United States Patent 8,445,666 (RIBONUCLEIC ACID INTERFERENCE MOLECULES) - sequence listing, part 8

SEQ ID NO: 199473 - DNA, 22 bp, Mus musculus
tgttttgtgaccaattatatgg

SEQ ID NO: 199474 - DNA, 23 bp, Mus musculus
atgtatatgtatatgtaagtgta

SEQ ID NO: 199475 - DNA, 22 bp, Mus musculus
tgttttgtgaccaattatatgg

SEQ ID NO: 199476 - DNA, 18 bp, Mus musculus
aatcattgcaagagtcag

SEQ ID NO: 199477 - DNA, 23 bp, Mus musculus
catatgtttgtatatatatgtac

SEQ ID NO: 199478 - DNA, 20 bp, Mus musculus
attctttatgtcatatactc

SEQ ID NO: 199479 - DNA, 21 bp, Mus musculus
tatctctcagactgagaggct

SEQ ID NO: 199480 - DNA, 23 bp, Mus musculus
tttccttcagtttctgcttcaga

SEQ ID NO: 199481 - DNA, 22 bp, Mus musculus
atatgtatatttgtatatgtgt

SEQ ID NO: 199482 - DNA, 23 bp, Mus musculus
atgtatgtatatatgtatgtatg

SEQ ID NO: 199483 - DNA, 23 bp, Mus musculus
tgtctagtcagtagagagtgagc

SEQ ID NO: 199484 - DNA, 23 bp, Mus musculus
gtctctatgtgtgtgtatatgta

SEQ ID NO: 199485 - DNA, 18 bp, Mus musculus
tggcatatgtatgtgtgt

SEQ ID NO: 199486 - DNA, 19 bp, Mus musculus
tctctctctcggtttgtta

SEQ ID NO: 199487 - DNA, 20 bp, Mus musculus
aggcaggttgaaattgaaca

SEQ ID NO: 199488 - DNA, 23 bp, Mus musculus
atatgtctgtgtttttcatccgc

SEQ ID NO: 199489 - DNA, 20 bp, Mus musculus
tgatctgaaattgaacggta

SEQ ID NO: 199490 - DNA, 20 bp, Mus musculus
tgatctgaaattgaacggta

SEQ ID NO: 199491 - DNA, 20 bp, Mus musculus
tgcctccctccctgttaggc

SEQ ID NO: 199492 - DNA, 23 bp, Mus musculus
ttattgaacatgttgttgtctgt

SEQ ID NO: 199493 - DNA, 21 bp, Mus musculus
attagataacacatgtaatct

SEQ ID NO: 199494 - DNA, 23 bp, Mus musculus
ttaaatgtagtatgaatgtgttt

SEQ ID NO: 199495 - DNA, 20 bp, Mus musculus
tactgagtgaacacagtggt

SEQ ID NO: 199496 - DNA, 23 bp, Mus musculus
aaggcagagagtgatgtagttat

SEQ ID NO: 199497 - DNA, 23 bp, Mus musculus
aaggcagagagtgatgtagttat

SEQ ID NO: 199498 - DNA, 22 bp, Mus musculus
tgttttgtgaccaattatatgg

SEQ ID NO: 199499 - DNA, 22 bp, Mus musculus
tgttttgtgaccaattatatgg

SEQ ID NO: 199500 - DNA, 22 bp, Mus musculus
tgttttgtgaccaattatatgg

SEQ ID NO: 199501 - DNA, 22 bp, Mus musculus
tgttttgtgaccaattatatgg

SEQ ID NO: 199502 - DNA, 19 bp, Mus musculus
tcttcgagccttaatgagg

SEQ ID NO: 199503 - DNA, 22 bp, Mus musculus
ttagaactgtaaaccttcaaat

SEQ ID NO: 199504 - DNA, 22 bp, Mus musculus
tacatcttcacgacctatctag

SEQ ID NO: 199505 - DNA, 23 bp, Mus musculus
tatatgtatatgtatacgtatac

SEQ ID NO: 199506 - DNA, 22 bp, Mus musculus
tgttttgtgaccaattatatgg

SEQ ID NO: 199507 - DNA, 23 bp, Mus musculus
actgacagtgacattcttgactg

SEQ ID NO: 199508 - DNA, 23 bp, Mus musculus
tatatctttatgtatatgtgtgt

SEQ ID NO: 199509 - DNA, 22 bp, Mus musculus
atatatgtgtgtgtgtatatgt

SEQ ID NO: 199510 - DNA, 18 bp, Mus musculus
gatttgatttaagactgg

SEQ ID NO: 199511 - DNA, 23 bp, Mus musculus
taaattggtcattttgttgttga

SEQ ID NO: 199512 - DNA, 20 bp, Mus musculus
aactgcaaaatgtctcctta

SEQ ID NO: 199513 - DNA, 19 bp, Mus musculus
atatacatacacatataca

SEQ ID NO: 199514 - DNA, 23 bp, Mus musculus
ataaaaggctgttattgtagttg

SEQ ID NO: 199515 - DNA, 21 bp, Mus musculus
ccgagtacaacagattgtcag

SEQ ID NO: 199516 - DNA, 23 bp, Mus musculus
agagctgagaacagagtgtggac

SEQ ID NO: 199517 - DNA, 23 bp, Mus musculus
tgtctgtgtccgtgtgtgtctgt

SEQ ID NO: 199518 - DNA, 21 bp, Mus musculus
tgatgatagatttagatctgt

SEQ ID NO: 199519 - DNA, 23 bp, Mus musculus
tataggtatatgtgtatgtgtgt

SEQ ID NO: 199520 - DNA, 19 bp, Mus musculus
atacatgtgtatatgtata

SEQ ID NO: 199521 - DNA, 23 bp, Mus musculus
gggacagagagcagagtgtgtgg

SEQ ID NO: 199522 - DNA, 22 bp, Mus musculus
agttctccaggtgatcctgcta

SEQ ID NO: 199523 - DNA, 23 bp, Mus musculus
tgactctgtgagtgtgtgtgtgt

SEQ ID NO: 199524 - DNA, 23 bp, Mus musculus
acagagaggctcagttctgatct

SEQ ID NO: 199525 - DNA, 18 bp, Mus musculus
gcctgtgtttctcagtgc

SEQ ID NO: 199526 - DNA, 23 bp, Mus musculus
caaaacagaattggctttcagtt

SEQ ID NO: 199527 - DNA, 20 bp, Mus musculus
ctaactgctctgcgatgaca

SEQ ID NO: 199528 - DNA, 20 bp, Mus musculus
tatatcacaacttttgtttg

SEQ ID NO: 199529 - DNA, 23 bp, Mus musculus
tatgtacatatgtatacatatgt

SEQ ID NO: 199530 - DNA, 23 bp, Mus musculus
tagtccatggtgatctgatagga

SEQ ID NO: 199531 - DNA, 23 bp, Mus musculus
caatatttttgtatctgttgagg

SEQ ID NO: 199532 - DNA, 23 bp, Mus musculus
aatggctatggaagaaaactcag

SEQ ID NO: 199533 - DNA, 22 bp, Mus musculus
tgttttgtgaccaattatatgg

SEQ ID NO: 199534 - DNA, 23 bp, Mus musculus
tggagtctcactgtctctgtctc

SEQ ID NO: 199535 - DNA, 23 bp, Mus musculus
tagctagtgcatttgttttggtc

SEQ ID NO: 199536 - DNA, 22 bp, Mus musculus
tgttttgtgaccaattatatgg

SEQ ID NO: 199537 - DNA, 21 bp, Mus musculus
tgttcttcagaaaactagtga

SEQ ID NO: 199538 - DNA, 23 bp, Mus musculus
actgaggtaggacttagaaaaca

SEQ ID NO: 199539 - DNA, 19 bp, Mus musculus
ttcttcatctcgtgctgtg

SEQ ID NO: 199540 - DNA, 23 bp, Mus musculus
tgcaggtagaagattgtgagcac

SEQ ID NO: 199541 - DNA, 22 bp, Mus musculus
tttcaagttcattctggtccat

SEQ ID NO: 199542 - DNA, 20 bp, Mus musculus
tgtttatatgtttcagtagt

SEQ ID NO: 199543 - DNA, 21 bp, Mus musculus
tccatggtggtctgataggat

SEQ ID NO: 199544 - DNA, 23 bp, Mus musculus
atgggatgtgtctggaatgggtt

SEQ ID NO: 199545 - DNA, 23 bp, Mus musculus
gtgtgtgagtgtacatgagcaca

SEQ ID NO: 199546 - DNA, 23 bp, Mus musculus
tcatttctgattttgttaattag

SEQ ID NO: 199547 - DNA, 23 bp, Mus musculus
ctgtctctctgtgtgtttgtact

SEQ ID NO: 199548 - DNA, 22 bp, Mus musculus
tgttttgtgaccaattatatgg

SEQ ID NO: 199549 - DNA, 23 bp, Mus musculus
tttgtgtgaaatctacttctgtg

SEQ ID NO: 199550 - DNA, 23 bp, Mus musculus
tagtgcatggtgatctgatagaa

SEQ ID NO: 199551 - DNA, 22 bp, Mus musculus
tgttttgtgacctattatgtgg

SEQ ID NO: 199552 - DNA, 23 bp, Mus musculus
tatgtgtgtgtattacatatgat

SEQ ID NO: 199553 - DNA, 22 bp, Mus musculus
tgttttgtgaccaattatatgg

SEQ ID NO: 199554 - DNA, 23 bp, Mus musculus
tatgtatatttgtatgtacatgt

SEQ ID NO: 199555 - DNA, 22 bp, Mus musculus
tgttttgtgaccaattatatgg

SEQ ID NO: 199556 - DNA, 19 bp, Mus musculus
ttgatttctctagctgcac

SEQ ID NO: 199557 - DNA, 23 bp, Mus musculus
tatgtgtatatatgcatatgtgt

SEQ ID NO: 199558 - DNA, 23 bp, Mus musculus
tatgtgtatgtgtatatgtgtgt

SEQ ID NO: 199559 - DNA, 22 bp, Mus musculus
tgttttgtgaccaattatatgg

SEQ ID NO: 199560 - DNA, 19 bp, Mus musculus
tgtgtatgtttatgtatat

SEQ ID NO: 199561 - DNA, 23 bp, Mus musculus
ttgagaagagtgctgttcagttt

SEQ ID NO: 199562 - DNA, 23 bp, Mus musculus
cttagtccatggtgatctgatag

SEQ ID NO: 199563 - DNA, 22 bp, Mus musculus
acatacacacaaatgtgtatgt

SEQ ID NO: 199564 - DNA, 23 bp, Mus musculus
aacagtgtgtgctaattacttgt

SEQ ID NO: 199565 - DNA, 20 bp, Mus musculus
tatgacactgattggcttat

SEQ ID NO: 199566 - DNA, 22 bp, Mus musculus
tgttttgtgaccaattatatgg

SEQ ID NO: 199567 - DNA, 20 bp, Mus musculus
tgtatacatgtatgtatatg

SEQ ID NO: 199568 - DNA, 23 bp, Mus musculus
tggaagagctaatagctaatttg

SEQ ID NO: 199569 - DNA, 21 bp, Mus musculus
tttgacaaattacattcagat

SEQ ID NO: 199570 - DNA, 22 bp, Mus musculus
tgagtctgtctgtcaattccct

SEQ ID NO: 199571 - DNA, 18 bp, Mus musculus
ggtattgtgaaaggtgtt

SEQ ID NO: 199572 - DNA, 22 bp, Mus musculus
tgtcagtgtagatatgtgtgtg

SEQ ID NO: 199573 - DNA, 22 bp, Mus musculus
gaagtgtcattccttatctttt

SEQ ID NO: 199574 - DNA, 19 bp, Mus musculus
atttgatatagaataggca

SEQ ID NO: 199575 - DNA, 20 bp, Mus musculus
ctgtggattcttaatcagga

SEQ ID NO: 199576 - DNA, 22 bp, Mus musculus
tttggtgagctacagctgactc

SEQ ID NO: 199577 - DNA, 23 bp, Mus musculus
aactgagaggtgagactcagcag

SEQ ID NO: 199578 - DNA, 21 bp, Mus musculus
atatgtatgtatatatgtgtg

SEQ ID NO: 199579 - DNA, 23 bp, Mus musculus
tatcaaaatcaccgtgtgtgtgt

SEQ ID NO: 199580 - DNA, 23 bp, Mus musculus
ccattgttgtcaggaagtcagtg

SEQ ID NO: 199581 - DNA, 21 bp, Mus musculus
actcagtggtattgattttgt

SEQ ID NO: 199582 - DNA, 18 bp, Mus musculus
tatgtatatgtatatgat

SEQ ID NO: 199583 - DNA, 21 bp, Mus musculus
tatatgtatatatgcatatgt

SEQ ID NO: 199584 - DNA, 23 bp, Mus musculus
tctatctgtctgtctgtctatct

SEQ ID NO: 199585 - DNA, 23 bp, Mus musculus
tagatagagatagatatgtgtag

SEQ ID NO: 199586 - DNA, 23 bp, Mus musculus
atatatgtatatgtattcctata

SEQ ID NO: 199587 - DNA, 23 bp, Mus musculus
cagtcaggagacagagagaagtt

SEQ ID NO: 199588 - DNA, 22 bp, Mus musculus
tactgagtagcttagatgtttt

SEQ ID NO: 199589 - DNA, 23 bp, Mus musculus
gagatgtttactgttcaagcatt

SEQ ID NO: 199590 - DNA, 23 bp, Mus musculus
agatagaggtagatagagataga

SEQ ID NO: 199591 - DNA, 23 bp, Mus musculus
atatgcatatgtatatgtctatg

SEQ ID NO: 199592 - DNA, 21 bp, Mus musculus
atatacagacatatggatatg

SEQ ID NO: 199593 - DNA, 23 bp, Mus musculus
gtcagtcagtcagtcagtcaatc

SEQ ID NO: 199594 - DNA, 23 bp, Mus musculus
ctatgagaggtttgttgtgtgca

SEQ ID NO: 199595 - DNA, 23 bp, Mus musculus
acgaaaactgatgtaagaaagac

SEQ ID NO: 199596 - DNA, 22 bp, Mus musculus
agaaaccacatggtggtttaca

SEQ ID NO: 199597 - DNA, 19 bp, Mus musculus
tcatgtggttcttggaaat

SEQ ID NO: 199598 - DNA, 23 bp, Mus musculus
aatgtatgcatatgtatatgtgt

SEQ ID NO: 199599 - DNA, 23 bp, Mus musculus
atatagtagaatgagcatatata

SEQ ID NO: 199600 - DNA, 23 bp, Mus musculus
tatgctggcttctctgtctctct

SEQ ID NO: 199601 - DNA, 23 bp, Mus musculus
gcctggttgtcagagttcaatcc

SEQ ID NO: 199602 - DNA, 20 bp, Mus musculus
gacacacacaggaatgcacg

SEQ ID NO: 199603 - DNA, 23 bp, Mus musculus
tgtctgtctgtctgtctgcttat

SEQ ID NO: 199604 - DNA, 23 bp, Mus musculus
tgtctgtgtgtctgtctgcatgc

SEQ ID NO: 199605 - DNA, 23 bp, Mus musculus
cactctctgtccctgagctcaat

SEQ ID NO: 199606 - DNA, 21 bp, Mus musculus
gccacatgatggggctgagga

SEQ ID NO: 199607 - DNA, 22 bp, Mus musculus
tgtgtctcagtcattcatctgt

SEQ ID NO: 199608 - DNA, 23 bp, Mus musculus
atagcagatatgcaacttggtct

SEQ ID NO: 199609 - DNA, 23 bp, Mus musculus
tggagctgagtttgtctttgtct

SEQ ID NO: 199610 - DNA, 23 bp, Mus musculus
cgtgcgtgcgtgcgtgcgtgcgt

SEQ ID NO: 199611 - DNA, 22 bp, Mus musculus
cgtgtgtgtgtctgctgcatgt

SEQ ID NO: 199612 - DNA, 23 bp, Mus musculus
tgtctgtttgtctatatgtatat

SEQ ID NO: 199613 - DNA, 20 bp, Mus musculus
atgtgtatgtttgtaagtat

SEQ ID NO: 199614 - DNA, 22 bp, Mus musculus
tgttttgtgaccaattatatgg

SEQ ID NO: 199615 - DNA, 19 bp, Mus musculus
tgtgcatacatatatgtgt

SEQ ID NO: 199616 - DNA, 23 bp, Mus musculus
ggcactgtgtctcactgggatat

SEQ ID NO: 199617 - DNA, 23 bp, Mus musculus
gatgctgtgaggattcttgagtg

SEQ ID NO: 199618 - DNA, 21 bp, Mus musculus
tctctctcagtttttctgtct

SEQ ID NO: 199619 - DNA, 20 bp, Mus musculus
tgcgtgtaagtatgtatgta

SEQ ID NO: 199620 - DNA, 23 bp, Mus musculus
ttgtaaatatacatgtatgtcca

SEQ ID NO: 199621 - DNA, 22 bp, Mus musculus
tgagtacatcttggcaaaccag

SEQ ID NO: 199622 - DNA, 22 bp, Mus musculus
tgaatgtatgcacacacacata

SEQ ID NO: 199623 - DNA, 23 bp, Mus musculus
tatgtgtatatatatgtgtgtgt

SEQ ID NO: 199624 - DNA, 18 bp, Mus musculus
ccacacacttactgtcac

SEQ ID NO: 199625 - DNA, 23 bp, Mus musculus
tggatggttctgagctgctatgt

SEQ ID NO: 199626 - DNA, 20 bp, Mus musculus
agcatgtgtgtatatatata

SEQ ID NO: 199627 - DNA, 23 bp, Mus musculus
tatacttgtatgtgtgtatgtat

SEQ ID NO: 199628 - DNA, 23 bp, Mus musculus
cactgtgctgtctgacctcagtg

SEQ ID NO: 199629 - DNA, 23 bp, Mus musculus
ctttaggctggaaaagttttctt

SEQ ID NO: 199630 - DNA, 23 bp, Mus musculus
agttaatctcacagcttcacagg

SEQ ID NO: 199631 - DNA, 23 bp, Mus musculus
aggcagatctcagtgagctcaag

SEQ ID NO: 199632 - DNA, 22 bp, Mus musculus
aaaattctggatatattcagta

SEQ ID NO: 199633 - DNA, 23 bp, Mus musculus
tctctctcgctctgttttatttc

SEQ ID NO: 199634 - DNA, 21 bp, Mus musculus
ctgactgctcttcctgaggtc

SEQ ID NO: 199635 - DNA, 23 bp, Mus musculus
tatatgtgtgtatatgaaatgta

SEQ ID NO: 199636 - DNA, 19 bp, Mus musculus
acacagggtgttagccagc

SEQ ID NO: 199637 - DNA, 23 bp, Mus musculus
ctatgtggagtctctggaggaac

SEQ ID NO: 199638 - DNA, 23 bp, Mus musculus
agttctctctgtgtgagtggcag

SEQ ID NO: 199639 - DNA, 23 bp, Mus musculus
gttctactgcaactgcaacagga

SEQ ID NO: 199640 - DNA, 22 bp, Mus musculus
tacagactcccagagttcactg

SEQ ID NO: 199641 - DNA, 22 bp, Mus musculus
taccatctagaaatggaggaaa

SEQ ID NO: 199642 - DNA, 22 bp, Mus musculus
tgtgcgcacatcctgctgtgag

SEQ ID NO: 199643 - DNA, 23 bp, Mus musculus
tctctgacagacatgtgtcactg

SEQ ID NO: 199644 - DNA, 23 bp, Mus musculus
tatgtctgtctgcctgcctgcct

SEQ ID NO: 199645 - DNA, 20 bp, Mus musculus
tattatggtgtttttcatgt

SEQ ID NO: 199646 - DNA, 20 bp, Mus musculus
actgggggaggtatatctct

SEQ ID NO: 199647 - DNA, 23 bp, Mus musculus
tggtctttgaggtttcagtctct

SEQ ID NO: 199648 - DNA, 23 bp, Mus musculus
tagttttaggattgcaaatcact

SEQ ID NO: 199649 - DNA, 23 bp, Mus musculus
agaactcaatttgtttttcaata

SEQ ID NO: 199650 - DNA, 23 bp, Mus musculus
tgtatatatgtatatatgtgtgt

SEQ ID NO: 199651 - DNA, 22 bp, Mus musculus
aactcaatatataatatagaag

SEQ ID NO: 199652 - DNA, 22 bp, Mus musculus
tgttttgtgaccaattatatgg

SEQ ID NO: 199653 - DNA, 22 bp, Mus musculus
tgttttgtgaccaattatatgg

SEQ ID NO: 199654 - DNA, 23 bp, Mus musculus
cagaagagagggaggactctgac

SEQ ID NO: 199655 - DNA, 23 bp, Mus musculus
tctcactgcttctctgtgtaact

SEQ ID NO: 199656 - DNA, 23 bp, Mus musculus
tgtatgtatgtatgtatatgtat

SEQ ID NO: 199657 - DNA, 19 bp, Mus musculus
tcagtcttctgctacggtg

SEQ ID NO: 199658 - DNA, 22 bp, Mus musculus
agagacaagtgagtctgcacat

SEQ ID NO: 199659 - DNA, 22 bp, Mus musculus
tgttttgtgaccaattatatgg

SEQ ID NO: 199660 - DNA, 23 bp, Mus musculus
cactggcaatagtttgtcaattc

SEQ ID NO: 199661 - DNA, 23 bp, Mus musculus
atttcattctgtttttaatggta

SEQ ID NO: 199662 - DNA, 23 bp, Mus musculus
aagacagtgagtggtgagagtga

SEQ ID NO: 199663 - DNA, 23 bp, Mus musculus
atgcaagtgcttagtgtgtaggt

SEQ ID NO: 199664 - DNA, 23 bp, Mus musculus
ctatctgtctgtctgtctgtctg

SEQ ID NO: 199665 - DNA, 22 bp, Mus musculus
tgttttgtgaccaattatatgg

SEQ ID NO: 199666 - DNA, 19 bp, Mus musculus
agagctgttcacatgtagg

SEQ ID NO: 199667 - DNA, 23 bp, Mus musculus
cagagtgacagttcactgtgtac

SEQ ID NO: 199668 - DNA, 21 bp, Mus musculus
atacacgttgatttccattct

SEQ ID NO: 199669 - DNA, 23 bp, Mus musculus
attctgagtctaaaagttgtagc

SEQ ID NO: 199670 - DNA, 22 bp, Mus musculus
tgttttgtgaccaattatatgg

SEQ ID NO: 199671 - DNA, 22 bp, Mus musculus
tctctctcactgtttctctctc

SEQ ID NO: 199672 - DNA, 23 bp, Mus musculus
atatagagaacatatatgtgtgt

SEQ ID NO: 199673 - DNA, 22 bp, Mus musculus
tgttttgtgaccaattatatgg

SEQ ID NO: 199674 - DNA, 23 bp, Mus musculus
ttgtggtttaagatatgttacct

SEQ ID NO: 199675 - DNA, 21 bp, Mus musculus
aaaatcagaaaatatttgtga

SEQ ID NO: 199676 - DNA, 23 bp, Mus musculus
catcacactggatgttctcattg

SEQ ID NO: 199677 - DNA, 21 bp, Mus musculus
agagacatctccttgaggact

SEQ ID NO: 199678 - DNA, 19 bp, Mus musculus
tctctgcatttgttcccat

SEQ ID NO: 199679 - DNA, 21 bp, Mus musculus
ttctgagcctctgtgagtcac

SEQ ID NO: 199680 - DNA, 22 bp, Mus musculus
tgttttgtgaccaattatatgg

SEQ ID NO: 199681 - DNA, 23 bp, Mus musculus
attcccagcatctgcaatgtgat

SEQ ID NO: 199682 - DNA, 21 bp, Mus musculus
tgtgtgcctgtgtgcctgtgt

SEQ ID NO: 199683 - DNA, 23 bp, Mus musculus
tgagcctgcatatgtgtgtgtgt

SEQ ID NO: 199684 - DNA, 23 bp, Mus musculus
tgtatgtgtgtatgtatatatct

SEQ ID NO: 199685 - DNA, 20 bp, Mus musculus
atatatgtctatgtgtatgt

SEQ ID NO: 199686 - DNA, 23 bp, Mus musculus
ccactcactctcagagaaacctc

SEQ ID NO: 199687 - DNA, 23 bp, Mus musculus
tgtgtctgtgtgtgtgtatgtgc

SEQ ID NO: 199688 - DNA, 23 bp, Mus musculus
gtcactcagtctcttccggttat

SEQ ID NO: 199689 - DNA, 18 bp, Mus musculus
tggaatggaaagaagaat

SEQ ID NO: 199690 - DNA, 19 bp, Mus musculus
tgtgtaggaagttctgtct

SEQ ID NO: 199691 - DNA, 21 bp, Mus musculus
agtgtgtacagactgaggtga

SEQ ID NO: 199692 - DNA, 22 bp, Mus musculus
tgttttgtgaccaattatatgg

SEQ ID NO: 199693 - DNA, 18 bp, Mus musculus
tctgttttcatgcacacg

SEQ ID NO: 199694 - DNA, 23 bp, Mus musculus
cactgtgactttcttctctgtct

SEQ ID NO: 199695 - DNA, 23 bp, Mus musculus
gagtatctgtatgtatatgtatg

SEQ ID NO: 199696 - DNA, 23 bp, Mus musculus
actttgagaactgttttagatga

SEQ ID NO: 199697 - DNA, 23 bp, Mus musculus
tcatctttataagatgatctcgg

SEQ ID NO: 199698 - DNA, 23 bp, Mus musculus
tttgtctgtctgtctgcctgtct

SEQ ID NO: 199699 - DNA, 23 bp, Mus musculus
atatatgtgcttatgtatatata

SEQ ID NO: 199700 - DNA, 22 bp, Mus musculus
tgttttgtgaccaattatatgg

SEQ ID NO: 199701 - DNA, 23 bp, Mus musculus
tagtgcatggtgatctgataaga

SEQ ID NO: 199702 - DNA, 18 bp, Mus musculus
tgttttgtgatcaattgt

SEQ ID NO: 199703 - DNA, 20 bp, Mus musculus
tgatagtaagtaataatgat

SEQ ID NO: 199704 - DNA, 23 bp, Mus musculus
tgtctgaatcaggtgctgggtgg

SEQ ID NO: 199705 - DNA, 23 bp, Mus musculus
gaggctctctcactcaaactgaa

SEQ ID NO: 199706 - DNA, 22 bp, Mus musculus
tgttttgtgaccaattatatgg

SEQ ID NO: 199707 - DNA, 22 bp, Mus musculus
ttatgaccaattatatggtcaa

SEQ ID NO: 199708 - DNA, 20 bp, Mus musculus
tatgcatatatatacatgta

SEQ ID NO: 199709 - DNA, 22 bp, Mus musculus
tgttttgtgaccaattatatgg

SEQ ID NO: 199710 - DNA, 23 bp, Mus musculus
caagagtgttgttctgtttccat

SEQ ID NO: 199711 - DNA, 21 bp, Mus musculus
cttagtccatggtgatctgat

SEQ ID NO: 199712 - DNA, 22 bp, Mus musculus
tgttttgtgaccaattatatgg

SEQ ID NO: 199713 - DNA, 21 bp, Mus musculus
tagacagagcacagtgtggtg

SEQ ID NO: 199714 - DNA, 19 bp, Mus musculus
tgaggtcttcatgtgggtc

SEQ ID NO: 199715 - DNA, 23 bp, Mus musculus
gagcactgactggtcttccagag

SEQ ID NO: 199716 - DNA, 23 bp, Mus musculus
tcagcaccagatgtctgtctcag

SEQ ID NO: 199717 - DNA, 22 bp, Mus musculus
atatatatatatgtatatgtgt

SEQ ID NO: 199718 - DNA, 22 bp, Mus musculus
catgtatgtatatatgtatatg

SEQ ID NO: 199719 - DNA, 23 bp, Mus musculus
ttgaccatcagacctttggttca

SEQ ID NO: 199720 - DNA, 23 bp, Mus musculus
actgagatgtcacagagctcatg

SEQ ID NO: 199721 - DNA, 23 bp, Mus musculus
tgtctgtctgtctgtctgtcgtg

SEQ ID NO: 199722 - DNA, 22 bp, Mus musculus
atgtgtgtatatatatatgtgt

SEQ ID NO: 199723 - DNA, 21 bp, Mus musculus
gtatgtatgtatgtgtgtatg

SEQ ID NO: 199724 - DNA, 19 bp, Mus musculus
acagggagggactgaagat

SEQ ID NO: 199725 - DNA, 20 bp, Mus musculus
ttcactgttgacacatgggc

SEQ ID NO: 199726 - DNA, 23 bp, Mus musculus
ttcagttgtgattttgatgagca

SEQ ID NO: 199727 - DNA, 20 bp, Mus musculus
tctcacagagatacatctga

SEQ ID NO: 199728 - DNA, 22 bp, Mus musculus
tatatatatatgtgtgtgtgta

SEQ ID NO: 199729 - DNA, 22 bp, Mus musculus
tatacacacatgtatacacaca

SEQ ID NO: 199730 - DNA, 22 bp, Mus musculus
aaggcgaattggaaatgtgtga

SEQ ID NO: 199731 - DNA, 23 bp, Mus musculus
tggcagtctgagtctctctatta

SEQ ID NO: 199732 - DNA, 22 bp, Mus musculus
atgaggtagtaccttgtgctca

SEQ ID NO: 199733 - DNA, 23 bp, Mus musculus
aaagaccctggttcaattctcag

SEQ ID NO: 199734 - DNA, 22 bp, Mus musculus
tgttttgtgaccaattatatgg

SEQ ID NO: 199735 - DNA, 23 bp, Mus musculus
ctgtggcactgtcactctgtagc

SEQ ID NO: 199736 - DNA, 23 bp, Mus musculus
tgtgagtgtgtatatatgtatgt

SEQ ID NO: 199737 - DNA, 23 bp, Mus musculus
gtgcttctctcactgcttctcga

SEQ ID NO: 199738 - DNA, 23 bp, Mus musculus
tctctctgcaggtgtgtatgttt

SEQ ID NO: 199739 - DNA, 21 bp, Mus musculus
agcagtctgctcttccagagg

SEQ ID NO: 199740 - DNA, 23 bp, Mus musculus
tgtatgcatgtattatgtggtat

SEQ ID NO: 199741 - DNA, 22 bp, Mus musculus
tgagtgggtttgaccagggctc

SEQ ID NO: 199742 - DNA, 20 bp, Mus musculus
tgtatgagtgtttatgtacg

SEQ ID NO: 199743 - DNA, 23 bp, Mus musculus
tgtctcagaggtagaacagtgcg

SEQ ID NO: 199744 - DNA, 20 bp, Mus musculus
acacagctgacactgaggtc

SEQ ID NO: 199745 - DNA, 23 bp, Mus musculus
tgtctgtctgtctgtctgtctgt

SEQ ID NO: 199746 - DNA, 22 bp, Mus musculus
atatgtatacatgtatatgtgt

SEQ ID NO: 199747 - DNA, 22 bp, Mus musculus
tatgtatatatacatgtatatg

SEQ ID NO: 199748 - DNA, 23 bp, Mus musculus
gtatgcctgtgtgtgtgcgtgtg

SEQ ID NO: 199749 - DNA, 22 bp, Mus musculus
atacgtgctatgtgtttacatg

SEQ ID NO: 199750 - DNA, 20 bp, Mus musculus
tgtgtatacatgtgtgtgca

SEQ ID NO: 199751 - DNA, 22 bp, Mus musculus
atgtgtatatgtatatgtgtgc

SEQ ID NO: 199752 - DNA, 22 bp, Mus musculus
tgtgtgtatatatatatgtgtg

SEQ ID NO: 199753 - DNA, 19 bp, Mus musculus
gtcaggagaaacagagcac

SEQ ID NO: 199754 - DNA, 23 bp, Mus musculus
tcaccttttgagttcttaagcct

SEQ ID NO: 199755 - DNA, 19 bp, Mus musculus
aggaaaggcaggaatgagt

SEQ ID NO: 199756 - DNA, 23 bp, Mus musculus
gtgtacctgcatgtgcatgtgca

SEQ ID NO: 199757 - DNA, 21 bp, Mus musculus
tatacttgtttacacatggac

SEQ ID NO: 199758 - DNA, 19 bp, Mus musculus
tgtcagaagacagtgagaa

SEQ ID NO: 199759 - DNA, 23 bp, Mus musculus
tgaggatatgactatgatctatg

SEQ ID NO: 199760 - DNA, 23 bp, Mus musculus
tggtatgtaaacttgtatactga

SEQ ID NO: 199761 - DNA, 20 bp, Mus musculus
acggtgtgtacactctctct

SEQ ID NO: 199762 - DNA, 22 bp, Mus musculus
tgttttgtgaccaattatatgg

SEQ ID NO: 199763 - DNA, 22 bp, Mus musculus
tgttttgtgaccaattatatgg

SEQ ID NO: 199764 - DNA, 23 bp, Mus musculus
acacataacacacaggcatgcat

SEQ ID NO: 199765 - DNA, 22 bp, Mus musculus
ttctggttgctgtatgtgtgtg

SEQ ID NO: 199766 - DNA, 23 bp, Mus musculus
tagtccatgttggtctgatagga

SEQ ID NO: 199767 - DNA, 23 bp, Mus musculus
atctgttgagacctgttttgtgt

SEQ ID NO: 199768 - DNA, 22 bp, Mus musculus
gtcatcttccctctccctcagc

SEQ ID NO: 199769 - DNA, 18 bp, Mus musculus
gagcttctgacagtcaag

SEQ ID NO: 199770 - DNA, 20 bp, Mus musculus
tatgtatgtatgtatgtatc

SEQ ID NO: 199771 - DNA, 23 bp, Mus musculus
cgactgtgtctctgatttcatgg

SEQ ID NO: 199772 - DNA, 23 bp, Mus musculus
tttgtgtgtgcttaagatttcat

SEQ ID NO: 199773 - DNA, 23 bp, Mus musculus
ttatgtgcatgtgcatgtatatg

SEQ ID NO: 199774 - DNA, 21 bp, Mus musculus
atatgtgatatgtatgcacat

SEQ ID NO: 199775 - DNA, 20 bp, Mus musculus
tctcaaaagttgatgtagtt

SEQ ID NO: 199776 - DNA, 20 bp, Mus musculus
tttgactgagatgggaaagc

SEQ ID NO: 199777 - DNA, 23 bp, Mus musculus
ttgctgtgacaaaacaccatgat

SEQ ID NO: 199778 - DNA, 18 bp, Mus musculus
tgagtacactgtagctgt

SEQ ID NO: 199779 - DNA, 23 bp, Mus musculus
catgtaggttgtatgtatgtatg

SEQ ID NO: 199780 - DNA, 23 bp, Mus musculus
ctatgagcatttcatttctatgt

SEQ ID NO: 199781 - DNA, 23 bp, Mus musculus
tgcgtgcgtgcgtgcgtgcgtgc

SEQ ID NO: 199782 - DNA, 22 bp, Mus musculus
tgttttgtgaccaattatatgg

SEQ ID NO: 199783 - DNA, 19 bp, Mus musculus
caccctgtactcatggcag

SEQ ID NO: 199784 - DNA, 19 bp, Mus musculus
tgtaagaagagtgtgagca

SEQ ID NO: 199785 - DNA, 22 bp, Mus musculus
tctcactgtcattcagtctgat

SEQ ID NO: 199786 - DNA, 21 bp, Mus musculus
atcaagtggccataggtgtgt

SEQ ID NO: 199787 - DNA, 19 bp, Mus musculus
ctgtctgtctgtctctatg

SEQ ID NO: 199788 - DNA, 22 bp, Mus musculus
gtctgaccttgtaaaatgagct

SEQ ID NO: 199789 - DNA, 22 bp, Mus musculus
tgttttgtgaccaattatatgg

SEQ ID NO: 199790 - DNA, 22 bp, Mus musculus
tgttttgtgaccaattatatgg

SEQ ID NO: 199791 - DNA, 23 bp, Mus musculus
acttttactgctactgcatggaa

SEQ ID NO: 199792 - DNA, 23 bp, Mus musculus
agagagacaagatcaggattcct

SEQ ID NO: 199793 - DNA, 22 bp, Mus musculus
ttctcatctgtggctctctcac

SEQ ID NO: 199794 - DNA, 23 bp, Mus musculus
tctatatctatatgtctatatct

SEQ ID NO: 199795 - DNA, 23 bp, Mus musculus
gcacagagagtacactgtcacct

SEQ ID NO: 199796 - DNA, 22 bp, Mus musculus
caggatgcttttcatatgcttc

SEQ ID NO: 199797 - DNA, 19 bp, Mus musculus
actgtatttggaaactggt

SEQ ID NO: 199798 - DNA, 19 bp, Mus musculus
atatatgtgtgtttatcta

SEQ ID NO: 199799 - DNA, 23 bp, Mus musculus
tgagtgattttgatattgtcttg

SEQ ID NO: 199800 - DNA, 20 bp, Mus musculus
tatgtgtgtgtacatatgta

SEQ ID NO: 199801 - DNA, 18 bp, Mus musculus
aatagatattatgtagat

SEQ ID NO: 199802 - DNA, 22 bp, Mus musculus
tgttttgtgaccaattatatgg

SEQ ID NO: 199803 - DNA, 22 bp, Mus musculus
tgacttggacttgtgtaggtct

SEQ ID NO: 199804 - DNA, 23 bp, Mus musculus
ggctgtcacagtctctgtgagtt

SEQ ID NO: 199805 - DNA, 22 bp, Mus musculus
tgttttgtgaccaattatatgg

SEQ ID NO: 199806 - DNA, 22 bp, Mus musculus
tgacttgcaattgttttttact

SEQ ID NO: 199807 - DNA, 23 bp, Mus musculus
aaacatcatgaccaagaagcaag

SEQ ID NO: 199808 - DNA, 19 bp, Mus musculus
aggttcttgctgttgatgc

SEQ ID NO: 199809 - DNA, 22 bp, Mus musculus
tgttttgtgaccaattatatgg

SEQ ID NO: 199810 - DNA, 23 bp, Mus musculus
ttgtgtgagtgcatgtggatatg

SEQ ID NO: 199811 - DNA, 23 bp, Mus musculus
aggatgagaagtgttttagttat

SEQ ID NO: 199812 - DNA, 23 bp, Mus musculus
ttatcttcagttgtgtgcacact

SEQ ID NO: 199813 - DNA, 23 bp, Mus musculus
tgtctgtctgtctctctgtctct

SEQ ID NO: 199814 - DNA, 19 bp, Mus musculus
gtagggtgtttgcttctgt

SEQ ID NO: 199815 - DNA, 20 bp, Mus musculus
aagagcactgactgctcttc

SEQ ID NO: 199816 - DNA, 23 bp, Mus musculus
agggactgactgtgtctaattcc

SEQ ID NO: 199817 - DNA, 23 bp, Mus musculus
tctgtgtgtctgactctgtgtgt

SEQ ID NO: 199818 - DNA, 23 bp, Mus musculus
aacttgcaactcagtgagtctca

SEQ ID NO: 199819 - DNA, 21 bp, Mus musculus
aagctgcatctagaaggtttt

SEQ ID NO: 199820 - DNA, 23 bp, Mus musculus
acaaatatatgtatgcagaaagt

SEQ ID NO: 199821 - DNA, 23 bp, Mus musculus
ctctcacagtctgtgttccaggt

SEQ ID NO: 199822 - DNA, 18 bp, Mus musculus
ggtgtctatacttctttg

SEQ ID NO: 199823 - DNA, 23 bp, Mus musculus
tttcatccttatgttttgtcttt

SEQ ID NO: 199824 - DNA, 18 bp, Mus musculus
gacacaggttcagctctg

SEQ ID NO: 199825 - DNA, 18 bp, Mus musculus
tggctgtgtgtggggctg

SEQ ID NO: 199826 - DNA, 23 bp, Mus musculus
agctacactgtgtacagttaggg

SEQ ID NO: 199827 - DNA, 23 bp, Mus musculus
tgtattcaaaagaagtaagcaga

SEQ ID NO: 199828 - DNA, 22 bp, Mus musculus
tatgtgcaggtctgtgtgtgtg

SEQ ID NO: 199829 - DNA, 21 bp, Mus musculus
tacacacaagtcacagtgcac

SEQ ID NO: 199830 - DNA, 23 bp, Mus musculus
tgatggtactcacacagtgtgtc

SEQ ID NO: 199831 - DNA, 23 bp, Mus musculus
ctgagtcagtgttgatactgtcc

SEQ ID NO: 199832 - DNA, 18 bp, Mus musculus
tgtgcatgtatgtatata

SEQ ID NO: 199833 - DNA, 23 bp, Mus musculus
tatgtgtatctatatatgtgtgt

SEQ ID NO: 199834 - DNA, 21 bp, Mus musculus
tctctgtgtgtgtgtgcatgt

SEQ ID NO: 199835 - DNA, 23 bp, Mus musculus
tgcatatgtaaaatgtttggtga

SEQ ID NO: 199836 - DNA, 23 bp, Mus musculus
agactgttcagagagtgcatcct

SEQ ID NO: 199837 - DNA, 23 bp, Mus musculus
atgtttgcttatgaatctgtatg

SEQ ID NO: 199838 - DNA, 23 bp, Mus musculus
tgtgcatgtgcatgtgcatgtat

SEQ ID NO: 199839 - DNA, 18 bp, Mus musculus
agacccaagtgtcctgct

SEQ ID NO: 199840 - DNA, 23 bp, Mus musculus
tctctctgtgtatgtgtgtgtga

SEQ ID NO: 199841 - DNA, 21 bp, Mus musculus
gtgtgtcactgtgggcatggg

SEQ ID NO: 199842 - DNA, 22 bp, Mus musculus
tatgtatgtacatgtatacata

SEQ ID NO: 199843 - DNA, 23 bp, Mus musculus
tgaacccactagaagggcttcag

SEQ ID NO: 199844 - DNA, 23 bp, Mus musculus
gaagctgagaacatggaggtatg

SEQ ID NO: 199845 - DNA, 23 bp, Mus musculus
atcactctctctgactcaagatt

SEQ ID NO: 199846 - DNA, 23 bp, Mus musculus
cagcctcacacagtggctgcatc

SEQ ID NO: 199847 - DNA, 22 bp, Mus musculus
acagtgtgtagacagtgtgcag

SEQ ID NO: 199848 - DNA, 20 bp, Mus musculus
acagtgtgtagacagtgtgc

SEQ ID NO: 199849 - DNA, 23 bp, Mus musculus
aaacatcatgaccaagaagcaag

SEQ ID NO: 199850 - DNA, 23 bp, Mus musculus
tgacagttgagtatgtgatcttc

SEQ ID NO: 199851 - DNA, 20 bp, Mus musculus
atagctcagtggttgactga

SEQ ID NO: 199852 - DNA, 23 bp, Mus musculus
tgactgtctcctgtctctctcac

SEQ ID NO: 199853 - DNA, 23 bp, Mus musculus
gtgtctctgtctactagagctga

SEQ ID NO: 199854 - DNA, 23 bp, Mus musculus
tgagtgagtgagtgagtgagtga

SEQ ID NO: 199855 - DNA, 21 bp, Mus musculus
tgtatgtatgtattcatgtgt

SEQ ID NO: 199856 - DNA, 21 bp, Mus musculus
tgagaagaaattcctgtccag

SEQ ID NO: 199857 - DNA, 21 bp, Mus musculus
atgaaagtgagttgggagctg

SEQ ID NO: 199858 - DNA, 23 bp, Mus musculus
agagatgagtgtgttcacagtga

SEQ ID NO: 199859 - DNA, 19 bp, Mus musculus
ctgcctgcctgcctgcctc

SEQ ID NO: 199860 - DNA, 22 bp, Mus musculus
tgtatggatctgtgtgtgtgtg

SEQ ID NO: 199861 - DNA, 23 bp, Mus musculus
tgtatccctgtgaaacttcacac

SEQ ID NO: 199862 - DNA, 20 bp, Mus musculus
tatcaactggagatagcttc

SEQ ID NO: 199863 - DNA, 23 bp, Mus musculus
ttccatatgtatatgtgtgtgtt

SEQ ID NO: 199864 - DNA, 23 bp, Mus musculus
agagagacactgagcgactgaac

SEQ ID NO: 199865 - DNA, 22 bp, Mus musculus
aaaagctcagtgcccaccctca

SEQ ID NO: 199866 - DNA, 23 bp, Mus musculus
tatgtatgtatatacgtatgtat

SEQ ID NO: 199867 - DNA, 22 bp, Mus musculus
atatgtatgtatgtatgtgtgt

SEQ ID NO: 199868 - DNA, 21 bp, Mus musculus
gtctcagactgactctgtctc

SEQ ID NO: 199869 - DNA, 23 bp, Mus musculus
tctgtctgtctgtctgactgtct

SEQ ID NO: 199870 - DNA, 22 bp, Mus musculus
tgttttgtgaccaattatatgg

SEQ ID NO: 199871 - DNA, 23 bp, Mus musculus
taatttttcagtcgagcctcaga

SEQ ID NO: 199872 - DNA, 20 bp, Mus musculus
tctctgtatctctctgtctc

SEQ ID NO: 199873 - DNA, 23 bp, Mus musculus
tgtgagctagtagtttcttttct

SEQ ID NO: 199874 - DNA, 20 bp, Mus musculus
aaggacaatagagaggccgt

SEQ ID NO: 199875 - DNA, 23 bp, Mus musculus
agtgtgtggatttgtaatgcaat

SEQ ID NO: 199876 - DNA, 20 bp, Mus musculus
ccatggtgatctgataggat

SEQ ID NO: 199877 - DNA, 20 bp, Mus musculus
tatcttcttcaaggttagtc

SEQ ID NO: 199878 - DNA, 19 bp, Mus musculus
gtttgtctgtctggctctg

SEQ ID NO: 199879 - DNA, 23 bp, Mus musculus
gcaatgtatgtaagtatgtgtgt

SEQ ID NO: 199880 - DNA, 23 bp, Mus musculus
caggctcagtctgtctctctctg

SEQ ID NO: 199881 - DNA, 22 bp, Mus musculus
ttgaacttgtgcaggtcctgtg

SEQ ID NO: 199882 - DNA, 23 bp, Mus musculus
ctgtcacagtctctgtgggtttg

SEQ ID NO: 199883 - DNA, 22 bp, Mus musculus
tatatgtatatttcctatgtat

SEQ ID NO: 199884 - DNA, 23 bp, Mus musculus
tgtagtgagtgttgtgtgtatgt

SEQ ID NO: 199885 - DNA, 20 bp, Mus musculus
aagtgttctgtctttcaatt

SEQ ID NO: 199886 - DNA, 23 bp, Mus musculus
gtatgtatgtatgtatgtgtgtg

SEQ ID NO: 199887 - DNA, 18 bp, Mus musculus
gagagaagtgagtgatgg

SEQ ID NO: 199888 - DNA, 21 bp, Mus musculus
aaatgagatgtgagagagcag

SEQ ID NO: 199889 - DNA, 22 bp, Mus musculus
taaagcagaagagggtgccaga

SEQ ID NO: 199890 - DNA, 23 bp, Mus musculus
gtgagcaaagttgtgtggatgct

SEQ ID NO: 199891 - DNA, 18 bp, Mus musculus
aggactgtgcctatcttc

SEQ ID NO: 199892 - DNA, 23 bp, Mus musculus
tggtgctgtgtctctctctgtat

SEQ ID NO: 199893 - DNA, 23 bp, Mus musculus
gctggctctgtctggctgtgtgt

SEQ ID NO: 199894 - DNA, 21 bp, Mus musculus
gtgtctgagtttggtgattat

SEQ ID NO: 199895 - DNA, 23 bp, Mus musculus
ccacactctgtctctgtaatttc

SEQ ID NO: 199896 - DNA, 23 bp, Mus musculus
ctgtctgtgtgtctgtgtgtaca

SEQ ID NO: 199897 - DNA, 23 bp, Mus musculus
tatattcatgtagtgtatgtgtg

SEQ ID NO: 199898 - DNA, 23 bp, Mus musculus
catatatatgtatgcacatgtgt

SEQ ID NO: 199899 - DNA, 22 bp, Mus musculus
attgatttacccatttctgtct

SEQ ID NO: 199900 - DNA, 23 bp, Mus musculus
ataagatagaagtcgctgagcac

SEQ ID NO: 199901 - DNA, 23 bp, Mus musculus
gtatatgtgcatgttcatgtgtt

SEQ ID NO: 199902 - DNA, 21 bp, Mus musculus
tctgtgcatgtgtgcatgggt

SEQ ID NO: 199903 - DNA, 23 bp, Mus musculus
ttacacactggatgaattcagtt

SEQ ID NO: 199904 - DNA, 22 bp, Mus musculus
tgttttgtgaccaattatatgg

SEQ ID NO: 199905 - DNA, 20 bp, Mus musculus
gtgtctatctgtctgtctgt

SEQ ID NO: 199906 - DNA, 23 bp, Mus musculus
gtgatacacagtcagtctctgag

SEQ ID NO: 199907 - DNA, 22 bp, Mus musculus
ctccagtctctgtctgtctggc

SEQ ID NO: 199908 - DNA, 18 bp, Mus musculus
agtccatggtcatttaat

SEQ ID NO: 199909 - DNA, 22 bp, Mus musculus
tgttttgtgaccaattatatgg

SEQ ID NO: 199910 - DNA, 18 bp, Mus musculus
ctgaggatgatatttggt

SEQ ID NO: 199911 - DNA, 18 bp, Mus musculus
tatagtggtaggatatta

SEQ ID NO: 199912 - DNA, 23 bp, Mus musculus
tcacacacagtctcagaatgttg

SEQ ID NO: 199913 - DNA, 22 bp, Mus musculus
tatgtatgtatgtatgtatgta

SEQ ID NO: 199914 - DNA, 22 bp, Mus musculus
tcttgaagtttcagaggaacat

SEQ ID NO: 199915 - DNA, 23 bp, Mus musculus
tttctgggtctggataatttcac

SEQ ID NO: 199916 - DNA, 23 bp, Mus musculus
ctaacagtgtttgaggagattgt

SEQ ID NO: 199917 - DNA, 22 bp, Mus musculus
ttgctgctgctgctgctgtttg

SEQ ID NO: 199918 - DNA, 23 bp, Mus musculus
atcgattctcacagtggctgtac

SEQ ID NO: 199919 - DNA, 23 bp, Mus musculus
cagagcctcactctctgcttcag

SEQ ID NO: 199920 - DNA, 20 bp, Mus musculus
ttggaacagttatagttcag

SEQ ID NO: 199921 - DNA, 22 bp, Mus musculus
gggaagactgtgtgagttccac

SEQ ID NO: 199922 - DNA, 20 bp, Mus musculus
tgagctacaaggttgtaaga

SEQ ID NO: 199923 - DNA, 23 bp, Mus musculus
agatgactgtgtgttattttctc

SEQ ID NO: 199924 - DNA, 21 bp, Mus musculus
aaaagagcaccaggaatcatg

SEQ ID NO: 199925 - DNA, 23 bp, Mus musculus
tatatgcatatgtatgtgtatgt

SEQ ID NO: 199926 - DNA, 22 bp, Mus musculus
aagtccttgctctgcagcctct

SEQ ID NO: 199927 - DNA, 19 bp, Mus musculus
tcactgatgatatgagcct

SEQ ID NO: 199928 - DNA, 23 bp, Mus musculus
tctcgctctcactccttcacctg

SEQ ID NO: 199929 - DNA, 23 bp, Mus musculus
tgtgtgtgtgtattacatgtgag

SEQ ID NO: 199930 - DNA, 23 bp, Mus musculus
ctttctctcactgtctttcttct

SEQ ID NO: 199931 - DNA, 23 bp, Mus musculus
agacagacaggcagacagacagg

SEQ ID NO: 199932 - DNA, 23 bp, Mus musculus
gagtctgactcagtccctgcttc

SEQ ID NO: 199933 - DNA, 20 bp, Mus musculus
tctgagagaaggcttctggg

SEQ ID NO: 199934 - DNA, 23 bp, Mus musculus
tctgtatatgtatatgtgtatgt

SEQ ID NO: 199935 - DNA, 18 bp, Mus musculus
atatatgtacatatgtat

SEQ ID NO: 199936 - DNA, 23 bp, Mus musculus
tatgtgtgtgtatgcatgtgtat

SEQ ID NO: 199937 - DNA, 23 bp, Mus musculus
tgaggtataaagttgtgtttgtc

SEQ ID NO: 199938 - DNA, 22 bp, Mus musculus
tgttttgtgaccaattatatgg

SEQ ID NO: 199939 - DNA, 22 bp, Mus musculus
tatgtatgtgtgcatatgtgtg

SEQ ID NO: 199940 - DNA, 23 bp, Mus musculus
tgtgtgtatgtgtgtgtgcatgt

SEQ ID NO: 199941 - DNA, 22 bp, Mus musculus
tatgtatgtatgtatgtatgta

SEQ ID NO: 199942 - DNA, 23 bp, Mus musculus
tgtatgtatggtctggcagcctt

SEQ ID NO: 199943 - DNA, 23 bp, Mus musculus
tgtgcatgcatgtgtatgtgtat

SEQ ID NO: 199944 - DNA, 23 bp, Mus musculus
ctcacaggctcactctgggtctg

SEQ ID NO: 199945 - DNA, 22 bp, Mus musculus
acacacagagctaaggttctgg

SEQ ID NO: 199946 - DNA, 22 bp, Mus musculus
tatgtgcacatgtaggtatata

SEQ ID NO: 199947 - DNA, 18 bp, Mus musculus
atatgtgtgcatatatgt

SEQ ID NO: 199948 - DNA, 23 bp, Mus musculus
agtgtgtatgttctaaatgtgct

SEQ ID NO: 199949 - DNA, 23 bp, Mus musculus
cacacacacacactggaaacaca

SEQ ID NO: 199950 - DNA, 23 bp, Mus musculus
taacacacactctgttttacaag

SEQ ID NO: 199951 - DNA, 21 bp, Mus musculus
tgtgagagcttctgcagaggg

SEQ ID NO: 199952 - DNA, 22 bp, Mus musculus
taagagcctgtactggcacagt

SEQ ID NO: 199953 - DNA, 22 bp, Mus musculus
cagactcagtcagtccctcagc

SEQ ID NO: 199954 - DNA, 20 bp, Mus musculus
cagctgctcacagtgctctg

SEQ ID NO: 199955 - DNA, 22 bp, Mus musculus
agagagatgtttgagagaagaa

SEQ ID NO: 199956 - DNA, 23 bp, Mus musculus
acactggctctgagaattagggc

SEQ ID NO: 199957 - DNA, 21 bp, Mus musculus
agaggacagctatgctagact

SEQ ID NO: 199958 - DNA, 20 bp, Mus musculus
ttgagatggtcacggagttt

SEQ ID NO: 199959 - DNA, 23 bp, Mus musculus
tatgtatgtatatatgtgtgcat

SEQ ID NO: 199960 - DNA, 23 bp, Mus musculus
agtgtcactgacagactgtgtgg

SEQ ID NO: 199961 - DNA, 20 bp, Mus musculus
tgtgattttgtgtgtatgtg

SEQ ID NO: 199962 - DNA, 20 bp, Mus musculus
tatttgtgcatgtatatata

SEQ ID NO: 199963 - DNA, 21 bp, Mus musculus
acaggcagagcatcaagagag

SEQ ID NO: 199964 - DNA, 22 bp, Mus musculus
agtgtgagcacagtgtgagcaa

SEQ ID NO: 199965 - DNA, 18 bp, Mus musculus
tgcctgcctgcctgtctg

SEQ ID NO: 199966 - DNA, 23 bp, Mus musculus
tatcactgagtcattaaggcctg

SEQ ID NO: 199967 - DNA, 21 bp, Mus musculus
tccctctctgtatctctctgc

SEQ ID NO: 199968 - DNA, 23 bp, Mus musculus
tttgagaggaggtttgagacttg

SEQ ID NO: 199969 - DNA, 18 bp, Mus musculus
tcatgtgatgtaagcatg

SEQ ID NO: 199970 - DNA, 18 bp, Mus musculus
actcactctgtaacttga

SEQ ID NO: 199971 - DNA, 23 bp, Mus musculus
acacactgagtctttgggcttgg

SEQ ID NO: 199972 - DNA, 22 bp, Mus musculus
gtctctctattctgcttctgtt

SEQ ID NO: 199973 - DNA, 23 bp, Mus musculus
tgtctcagtgcaagttcatttgt

SEQ ID NO: 199974 - DNA, 23 bp, Mus musculus
cagtgctcagtctcagtctcggt

SEQ ID NO: 199975 - DNA, 22 bp, Mus musculus
tgtcagggcaaagagtgtgcag

SEQ ID NO: 199976 - DNA, 23 bp, Mus musculus
tgtgtgtgtgtgacacacttact

SEQ ID NO: 199977 - DNA, 23 bp, Mus musculus
tgtatgtgtgtgtatgcatgtgt

SEQ ID NO: 199978 - DNA, 23 bp, Mus musculus
cactggtcacactgagtcctcag

SEQ ID NO: 199979 - DNA, 23 bp, Mus musculus
ctgtactgactggttttgtgtca

SEQ ID NO: 199980 - DNA, 23 bp, Mus musculus
tgacagaagctagagtcatcaga

SEQ ID NO: 199981 - DNA, 23 bp, Mus musculus
tctgtctctctgtgtctctccct

SEQ ID NO: 199982 - DNA, 20 bp, Mus musculus
attccatgcacttcttggct

SEQ ID NO: 199983 - DNA, 23 bp, Mus musculus
gtgaggctgtctcactcagtgca

SEQ ID NO: 199984 - DNA, 22 bp, Mus musculus
accaaggcactgagtgacatca

SEQ ID NO: 199985 - DNA, 23 bp, Mus musculus
atactcattggtatggaatgtga

SEQ ID NO: 199986 - DNA, 21 bp, Mus musculus
ttgtaaacagagggtaggttc

SEQ ID NO: 199987 - DNA, 23 bp, Mus musculus
gtgtgtatgtgtgtgtgtcttat

SEQ ID NO: 199988 - DNA, 19 bp, Mus musculus
acacagagtgagaatatac

SEQ ID NO: 199989 - DNA, 23 bp, Mus musculus
aggtgacagtgaggtgacctgtt

SEQ ID NO: 199990 - DNA, 19 bp, Mus musculus
tgtcactgcttctgatgag

SEQ ID NO: 199991 - DNA, 22 bp, Mus musculus
tgttttgtgaccaattatatgg

SEQ ID NO: 199992 - DNA, 19 bp, Mus musculus
tctctatatgtatatatgt

SEQ ID NO: 199993 - DNA, 22 bp, Mus musculus
tgttttgtgaccaattatatgg

SEQ ID NO: 199994 - DNA, 18 bp, Mus musculus
gagtctgggaaagctgag

SEQ ID NO: 199995 - DNA, 23 bp, Mus musculus
acccagactgtctctgtatctcc

SEQ ID NO: 199996 - DNA, 20 bp, Mus musculus
tcagtctgtctctatgtgtc

SEQ ID NO: 199997 - DNA, 23 bp, Mus musculus
aagttcaagagacactgctatgc

SEQ ID NO: 199998 - DNA, 20 bp, Mus musculus
agtctctcagacagttattt

SEQ ID NO: 199999 - DNA, 23 bp, Mus musculus
ctctcagagtctcagagtatcta

SEQ ID NO: 200000 - DNA, 22 bp, Mus musculus
tctgcatgtatgtatgtatgta

SEQ ID NO: 200001 - DNA, 23 bp, Mus musculus
tgtatgcatgcatgtatgtgtag

SEQ ID NO: 200002 - DNA, 23 bp, Mus musculus
ctgtcacctacaggaccagctgc

SEQ ID NO: 200003 - DNA, 23 bp, Mus musculus
tgtatgtatgtatgtatatgtgt

SEQ ID NO: 200004 - DNA, 20 bp, Mus musculus
tgtgtatatgtatatatgtg

SEQ ID NO: 200005 - DNA, 20 bp, Mus musculus
tacatgtatgtatatgtgta

SEQ ID NO: 200006 - DNA, 19 bp, Mus musculus
gtgtgcagatctctgtatt

SEQ ID NO: 200007 - DNA, 23 bp, Mus musculus
ataaatctagattctgcatctag

SEQ ID NO: 200008 - DNA, 23 bp, Mus musculus
tgactgattagagagagctgaga

SEQ ID NO: 200009 - DNA, 23 bp, Mus musculus
cactgttatgctgtgacttctgt

SEQ ID NO: 200010 - DNA, 23 bp, Mus musculus
aatgctacatgaacattttgatt

SEQ ID NO: 200011 - DNA, 23 bp, Mus musculus
ttatgtgcatgtagatatgtgtg

SEQ ID NO: 200012 - DNA, 23 bp, Mus musculus
tgactgactcagtgcctccctgt

SEQ ID NO: 200013 - DNA, 23 bp, Mus musculus
tagtgtcttgataatctgagcac

SEQ ID NO: 200014 - DNA, 20 bp, Mus musculus
tctcctattctatagataat

SEQ ID NO: 200015 - DNA, 20 bp, Mus musculus
tggatgtgacaatttctacc

SEQ ID NO: 200016 - DNA, 23 bp, Mus musculus
tctgtcacacagcattgtttgac

SEQ ID NO: 200017 - DNA, 23 bp, Mus musculus
taactctcctttacaagtctttt

SEQ ID NO: 200018 - DNA, 20 bp, Mus musculus
ccatggtggtctgataggat

SEQ ID NO: 200019 - DNA, 22 bp, Mus musculus
tgttttgtgaccaattatatgg

SEQ ID NO: 200020 - DNA, 23 bp, Mus musculus
tgagaatgaggaaaatgccatgt

SEQ ID NO: 200021 - DNA, 21 bp, Mus musculus
tctgccactcgctcatttttg

SEQ ID NO: 200022 - DNA, 22 bp, Mus musculus
tgttttgtgaccaattatatgg

SEQ ID NO: 200023 - DNA, 20 bp, Mus musculus
atagtcatagctatatatgt

SEQ ID NO: 200024 - DNA, 23 bp, Mus musculus
cgtatgtatagtcttagctacta

SEQ ID NO: 200025 - DNA, 23 bp, Mus musculus
caatatttttgtatctgttgagg

SEQ ID NO: 200026 - DNA, 21 bp, Mus musculus
aatgtactatgtatacagtga

SEQ ID NO: 200027 - DNA, 23 bp, Mus musculus
ttctctagagtcacagaagttac

SEQ ID NO: 200028 - DNA, 23 bp, Mus musculus
aaaactgtggtcaggatgcagat

SEQ ID NO: 200029 - DNA, 20 bp, Mus musculus
agctagttggatttattgtt

SEQ ID NO: 200030 - DNA, 20 bp, Mus musculus
cagtggcagtgaaagtggga

SEQ ID NO: 200031 - DNA, 23 bp, Mus musculus
cttttcatctcactgggttttct

SEQ ID NO: 200032 - DNA, 21 bp, Mus musculus
aaggagctgtctaagtcattc

SEQ ID NO: 200033 - DNA, 22 bp, Mus musculus
agtcagctcactgagtgctcta

SEQ ID NO: 200034 - DNA, 18 bp, Mus musculus
atgtatatatatatatgt

SEQ ID NO: 200035 - DNA, 23 bp, Mus musculus
aactgagaagaaagagagctgaa

SEQ ID NO: 200036 - DNA, 22 bp, Mus musculus
tatctgtataaattttcagaaa

SEQ ID NO: 200037 - DNA, 21 bp, Mus musculus
gtgtgaagtcagtgtgcagaa

SEQ ID NO: 200038 - DNA, 22 bp, Mus musculus
tgttttgtgaccaattatatgg

SEQ ID NO: 200039 - DNA, 23 bp, Mus musculus
tatgtacatgtgtgcgtatgatg

SEQ ID NO: 200040 - DNA, 22 bp, Mus musculus
tgtgcatgtatgtatgtatgta

SEQ ID NO: 200041 - DNA, 22 bp, Mus musculus
tactgcttttaatattcagtct

SEQ ID NO: 200042 - DNA, 23 bp, Mus musculus
caatatttttgtatctgttgagg

SEQ ID NO: 200043 - DNA, 22 bp, Mus musculus
tgacagaagagacattggtggt

SEQ ID NO: 200044 - DNA, 22 bp, Mus musculus
tatatgcatatataagtgtaca

SEQ ID NO: 200045 - DNA, 23 bp, Mus musculus
ttatgtgtatttctatatgtgta

SEQ ID NO: 200046 - DNA, 19 bp, Mus musculus
atggtcaggggctggagag

SEQ ID NO: 200047 - DNA, 23 bp, Mus musculus
tgtctccctcacaccctgcatcc

SEQ ID NO: 200048 - DNA, 23 bp, Mus musculus
ctgtctgctgtgtgtgtgtgtct

SEQ ID NO: 200049 - DNA, 23 bp, Mus musculus
tagtccatggtgatctgatagga

SEQ ID NO: 200050 - DNA, 23 bp, Mus musculus
tactatttgcttggaaaagtgtt

SEQ ID NO: 200051 - DNA, 23 bp, Mus musculus
gtctgcacagatgagagtgtgga

SEQ ID NO: 200052 - DNA, 22 bp, Mus musculus
tttctctctgtctctgagagag

SEQ ID NO: 200053 - DNA, 18 bp, Mus musculus
ctgtggtgatatgatagg

SEQ ID NO: 200054 - DNA, 21 bp, Mus musculus
agtccttgcctgatatagctt

SEQ ID NO: 200055 - DNA, 19 bp, Mus musculus
atctagctagtttagctta

SEQ ID NO: 200056 - DNA, 22 bp, Mus musculus
ttgtgcttgagcaaacactctt

SEQ ID NO: 200057 - DNA, 23 bp, Mus musculus
gtgtgggtcactcactgcctgag

SEQ ID NO: 200058 - DNA, 20 bp, Mus musculus
tttgacacaagagtgtctgc

SEQ ID NO: 200059 - DNA, 22 bp, Mus musculus
gaatgaggttattgtgcagttt

SEQ ID NO: 200060 - DNA, 23 bp, Mus musculus
gcagcagatagaagagagttagc

SEQ ID NO: 200061 - DNA, 18 bp, Mus musculus
caacacactgtctgaact

SEQ ID NO: 200062 - DNA, 22 bp, Mus musculus
tcactcacactgtgttagcatt

SEQ ID NO: 200063 - DNA, 23 bp, Mus musculus
tagtacaagtgcatctggatctg

SEQ ID NO: 200064 - DNA, 23 bp, Mus musculus
tcctctgagaccctgagtccctg

SEQ ID NO: 200065 - DNA, 23 bp, Mus musculus
tttctactgtgtggaatagttta

SEQ ID NO: 200066 - DNA, 23 bp, Mus musculus
tttatatctgtggtatgcatgtg

SEQ ID NO: 200067 - DNA, 21 bp, Mus musculus
tccatggtgatctgataggat

SEQ ID NO: 200068 - DNA, 23 bp, Mus musculus
tcattagagaggaaatagagatg

SEQ ID NO: 200069 - DNA, 23 bp, Mus musculus
gacacactgacaggctgcctgta

SEQ ID NO: 200070 - DNA, 22 bp, Mus musculus
ggagtgaatagagtatttgttg

SEQ ID NO: 200071 - DNA, 22 bp, Mus musculus
tcttctacattctgtctcagat

SEQ ID NO: 200072 - DNA, 20 bp, Mus musculus
tggtgatttgataggttgca

SEQ ID NO: 200073 - DNA, 23 bp, Mus musculus
acgctctctgagtctctaatggc

SEQ ID NO: 200074 - DNA, 22 bp, Mus musculus
agagatgtcattatgttcttct

SEQ ID NO: 200075 - DNA, 23 bp, Mus musculus
tcagagctacctacagtctgtaa

SEQ ID NO: 200076 - DNA, 23 bp, Mus musculus
tgtatcaggttctacattcgggt

SEQ ID NO: 200077 - DNA, 22 bp, Mus musculus
atgtatgtatgtatgtgtatat

SEQ ID NO: 200078 - DNA, 23 bp, Mus musculus
agagatcacagtgagtgtagcct

SEQ ID NO: 200079 - DNA, 23 bp, Mus musculus
atagacacagcatcaagtctttc

SEQ ID NO: 200080 - DNA, 23 bp, Mus musculus
tggatctctgtgactgtctatta

SEQ ID NO: 200081 - DNA, 18 bp, Mus musculus
tcaggggctggagagatg

SEQ ID NO: 200082 - DNA, 21 bp, Mus musculus
tactgactgctcttccagagg

SEQ ID NO: 200083 - DNA, 22 bp, Mus musculus
tgttttgtgaccaattatatgg

SEQ ID NO: 200084 - DNA, 22 bp, Mus musculus
tgttttgtgaccaattatatgg

SEQ ID NO: 200085 - DNA, 23 bp, Mus musculus
tcactctgttcccagaaactgtc

SEQ ID NO: 200086 - DNA, 22 bp, Mus musculus
tgttttgtgaccaattatatgg

SEQ ID NO: 200087 - DNA, 19 bp, Mus musculus
atatatgtatgtgtaaaag

SEQ ID NO: 200088 - DNA, 23 bp, Mus musculus
tatctgtgtcactgtctgtggtt

SEQ ID NO: 200089 - DNA, 21 bp, Mus musculus
cacagtgcttaggctataggt

SEQ ID NO: 200090 - DNA, 23 bp, Mus musculus
agagagtagacagagacctgtga

SEQ ID NO: 200091 - DNA, 23 bp, Mus musculus
tcagactcagtgtctctggtttt

SEQ ID NO: 200092 - DNA, 22 bp, Mus musculus
ctcaaggtctctgactctctat

SEQ ID NO: 200093 - DNA, 23 bp, Mus musculus
cacatctctgtctgtctgtgcat

SEQ ID NO: 200094 - DNA, 23 bp, Mus musculus
tctgtctgtgtctctctgtgcct

SEQ ID NO: 200095 - DNA, 23 bp, Mus musculus
ctgtgtgtctctgtgtaacagat

SEQ ID NO: 200096 - DNA, 21 bp, Mus musculus
gattgaatggttgagtctggg

SEQ ID NO: 200097 - DNA, 23 bp, Mus musculus
tctctcacaggctgtgttcttcc

SEQ ID NO: 200098 - DNA, 23 bp, Mus musculus
tctgtctgtctgtctgagatcac

SEQ ID NO: 200099 - DNA, 23 bp, Mus musculus
tgtctgtctgtctgtctgtctgt

SEQ ID NO: 200100 - DNA, 23 bp, Mus musculus
ctgactgtaaagactgaggacta

SEQ ID NO: 200101 - DNA, 23 bp, Mus musculus
tagtccatggtgatctgatagga

SEQ ID NO: 200102 - DNA, 23 bp, Mus musculus
ttatggtaacttaggacaaaatc

SEQ ID NO: 200103 - DNA, 23 bp, Mus musculus
actgacacactggttgctgtgac

SEQ ID NO: 200104 - DNA, 20 bp, Mus musculus
catgtgctagcacatttgga

SEQ ID NO: 200105 - DNA, 23 bp, Mus musculus
gtctgtgtgtgtgtgtttcagca

SEQ ID NO: 200106 - DNA, 23 bp, Mus musculus
tgagaggctctgtcagagtctga

SEQ ID NO: 200107 - DNA, 23 bp, Mus musculus
ttttgacattttgatattttgat

SEQ ID NO: 200108 - DNA, 23 bp, Mus musculus
tttaacaatggctatgagaacat

SEQ ID NO: 200109 - DNA, 20 bp, Mus musculus
gaattgaatttcaattgcaa

SEQ ID NO: 200110 - DNA, 22 bp, Mus musculus
taagagtaagtcaaaagccatg

SEQ ID NO: 200111 - DNA, 19 bp, Mus musculus
tatgtatgtatgtatatgt

SEQ ID NO: 200112 - DNA, 23 bp, Mus musculus
agacactgcagcaatgtggaata

SEQ ID NO: 200113 - DNA, 23 bp, Mus musculus
aacaccagtcatattgttgtatt

SEQ ID NO: 200114 - DNA, 18 bp, Mus musculus
tgcatgtatgtgtatagg

SEQ ID NO: 200115 - DNA, 19 bp, Mus musculus
tgtttgtgtgcatgtgcat

SEQ ID NO: 200116 - DNA, 18 bp, Mus musculus
atgccagaagaatgtgtt

SEQ ID NO: 200117 - DNA, 23 bp, Mus musculus
gagaggctctgtctgtgcctgac

SEQ ID NO: 200118 - DNA, 21 bp, Mus musculus
tatacacactcacatatatgt

SEQ ID NO: 200119 - DNA, 22 bp, Mus musculus
tatatagaactttctggtaaca

SEQ ID NO: 200120 - DNA, 18 bp, Mus musculus
tgcttacatttagagtct

SEQ ID NO: 200121 - DNA, 18 bp, Mus musculus
tttgtggatgatatcgca

SEQ ID NO: 200122 - DNA, 22 bp, Mus musculus
tgttttgtgaccaattatatgg

SEQ ID NO: 200123 - DNA, 21 bp, Mus musculus
ttttggattatttttcagtgt

SEQ ID NO: 200124 - DNA, 20 bp, Mus musculus
tttcaccttggcttgctttt

SEQ ID NO: 200125 - DNA, 22 bp, Mus musculus
tgttttgtgaccaattatatgg

SEQ ID NO: 200126 - DNA, 22 bp, Mus musculus
gtcaggctctgactctcaggca

SEQ ID NO: 200127 - DNA, 18 bp, Mus musculus
tgcagaagagcctgttct

SEQ ID NO: 200128 - DNA, 19 bp, Mus musculus
ccagataactgtggcaaac

SEQ ID NO: 200129 - DNA, 23 bp, Mus musculus
caatatttttgtatctgttgagg

SEQ ID NO: 200130 - DNA, 22 bp, Mus musculus
aatatatatgtatatgtgtata

SEQ ID NO: 200131 - DNA, 23 bp, Mus musculus
ttgggtgggtccctgtgtccctg

SEQ ID NO: 200132 - DNA, 23 bp, Mus musculus
tggattgaaaagtagataggaag

SEQ ID NO: 200133 - DNA, 23 bp, Mus musculus
ttcagtctgtgttagaatctgga

SEQ ID NO: 200134 - DNA, 23 bp, Mus musculus
ttttgtgaccaattatattgtca

SEQ ID NO: 200135 - DNA, 23 bp, Mus musculus
tttgtattgaatataaattgggc

SEQ ID NO: 200136 - DNA, 21 bp, Mus musculus
atagtttgtattgaatacaga

SEQ ID NO: 200137 - DNA, 22 bp, Mus musculus
tatggcacactgcaggccctga

SEQ ID NO: 200138 - DNA, 23 bp, Mus musculus
aagtgaatgaggatctaaatggt

SEQ ID NO: 200139 - DNA, 23 bp, Mus musculus
tgcatgtgtgtgtgtgcatgtgc

SEQ ID NO: 200140 - DNA, 23 bp, Mus musculus
tgagtgcagagagtgagcacagg

SEQ ID NO: 200141 - DNA, 23 bp, Mus musculus
ttctggaacatgacagtagctgt

SEQ ID NO: 200142 - DNA, 23 bp, Mus musculus
tctctgtgcctcagtgtccgcat

SEQ ID NO: 200143 - DNA, 21 bp, Mus musculus
tcatgttgctgtgcaccatgt

SEQ ID NO: 200144 - DNA, 23 bp, Mus musculus
gtgtgtgcaaaagcatgtgtatg

SEQ ID NO: 200145 - DNA, 23 bp, Mus musculus
acactcacctgaccctcctgagt

SEQ ID NO: 200146 - DNA, 23 bp, Mus musculus
agtctcgattgttgtgtggtttg

SEQ ID NO: 200147 - DNA, 23 bp, Mus musculus
aaacacagcgcttaccatgatgt

SEQ ID NO: 200148 - DNA, 21 bp, Mus musculus
tgtgtgtcagtgtgtgcatgc

SEQ ID NO: 200149 - DNA, 23 bp, Mus musculus
gtgtgcgtgtgtgtgtgcctgtg

SEQ ID NO: 200150 - DNA, 19 bp, Mus musculus
ttgtgtgcatgtgtacatg

SEQ ID NO: 200151 - DNA, 23 bp, Mus musculus
ttgcacactcacatgcatgtgtg

SEQ ID NO: 200152 - DNA, 22 bp, Mus musculus
taagtgggttcagtgctggcat

SEQ ID NO: 200153 - DNA, 23 bp, Mus musculus
ctgcattgttctgagtgtcactg

SEQ ID NO: 200154 - DNA, 22 bp, Mus musculus
atgacaggcactgacataggtc

SEQ ID NO: 200155 - DNA, 20 bp, Mus musculus
cacaatatctatatatgtgt

SEQ ID NO: 200156 - DNA, 20 bp, Mus musculus
ggctgaggaaatcctggtgg

SEQ ID NO: 200157 - DNA, 18 bp, Mus musculus
ctgcttgcctgtgtgcct

SEQ ID NO: 200158 - DNA, 23 bp, Mus musculus
tcacactgtcattgtgctgatgc

SEQ ID NO: 200159 - DNA, 22 bp, Mus musculus
agagtagtgactgtgtagaagg

SEQ ID NO: 200160 - DNA, 23 bp, Mus musculus
gggcccctccctctggctgtccc

SEQ ID NO: 200161 - DNA, 23 bp, Mus musculus
ttctgtgtgtagagtgtgtgctg

SEQ ID NO: 200162 - DNA, 23 bp, Mus musculus
acacactctctgtgtgagcatgg

SEQ ID NO: 200163 - DNA, 23 bp, Mus musculus
atgagtctggagactgagagcac

SEQ ID NO: 200164 - DNA, 21 bp, Mus musculus
actcagaagtgagagtgaaca

SEQ ID NO: 200165 - DNA, 21 bp, Mus musculus
acagtgaggttcattctcatt

SEQ ID NO: 200166 - DNA, 23 bp, Mus musculus
ttagatcatcttgatacatgtat

SEQ ID NO: 200167 - DNA, 22 bp, Mus musculus
tgttttgtgaccaattatatgg

SEQ ID NO: 200168 - DNA, 23 bp, Mus musculus
agggtggcagctttacatgtgga

SEQ ID NO: 200169 - DNA, 23 bp, Mus musculus
cactgggtctctgtgagagagga

SEQ ID NO: 200170 - DNA, 23 bp, Mus musculus
gtctgggtgtctctcacttagtt

SEQ ID NO: 200171 - DNA, 22 bp, Mus musculus
tgacacatgactgtgaacttct

SEQ ID NO: 200172 - DNA, 21 bp, Mus musculus
ttagcttggaggttgtatggt

SEQ ID NO: 200173 - DNA, 22 bp, Mus musculus
tgttttgtgaccaattatatgg

SEQ ID NO: 200174 - DNA, 23 bp, Mus musculus
gaaggagctgagggtgtttgcag

SEQ ID NO: 200175 - DNA, 23 bp, Mus musculus
agcaacactgtcagtcagtcagc

SEQ ID NO: 200176 - DNA, 23 bp, Mus musculus
aagtgattgtggaaagggagctg

SEQ ID NO: 200177 - DNA, 23 bp, Mus musculus
tatgtgtgcatatgtatatgtgt

SEQ ID NO: 200178 - DNA, 23 bp, Mus musculus
ttagtggaagctaatggtatgtc

SEQ ID NO: 200179 - DNA, 22 bp, Mus musculus
tgttttgtgaccaattatatgg

SEQ ID NO: 200180 - DNA, 23 bp, Mus musculus
tctctgctctgactttgtctctg

SEQ ID NO: 200181 - DNA, 20 bp, Mus musculus
tcatatggtctataagttgt

SEQ ID NO: 200182 - DNA, 23 bp, Mus musculus
ttcctcctactgaattgccttag

SEQ ID NO: 200183 - DNA, 23 bp, Mus musculus
ttctgatgattgtgagcagtctt

SEQ ID NO: 200184 - DNA, 18 bp, Mus musculus
taagattcttatgtttgc

SEQ ID NO: 200185 - DNA, 23 bp, Mus musculus
tgtatatgtgcatgtgtatatgt

SEQ ID NO: 200186 - DNA, 20 bp, Mus musculus
taaatatgtatgtgtatatg

SEQ ID NO: 200187 - DNA, 23 bp, Mus musculus
tgctatgacagagaaatgccagc

SEQ ID NO: 200188 - DNA, 21 bp, Mus musculus
tccatggtggtctgataggat

SEQ ID NO: 200189 - DNA, 23 bp, Mus musculus
tcatcagtgagtgcataccacgt

SEQ ID NO: 200190 - DNA, 23 bp, Mus musculus
tgatctccatttgttttcttatt

SEQ ID NO: 200191 - DNA, 22 bp, Mus musculus
tgttttgtgaccaattatatgg

SEQ ID NO: 200192 - DNA, 23 bp, Mus musculus
aacagagcttatagaatgtatat

SEQ ID NO: 200193 - DNA, 23 bp, Mus musculus
tagaactcactctgcagaccagg

SEQ ID NO: 200194 - DNA, 21 bp, Mus musculus
gtatgagcaccgcatacctgt

SEQ ID NO: 200195 - DNA, 18 bp, Mus musculus
tttaataatctagctttc

SEQ ID NO: 200196 - DNA, 23 bp, Mus musculus
ttaatctttgaggtatgaagata

SEQ ID NO: 200197 - DNA, 20 bp, Mus musculus
tatatatgtgtatgtgtgta

SEQ ID NO: 200198 - DNA, 20 bp, Mus musculus
tatagcatatatatacgtgt

SEQ ID NO: 200199 - DNA, 23 bp, Mus musculus
tgtctcactctctgtgtatgtgt

SEQ ID NO: 200200 - DNA, 22 bp, Mus musculus
acctcaacatgtcctagagctt

SEQ ID NO: 200201 - DNA, 21 bp, Mus musculus
tgccacactctcacacacaca

SEQ ID NO: 200202 - DNA, 20 bp, Mus musculus
agtcagaagtgagtgtgctc

SEQ ID NO: 200203 - DNA, 21 bp, Mus musculus
ctcagtacagtgtctgtcaca

SEQ ID NO: 200204 - DNA, 23 bp, Mus musculus
aggtagtaggtagagtccttatg

SEQ ID NO: 200205 - DNA, 23 bp, Mus musculus
tagaatctatttgaaaaggatcc

SEQ ID NO: 200206 - DNA, 23 bp, Mus musculus
tcttagcatctggtagacatagg

SEQ ID NO: 200207 - DNA, 23 bp, Mus musculus
gaccttgaactcctgagtctcct

SEQ ID NO: 200208 - DNA, 23 bp, Mus musculus
tgtgtccctgtgtcagtcctacg

SEQ ID NO: 200209 - DNA, 21 bp, Mus musculus
agagagaaagcctgtcttgaa

SEQ ID NO: 200210 - DNA, 23 bp, Mus musculus
tatgtctgtctttctgtctgtct

SEQ ID NO: 200211 - DNA, 23 bp, Mus musculus
actgccacaccctctctatggcc

SEQ ID NO: 200212 - DNA, 21 bp, Mus musculus
atatatgtatgtatgctgtac

SEQ ID NO: 200213 - DNA, 21 bp, Mus musculus
tggattcagatcaagcagatg

SEQ ID NO: 200214 - DNA, 23 bp, Mus musculus
tgtctgtctgtctgtactcacat

SEQ ID NO: 200215 - DNA, 22 bp, Mus musculus
acacagacgtaaagaagctgta

SEQ ID NO: 200216 - DNA, 23 bp, Mus musculus
agagtgcagagagtctgtccaca

SEQ ID NO: 200217 - DNA, 22 bp, Mus musculus
tgttttgtgaccaattatatgg

SEQ ID NO: 200218 - DNA, 21 bp, Mus musculus
cagactcccattcttgtctcc

SEQ ID NO: 200219 - DNA, 23 bp, Mus musculus
ctgtctctgtccctcaaacactg

SEQ ID NO: 200220 - DNA, 23 bp, Mus musculus
ctgactctctcacaaagacaaat

SEQ ID NO: 200221 - DNA, 20 bp, Mus musculus
tcacagtctctgactgctct

SEQ ID NO: 200222 - DNA, 22 bp, Mus musculus
tgttttgtgaccaattatatgg

SEQ ID NO: 200223 - DNA, 23 bp, Mus musculus
tgacatggactaagaatctagtt

SEQ ID NO: 200224 - DNA, 23 bp, Mus musculus
tctctcagtctctgtctgtctgt

SEQ ID NO: 200225 - DNA, 22 bp, Mus musculus
tgttttgtgaccaattatatgg

SEQ ID NO: 200226 - DNA, 23 bp, Mus musculus
tctttctgtgcgtctgtgtgagg

SEQ ID NO: 200227 - DNA, 23 bp, Mus musculus
gtgtcagcttctggaagtggtgc

SEQ ID NO: 200228 - DNA, 23 bp, Mus musculus
ttggtgagagaaatctcagtggt

SEQ ID NO: 200229 - DNA, 23 bp, Mus musculus
gtgtgtgctcatgtgtgtgtgtg

SEQ ID NO: 200230 - DNA, 23 bp, Mus musculus
tgcatgaacatgtctttgcctgt

SEQ ID NO: 200231 - DNA, 22 bp, Mus musculus
ggcaagtctctgggtttgtttg

SEQ ID NO: 200232 - DNA, 21 bp, Mus musculus
acgtgagaagattcagaccac

SEQ ID NO: 200233 - DNA, 22 bp, Mus musculus
tgtgtgtgtgtctatatgtata

SEQ ID NO: 200234 - DNA, 23 bp, Mus musculus
atctgactgtagactttgtgttc

SEQ ID NO: 200235 - DNA, 23 bp, Mus musculus
atataggttgaaaaggaaagcct

SEQ ID NO: 200236 - DNA, 21 bp, Mus musculus
tgtttccttttctaattatag

SEQ ID NO: 200237 - DNA, 20 bp, Mus musculus
tggatctagactaggtatca

SEQ ID NO: 200238 - DNA, 23 bp, Mus musculus
agaactgaagactttctgccata

SEQ ID NO: 200239 - DNA, 23 bp, Mus musculus
agtcagaaagtcttgttccatgt

SEQ ID NO: 200240 - DNA, 22 bp, Mus musculus
tagcaggttttcaattctgtct

SEQ ID NO: 200241 - DNA, 22 bp, Mus musculus
tgttttgtgaccaattatatgg

SEQ ID NO: 200242 - DNA, 22 bp, Mus musculus
tgttttgtgaccaattatatgg

SEQ ID NO: 200243 - DNA, 23 bp, Mus musculus
tctactgtgtagtttgagaggtc

SEQ ID NO: 200244 - DNA, 23 bp, Mus musculus
ctgacctaaagtaaagaagtaag

SEQ ID NO: 200245 - DNA, 22 bp, Mus musculus
ttaagtcattttgtaaatgtct

SEQ ID NO: 200246 - DNA, 19 bp, Mus musculus
tcagtatttggcattttgt

SEQ ID NO: 200247 - DNA, 19 bp, Mus musculus
acacaacttccgaatatct

SEQ ID NO: 200248 - DNA, 23 bp, Mus musculus
tagtccatggtgatctgatagga

SEQ ID NO: 200249 - DNA, 22 bp, Mus musculus
tactgtaaagatgtacttgttc

SEQ ID NO: 200250 - DNA, 23 bp, Mus musculus
gactgagagactgagagagagtg

SEQ ID NO: 200251 - DNA, 22 bp, Mus musculus
atgatgtcttccctgggtctct

SEQ ID NO: 200252 - DNA, 22 bp, Mus musculus
tgttttgtgaccaattatatgg

SEQ ID NO: 200253 - DNA, 23 bp, Mus musculus
cgtctctgtctctcatgctcgct

SEQ ID NO: 200254 - DNA, 23 bp, Mus musculus
tgccacaccctcagagtctctgt

SEQ ID NO: 200255 - DNA, 21 bp, Mus musculus
tctgtgtttctcagtcattgg

SEQ ID NO: 200256 - DNA, 22 bp, Mus musculus
agaaaaatgtctccataagacc

SEQ ID NO: 200257 - DNA, 23 bp, Mus musculus
tttattttgaacctgagtgaggg

SEQ ID NO: 200258 - DNA, 23 bp, Mus musculus
tagtacagctccatgatcaagca

SEQ ID NO: 200259 - DNA, 23 bp, Mus musculus
atatgtctgctatgtgatactaa

SEQ ID NO: 200260 - DNA, 19 bp, Mus musculus
tgtatatatgtatatgtgt

SEQ ID NO: 200261 - DNA, 23 bp, Mus musculus
tataatgcataggtacatgtaca

SEQ ID NO: 200262 - DNA, 21 bp, Mus musculus
atcttagaatgatcatgttgg

SEQ ID NO: 200263 - DNA, 21 bp, Mus musculus
aaagaagaggcatttgtgttc

SEQ ID NO: 200264 - DNA, 23 bp, Mus musculus
tcactgggtgcttgtgttctgtt

SEQ ID NO: 200265 - DNA, 23 bp, Mus musculus
cagagccacaagagactgagcac

SEQ ID NO: 200266 - DNA, 22 bp, Mus musculus
atgacatcatatatatatgtgt

SEQ ID NO: 200267 - DNA, 23 bp, Mus musculus
agggtctgtctgtctgtgaatct

SEQ ID NO: 200268 - DNA, 20 bp, Mus musculus
cagagcatatactttgtata

SEQ ID NO: 200269 - DNA, 22 bp, Mus musculus
aaacagagtttcttattgtgtg

SEQ ID NO: 200270 - DNA, 19 bp, Mus musculus
actgggtataaattgcaaa

SEQ ID NO: 200271 - DNA, 23 bp, Mus musculus
tctctctgtcactctgtggatcc

SEQ ID NO: 200272 - DNA, 19 bp, Mus musculus
agtacacagagaatctcat

SEQ ID NO: 200273 - DNA, 23 bp, Mus musculus
ctgcctgtctgcctgcctgtctg

SEQ ID NO: 200274 - DNA, 23 bp, Mus musculus
ctctgtgtttgaaacatgtgata

SEQ ID NO: 200275 - DNA, 23 bp, Mus musculus
tgtgtatgtgcatgtagtataca

SEQ ID NO: 200276 - DNA, 20 bp, Mus musculus
tggcaggcagattggctgcc

SEQ ID NO: 200277 - DNA, 22 bp, Mus musculus
gtgtgtatgtgtgtgtgtacat

SEQ ID NO: 200278 - DNA, 23 bp, Mus musculus
atgtatgtatatgtatgtgtgtg

SEQ ID NO: 200279 - DNA, 23 bp, Mus musculus
aatttgaggaaagcggttgagcg

SEQ ID NO: 200280 - DNA, 23 bp, Mus musculus
taatatcttggtgttggagagat

SEQ ID NO: 200281 - DNA, 23 bp, Mus musculus
tactctcactgcaacttgatatc

SEQ ID NO: 200282 - DNA, 22 bp, Mus musculus
aggttgacctgtgatattcttg

SEQ ID NO: 200283 - DNA, 23 bp, Mus musculus
cacaaaggacagacacactgacc

SEQ ID NO: 200284 - DNA, 22 bp, Mus musculus
tctctctctttgtgactctctt

SEQ ID NO: 200285 - DNA, 23 bp, Mus musculus
ccagaggctctctctcactcagt

SEQ ID NO: 200286 - DNA, 23 bp, Mus musculus
tgaatggtttggtaactttggaa

SEQ ID NO: 200287 - DNA, 23 bp, Mus musculus
tgggtgtcttctctgcctctctg

SEQ ID NO: 200288 - DNA, 21 bp, Mus musculus
gttctgtctctgactcgctgc

SEQ ID NO: 200289 - DNA, 22 bp, Mus musculus
tgactagaccctactttgatga

SEQ ID NO: 200290 - DNA, 22 bp, Mus musculus
gagaagttcttgtatttttcta

SEQ ID NO: 200291 - DNA, 23 bp, Mus musculus
agaagtagcagctctctaacagt

SEQ ID NO: 200292 - DNA, 19 bp, Mus musculus
acagtgacagacttcctcc

SEQ ID NO: 200293 - DNA, 23 bp, Mus musculus
tatttttgatgcacatagtcctt

SEQ ID NO: 200294 - DNA, 23 bp, Mus musculus
ctgtctgcctgtctgcctgcctg

SEQ ID NO: 200295 - DNA, 20 bp, Mus musculus
agtacctgcagaagccagag

SEQ ID NO: 200296 - DNA, 22 bp, Mus musculus
tgttttgtgaccaattatatgg

SEQ ID NO: 200297 - DNA, 23 bp, Mus musculus
ttgctgtggatgaccttgagtga

SEQ ID NO: 200298 - DNA, 23 bp, Mus musculus
tcagttcacagtcactgagtgca

SEQ ID NO: 200299 - DNA, 23 bp, Mus musculus
atataggaccttgagcttcgaga

SEQ ID NO: 200300 - DNA, 20 bp, Mus musculus
tgcctggctctttcttgact

SEQ ID NO: 200301 - DNA, 20 bp, Mus musculus
atttcttttctttttctttt

SEQ ID NO: 200302 - DNA, 23 bp, Mus musculus
ctcagttctcagtctgtgatgtt

SEQ ID NO: 200303 - DNA, 18 bp, Mus musculus
ctcactctcactgtgcag

SEQ ID NO: 200304 - DNA, 19 bp, Mus musculus
tttgcacttgtctggtgct

SEQ ID NO: 200305 - DNA, 23 bp, Mus musculus
gtctgttcacagtgaccacatgc

SEQ ID NO: 200306 - DNA, 23 bp, Mus musculus
tctgtgagaggcctttccttctc

SEQ ID NO: 200307 - DNA, 23 bp, Mus musculus
tgtctgtcggtctctctttctct

SEQ ID NO: 200308 - DNA, 23 bp, Mus musculus
ggggagtgagtgtgcttgtgcag

SEQ ID NO: 200309 - DNA, 23 bp, Mus musculus
ttcaatctgaatttcactctctc

SEQ ID NO: 200310 - DNA, 23 bp, Mus musculus
tgcagtttggttttcatgagggt

SEQ ID NO: 200311 - DNA, 23 bp, Mus musculus
tgtgaatttctttcttcttctgt

SEQ ID NO: 200312 - DNA, 23 bp, Mus musculus
agaagagtgaagacagtttgcag

SEQ ID NO: 200313 - DNA, 23 bp, Mus musculus
cacatgtatctgtatcagtatgt

SEQ ID NO: 200314 - DNA, 23 bp, Mus musculus
ctctgtgactgtctctcttcctg

SEQ ID NO: 200315 - DNA, 23 bp, Mus musculus
tgtatgtgtatatgtatgtgaat

SEQ ID NO: 200316 - DNA, 23 bp, Mus musculus
ataatgtatatgtatgtgtatgt

SEQ ID NO: 200317 - DNA, 20 bp, Mus musculus
tgcatgtatgtatgtatgca

SEQ ID NO: 200318 - DNA, 18 bp, Mus musculus
tgtgtgaccctgacatga

SEQ ID NO: 200319 - DNA, 20 bp, Mus musculus
tctctgggtctcagtttctt

SEQ ID NO: 200320 - DNA, 18 bp, Mus musculus
tagcaaggaagttttcag

SEQ ID NO: 200321 - DNA, 21 bp, Mus musculus
acagacaggacactgtgctct

SEQ ID NO: 200322 - DNA, 23 bp, Mus musculus
tcactaatactgtctgctaatta

SEQ ID NO: 200323 - DNA, 23 bp, Mus musculus
tgactctgcctctgtctcctgag

SEQ ID NO: 200324 - DNA, 23 bp, Mus musculus
ttcaggctcatgatcttggattt

SEQ ID NO: 200325 - DNA, 23 bp, Mus musculus
tatgtctgagcatcatgtctgtg

SEQ ID NO: 200326 - DNA, 23 bp, Mus musculus
tctcagaggtgtgatctctgtga

SEQ ID NO: 200327 - DNA, 23 bp, Mus musculus
tctcagaggtgtgatctctgtga

SEQ ID NO: 200328 - DNA, 23 bp, Mus musculus
tctcagaggtgtgatctctgtga

SEQ ID NO: 200329 - DNA, 21 bp, Mus musculus
ttctcagaggtgtgatctctg

SEQ ID NO: 200330 - DNA, 22 bp, Mus musculus
ataagtactgatccatgaaagg

SEQ ID NO: 200331 - DNA, 21 bp, Mus musculus
ttcacatgcactttctcctgt

SEQ ID NO: 200332 - DNA, 23 bp, Mus musculus
atggactggctactgtttctctt

SEQ ID NO: 200333 - DNA, 23 bp, Mus musculus
aacagaaagagtgcaggagcaac

SEQ ID NO: 200334 - DNA, 23 bp, Mus musculus
ttgaacactagtgttcttattct

SEQ ID NO: 200335 - DNA, 22 bp, Mus musculus
catctgtgaagtaggaaaggct

SEQ ID NO: 200336 - DNA, 23 bp, Mus musculus
tgcctctctgagacactacagtg

SEQ ID NO: 200337 - DNA, 21 bp, Mus musculus
tccatggtggtctgataggat

SEQ ID NO: 200338 - DNA, 22 bp, Mus musculus
tgttttgtgaccaattatatgg

SEQ ID NO: 200339 - DNA, 23 bp, Mus musculus
tgttattgttcttcagataggat

SEQ ID NO: 200340 - DNA, 22 bp, Mus musculus
tgttttgtgaccaattatatgg

SEQ ID NO: 200341 - DNA, 21 bp, Mus musculus
tttggtagatggtagtatagt

SEQ ID NO: 200342 - DNA, 23 bp, Mus musculus
ctcttggtcactctctatttcac

SEQ ID NO: 200343 - DNA, 23 bp, Mus musculus
aatatttttgtatatgttgcggc

SEQ ID NO: 200344 - DNA, 23 bp, Mus musculus
tgtgtgtatgtctgtgtgtattt

SEQ ID NO: 200345 - DNA, 18 bp, Mus musculus
tgtgtgtacagtgtgtgc

SEQ ID NO: 200346 - DNA, 21 bp, Mus musculus
atctcagtcagataggcagag

SEQ ID NO: 200347 - DNA, 23 bp, Mus musculus
acatctgtctgtctgtctgtctg

SEQ ID NO: 200348 - DNA, 23 bp, Mus musculus
tatctgtgtatatcatatgaatg

SEQ ID NO: 200349 - DNA, 22 bp, Mus musculus
tgtgcatgcatgtatatgtgta

SEQ ID NO: 200350 - DNA, 22 bp, Mus musculus
attgtggttatcacattggtgt

SEQ ID NO: 200351 - DNA, 23 bp, Mus musculus
tgcctggctctgtggctctcagg

SEQ ID NO: 200352 - DNA, 23 bp, Mus musculus
ccctttcttctatccttgactct

SEQ ID NO: 200353 - DNA, 20 bp, Mus musculus
aagagcactgactgctcttc

SEQ ID NO: 200354 - DNA, 23 bp, Mus musculus
gttcagagtgagtagagtctcag

SEQ ID NO: 200355 - DNA, 23 bp, Mus musculus
acactcatactctcacacacaga

SEQ ID NO: 200356 - DNA, 23 bp, Mus musculus
agtgtcttgtgtgcacatatgtc

SEQ ID NO: 200357 - DNA, 23 bp, Mus musculus
tatatgatgcatatgatgtgtat

SEQ ID NO: 200358 - DNA, 23 bp, Mus musculus
tctgtctgtctgtctctgaacct

SEQ ID NO: 200359 - DNA, 23 bp, Mus musculus
taagctattctaagcttacagtg

SEQ ID NO: 200360 - DNA, 23 bp, Mus musculus
tttatgtatatatacatatgtat

SEQ ID NO: 200361 - DNA, 23 bp, Mus musculus
atgcatgtatatatatatgtgga

SEQ ID NO: 200362 - DNA, 23 bp, Mus musculus
tcacatactgtatatctgtatgg

SEQ ID NO: 200363 - DNA, 23 bp, Mus musculus
ggctctcaggctctcagacaccc

SEQ ID NO: 200364 - DNA, 23 bp, Mus musculus
ttgtaggtggaattgatatcatt

SEQ ID NO: 200365 - DNA, 23 bp, Mus musculus
atttttacttcttatggcttcgt

SEQ ID NO: 200366 - DNA, 23 bp, Mus musculus
agtggatttttttcctttaatca

SEQ ID NO: 200367 - DNA, 21 bp, Mus musculus
tggcatggagtgggggagttg

SEQ ID NO: 200368 - DNA, 23 bp, Mus musculus
gatgtatgtatctatgtatgtat

SEQ ID NO: 200369 - DNA, 23 bp, Mus musculus
actcagtgtgtgtgtgtgtgtgt

SEQ ID NO: 200370 - DNA, 18 bp, Mus musculus
ttttgtatctattgaggc

SEQ ID NO: 200371 - DNA, 23 bp, Mus musculus
ttgtgtccaattatatggtcaat

SEQ ID NO: 200372 - DNA, 23 bp, Mus musculus
tcactcatgtatgctctttggtt

SEQ ID NO: 200373 - DNA, 23 bp, Mus musculus
tagatatctgactgtgtgttctt

SEQ ID NO: 200374 - DNA, 19 bp, Mus musculus
atctctactataaaagctg

SEQ ID NO: 200375 - DNA, 22 bp, Mus musculus
tgttttgtgaccaattatatgg

SEQ ID NO: 200376 - DNA, 23 bp, Mus musculus
tatatgtatgtatagatatgtat

SEQ ID NO: 200377 - DNA, 23 bp, Mus musculus
gtgtgtctctgcatgtccatgtg

SEQ ID NO: 200378 - DNA, 23 bp, Mus musculus
tgactgtggatatcattggtcaa

SEQ ID NO: 200379 - DNA, 18 bp, Mus musculus
tttcgctgggatatccac

SEQ ID NO: 200380 - DNA, 23 bp, Mus musculus
gcctgtctgcctgtctgtctgtc

SEQ ID NO: 200381 - DNA, 23 bp, Mus musculus
cacgtgctcacacacatgtccat

SEQ ID NO: 200382 - DNA, 23 bp, Mus musculus
ggccgtcacagactgtcactctg

SEQ ID NO: 200383 - DNA, 20 bp, Mus musculus
gatttgtcaggcagctttta

SEQ ID NO: 200384 - DNA, 23 bp, Mus musculus
aaagcgagaagaaaggtttgcct

SEQ ID NO: 200385 - DNA, 18 bp, Mus musculus
tcacctttaggtttcttg

SEQ ID NO: 200386 - DNA, 19 bp, Mus musculus
tgcatgtgtatatgtatgt

SEQ ID NO: 200387 - DNA, 23 bp, Mus musculus
tccgaggctctctctttgcctca

SEQ ID NO: 200388 - DNA, 23 bp, Mus musculus
tatgtgtgtgtgtatgtgcatgt

SEQ ID NO: 200389 - DNA, 22 bp, Mus musculus
agtcggatgcctttgacctggt

SEQ ID NO: 200390 - DNA, 23 bp, Mus musculus
gagactgtctggcactgtgactg

SEQ ID NO: 200391 - DNA, 22 bp, Mus musculus
tgtgtgcatgtgcatgtgtgtg

SEQ ID NO: 200392 - DNA, 23 bp, Mus musculus
tgtgtgtgtgtgtgtgtatgctc

SEQ ID NO: 200393 - DNA, 22 bp, Mus musculus
tcagaggtatcatagctgggga

SEQ ID NO: 200394 - DNA, 18 bp, Mus musculus
ttctggtaccttgagagc

SEQ ID NO: 200395 - DNA, 21 bp, Mus musculus
tctgtctgtctgtctgtctgt

SEQ ID NO: 200396 - DNA, 22 bp, Mus musculus
aacccgtagatccgaacttgtg

SEQ ID NO: 200397 - DNA, 23 bp, Mus musculus
tgtctataggtatgtgtctgtta

SEQ ID NO: 200398 - DNA, 22 bp, Mus musculus
tccctgagaccctaacttgtga

SEQ ID NO: 200399 - DNA, 23 bp, Mus musculus
tgtggttctaggttctatttggt

SEQ ID NO: 200400 - DNA, 22 bp, Mus musculus
acacacacacacatatatatgt

SEQ ID NO: 200401 - DNA, 23 bp, Mus musculus
tctctggctgtgtctctggggca

SEQ ID NO: 200402 - DNA, 23 bp, Mus musculus
tcagactctgagatgggaagtgt

SEQ ID NO: 200403 - DNA, 23 bp, Mus musculus
gtctctcagtgtgtccacaatgt

SEQ ID NO: 200404 - DNA, 23 bp, Mus musculus
cagagtgactcactcattctgca

SEQ ID NO: 200405 - DNA, 19 bp, Mus musculus
tctccctcaatcactctct

SEQ ID NO: 200406 - DNA, 23 bp, Mus musculus
agaacactgactgctcttccaga

SEQ ID NO: 200407 - DNA, 21 bp, Mus musculus
ttctgtgtatgttcatgtgtg

SEQ ID NO: 200408 - DNA, 23 bp, Mus musculus
gtaagtatacatgtgcacgtgca

SEQ ID NO: 200409 - DNA, 18 bp, Mus musculus
ggaagatggtgtctaagc

SEQ ID NO: 200410 - DNA, 23 bp, Mus musculus
gggatgtagctggagttctcttt

SEQ ID NO: 200411 - DNA, 23 bp, Mus musculus
tgacagatctcagttctgtctct

SEQ ID NO: 200412 - DNA, 18 bp, Mus musculus
gactggaaaggaaagtga

SEQ ID NO: 200413 - DNA, 22 bp, Mus musculus
aatgtgcttggcttattatttc

SEQ ID NO: 200414 - DNA, 21 bp, Mus musculus
gaggacaagaagtgggtctgt

SEQ ID NO: 200415 - DNA, 21 bp, Mus musculus
tgtgcaaatatatacaataca

SEQ ID NO: 200416 - DNA, 20 bp, Mus musculus
atatgtatatgtgtatatgt

SEQ ID NO: 200417 - DNA, 23 bp, Mus musculus
ctcagaaatctgtctgtctctgc

SEQ ID NO: 200418 - DNA, 18 bp, Mus musculus
cacttcatgcactttgcg

SEQ ID NO: 200419 - DNA, 22 bp, Mus musculus
ctcgctgcctcgctggctctct

SEQ ID NO: 200420 - DNA, 18 bp, Mus musculus
tcctgtttgtgagagatg

SEQ ID NO: 200421 - DNA, 23 bp, Mus musculus
accagtgaactcagaacttagta

SEQ ID NO: 200422 - DNA, 23 bp, Mus musculus
tgtctgtctgtctgtctgtctgt

SEQ ID NO: 200423 - DNA, 19 bp, Mus musculus
tatatacacgtatgcatgt

SEQ ID NO: 200424 - DNA, 23 bp, Mus musculus
gcatatgtatatatgtatgtgta

SEQ ID NO: 200425 - DNA, 23 bp, Mus musculus
atgtgtatatatgtatatgtgag

SEQ ID NO: 200426 - DNA, 21 bp, Mus musculus
aagcagcttctgtcacacggt

SEQ ID NO: 200427 - DNA, 23 bp, Mus musculus
tttcacagtgggtaacttcagtt

SEQ ID NO: 200428 - DNA, 20 bp, Mus musculus
atgtatgtgtgcatgtgtat

SEQ ID NO: 200429 - DNA, 23 bp, Mus musculus
gccatctgtgcaacactgagtct

SEQ ID NO: 200430 - DNA, 18 bp, Mus musculus
tctctctctgtgtgtgtg

SEQ ID NO: 200431 - DNA, 23 bp, Mus musculus
tctcccagactctctctttccct

SEQ ID NO: 200432 - DNA, 20 bp, Mus musculus
acaagtgccctcacacacac

SEQ ID NO: 200433 - DNA, 22 bp, Mus musculus
aaggatgatgatggtgatggtg

SEQ ID NO: 200434 - DNA, 23 bp, Mus musculus
tatgtgtataagtatatgagtgt

SEQ ID NO: 200435 - DNA, 23 bp, Mus musculus
tgagagtgtcactgtgtctttgt

SEQ ID NO: 200436 - DNA, 19 bp, Mus musculus
tggcatatgcttccctttg

SEQ ID NO: 200437 - DNA, 18 bp, Mus musculus
aacatcctctgcacagtg

SEQ ID NO: 200438 - DNA, 23 bp, Mus musculus
agagaagactgttacgagagact

SEQ ID NO: 200439 - DNA, 22 bp, Mus musculus
tgagcagctttttgttgggtgt

SEQ ID NO: 200440 - DNA, 23 bp, Mus musculus
tgtgtgtctgtgtgtcagtagtg

SEQ ID NO: 200441 - DNA, 23 bp, Mus musculus
ctgtctgactgtctgtctgtctg

SEQ ID NO: 200442 - DNA, 23 bp, Mus musculus
actgggtgactgggtgactgggt

SEQ ID NO: 200443 - DNA, 23 bp, Mus musculus
tctctgggtccctgggtgccaaa

SEQ ID NO: 200444 - DNA, 23 bp, Mus musculus
agctgagagaagagagtgtgcct

SEQ ID NO: 200445 - DNA, 19 bp, Mus musculus
gactgaggctcactctctg

SEQ ID NO: 200446 - DNA, 23 bp, Mus musculus
tttgtggttgtacaactggtggg

SEQ ID NO: 200447 - DNA, 23 bp, Mus musculus
tatgagtgaggatatgtatatgt

SEQ ID NO: 200448 - DNA, 23 bp, Mus musculus
gctcgctcgctcgctcattggct

SEQ ID NO: 200449 - DNA, 23 bp, Mus musculus
tcagtctcttggtagtatgcagc

SEQ ID NO: 200450 - DNA, 21 bp, Mus musculus
tgacaactttaaaagaaatgg

SEQ ID NO: 200451 - DNA, 19 bp, Mus musculus
tttagtcactggtttggag

SEQ ID NO: 200452 - DNA, 23 bp, Mus musculus
ctctcctctctctatctgtctgt

SEQ ID NO: 200453 - DNA, 21 bp, Mus musculus
atgatgcttgtaacttgctct

SEQ ID NO: 200454 - DNA, 23 bp, Mus musculus
atgtcacagaagccagagagcac

SEQ ID NO: 200455 - DNA, 23 bp, Mus musculus
ctctctcatccagtctctgtcat

SEQ ID NO: 200456 - DNA, 20 bp, Mus musculus
attgcatatatattgtatat

SEQ ID NO: 200457 - DNA, 18 bp, Mus musculus
caatgcatgtatacacat

SEQ ID NO: 200458 - DNA, 23 bp, Mus musculus
tttcaactcaggtatgtctcacc

SEQ ID NO: 200459 - DNA, 23 bp, Mus musculus
cagtaattacagagcttgtggtt

SEQ ID NO: 200460 - DNA, 18 bp, Mus musculus
ttactggtatgtatgtac

SEQ ID NO: 200461 - DNA, 21 bp, Mus musculus
tatgtgtgtgccaaatatatg

SEQ ID NO: 200462 - DNA, 20 bp, Mus musculus
taacccttgctgctgctgtg

SEQ ID NO: 200463 - DNA, 23 bp, Mus musculus
tttctctctcttcggtgaggcta

SEQ ID NO: 200464 - DNA, 22 bp, Mus musculus
gaacccagagagcacaagagtc

SEQ ID NO: 200465 - DNA, 23 bp, Mus musculus
ttctgagttctgtgtgtctctcc

SEQ ID NO: 200466 - DNA, 23 bp, Mus musculus
gggtccctgtcacactcagtgaa

SEQ ID NO: 200467 - DNA, 23 bp, Mus musculus
ctctacagacacattctctcaat

SEQ ID NO: 200468 - DNA, 23 bp, Mus musculus
acatatgtatatgtataggtata

SEQ ID NO: 200469 - DNA, 21 bp, Mus musculus
atcaggggctgtctctgactc

SEQ ID NO: 200470 - DNA, 22 bp, Mus musculus
tataaggtactttagggagact

SEQ ID NO: 200471 - DNA, 23 bp, Mus musculus
tgcatatcagtgtgtgtatgtat

SEQ ID NO: 200472 - DNA, 23 bp, Mus musculus
tatacacacacgtatgtatcaga

SEQ ID NO: 200473 - DNA, 23 bp, Mus musculus
tctctatgtgtatgtgtgtgtgt

SEQ ID NO: 200474 - DNA, 21 bp, Mus musculus
atacaatatatatgtatgtgt

SEQ ID NO: 200475 - DNA, 19 bp, Mus musculus
tatgtgtatatatgtgtgt

SEQ ID NO: 200476 - DNA, 21 bp, Mus musculus
tgattgacattccactttgtg

SEQ ID NO: 200477 - DNA, 23 bp, Mus musculus
aggaatgagagcagacagtgcag

SEQ ID NO: 200478 - DNA, 19 bp, Mus musculus
catcgcctgcagctgctca

SEQ ID NO: 200479 - DNA, 23 bp, Mus musculus
atgtgtctgtttgtctgtctctt

SEQ ID NO: 200480 - DNA, 23 bp, Mus musculus
tgtatgtatgtatgtgtgtatgt

SEQ ID NO: 200481 - DNA, 23 bp, Mus musculus
cagtgtgagaaacatggttgatt

SEQ ID NO: 200482 - DNA, 22 bp, Mus musculus
tatgaatgtatgtatatgtaca

SEQ ID NO: 200483 - DNA, 23 bp, Mus musculus
gtgtctgtctgtctgtctgtctg

SEQ ID NO: 200484 - DNA, 18 bp, Mus musculus
cctggaacttgctctgta

SEQ ID NO: 200485 - DNA, 22 bp, Mus musculus
gtgttattctagggattacaat

SEQ ID NO: 200486 - DNA, 23 bp, Mus musculus
atgtatgtatatgtatgtatatc

SEQ ID NO: 200487 - DNA, 20 bp, Mus musculus
actgcagagatggctcagcg

SEQ ID NO: 200488 - DNA, 23 bp, Mus musculus
gtctctcaggctctggcagtctc

SEQ ID NO: 200489 - DNA, 23 bp, Mus musculus
tctgtgtgtgtgcatgtgcatgt

SEQ ID NO: 200490 - DNA, 23 bp, Mus musculus
tgtgtatgtctctctgtgtaatt

SEQ ID NO: 200491 - DNA, 18 bp, Mus musculus
atgtatgtgtgtatgagg

SEQ ID NO: 200492 - DNA, 23 bp, Mus musculus
tcgtagctcctggtatacagtaa

SEQ ID NO: 200493 - DNA, 19 bp, Mus musculus
atgtgtgcatgtacatgtg

SEQ ID NO: 200494 - DNA, 23 bp, Mus musculus
agcctcggtctctctctctagcg

SEQ ID NO: 200495 - DNA, 18 bp, Mus musculus
cagaggtcctgagttcaa

SEQ ID NO: 200496 - DNA, 22 bp, Mus musculus
atatatgcatatatatatcatg

SEQ ID NO: 200497 - DNA, 23 bp, Mus musculus
tagatgctgcttaaaattagaga

SEQ ID NO: 200498 - DNA, 23 bp, Mus musculus
attcacaatgtgcatgtgcatgt

SEQ ID NO: 200499 - DNA, 23 bp, Mus musculus
agcatgtatgtatgtatgtatgt

SEQ ID NO: 200500 - DNA, 21 bp, Mus musculus
tgcatgcatgcatgtatgtac

SEQ ID NO: 200501 - DNA, 20 bp, Mus musculus
ttgacacaagttagagtcat

SEQ ID NO: 200502 - DNA, 18 bp, Mus musculus
tagtatgagagctggatt

SEQ ID NO: 200503 - DNA, 23 bp, Mus musculus
tctattgattatgttcttgtgct

SEQ ID NO: 200504 - DNA, 23 bp, Mus musculus
tgatgtctgcctctctctgtgac

SEQ ID NO: 200505 - DNA, 23 bp, Mus musculus
tgtgtttctatatgtatgtgtgt

SEQ ID NO: 200506 - DNA, 23 bp, Mus musculus
actttatccattactgttcctat

SEQ ID NO: 200507 - DNA, 23 bp, Mus musculus
cacacacttgtctgctctttgct

SEQ ID NO: 200508 - DNA, 23 bp, Mus musculus
actgaagagtgaacctaaggctg

SEQ ID NO: 200509 - DNA, 23 bp, Mus musculus
tgtcactgtcactcctacagcac

SEQ ID NO: 200510 - DNA, 22 bp, Mus musculus
taaagacactcactctctctgg

SEQ ID NO: 200511 - DNA, 23 bp, Mus musculus
gtggagacagtagtggtagaggt

SEQ ID NO: 200512 - DNA, 23 bp, Mus musculus
agaagtctgcctgtctctgcctc

SEQ ID NO: 200513 - DNA, 20 bp, Mus musculus
tttgctactttaggactgaa

SEQ ID NO: 200514 - DNA, 22 bp, Mus musculus
aagttcaaggtatgtatgtatg

SEQ ID NO: 200515 - DNA, 20 bp, Mus musculus
atgtatgtatgtatgtatgt

SEQ ID NO: 200516 - DNA, 21 bp, Mus musculus
acatgtatgtatatatgtatg

SEQ ID NO: 200517 - DNA, 21 bp, Mus musculus
tattgaatgttattctttaca

SEQ ID NO: 200518 - DNA, 20 bp, Mus musculus
ttctgcttggtcattgtcta

SEQ ID NO: 200519 - DNA, 23 bp, Mus musculus
ctgtctgtgtgcatctgtgtgtg

SEQ ID NO: 200520 - DNA, 18 bp, Mus musculus
ttatcagtggaagtcata

SEQ ID NO: 200521 - DNA, 19 bp, Mus musculus
acagcagagagagtgctga

SEQ ID NO: 200522 - DNA, 23 bp, Mus musculus
tctctgtgtgtgtacataagtgt

SEQ ID NO: 200523 - DNA, 23 bp, Mus musculus
tatatatgtgcatacacagtatg

SEQ ID NO: 200524 - DNA, 19 bp, Mus musculus
gtatgtatatatgtgtgta

SEQ ID NO: 200525 - DNA, 23 bp, Mus musculus
acatattatgtatgtatgtatgt

SEQ ID NO: 200526 - DNA, 23 bp, Mus musculus
ctgtctgtctgtctgtctgtctg

SEQ ID NO: 200527 - DNA, 22 bp, Mus musculus
acaggaaccacagagtccagaa

SEQ ID NO: 200528 - DNA, 23 bp, Mus musculus
gccagggatgttgctgcagcctt

SEQ ID NO: 200529 - DNA, 19 bp, Mus musculus
aaacatcttcccggtgggt

SEQ ID NO: 200530 - DNA, 18 bp, Mus musculus
tctagttacctaccaaag

SEQ ID NO: 200531 - DNA, 18 bp, Mus musculus
tctcagctgctgcttcag

SEQ ID NO: 200532 - DNA, 23 bp, Mus musculus
tgcctgcctgaatgcctgcctgc

SEQ ID NO: 200533 - DNA, 23 bp, Mus musculus
cagacagactgactgacaaggtt

SEQ ID NO: 200534 - DNA, 23 bp, Mus musculus
gagggagtggttggtctgagtga

SEQ ID NO: 200535 - DNA, 22 bp, Mus musculus
tgtctcacactctcatttattt

SEQ ID NO: 200536 - DNA, 23 bp, Mus musculus
gtgtgtgtgtgtgcatgtgcatg

SEQ ID NO: 200537 - DNA, 23 bp, Mus musculus
gggtgtgatttagaagggacagt

SEQ ID NO: 200538 - DNA, 20 bp, Mus musculus
tgtcaatctttctctctctt

SEQ ID NO: 200539 - DNA, 18 bp, Mus musculus
tatacattgaagcattca

SEQ ID NO: 200540 - DNA, 21 bp, Mus musculus
tcatgtaggtatagctgtgga

SEQ ID NO: 200541 - DNA, 18 bp, Mus musculus
ccatcttctggcctctgt

SEQ ID NO: 200542 - DNA, 23 bp, Mus musculus
tacacacggcacacagacagaca

SEQ ID NO: 200543 - DNA, 21 bp, Mus musculus
agtatgtggagaaaggatgaa

SEQ ID NO: 200544 - DNA, 23 bp, Mus musculus
ctgtctgtctctgtctctctatc

SEQ ID NO: 200545 - DNA, 20 bp, Mus musculus
tgtgtgtgtgcatgtgtatg

SEQ ID NO: 200546 - DNA, 23 bp, Mus musculus
gcatgcatgtatgtatgtatgta

SEQ ID NO: 200547 - DNA, 23 bp, Mus musculus
tgctcagagtggcagtagagggc

SEQ ID NO: 200548 - DNA, 23 bp, Mus musculus
ttgagttctgattttgatgtgta

SEQ ID NO: 200549 - DNA, 23 bp, Mus musculus
ttgcagccactgagaataagacc

SEQ ID NO: 200550 - DNA, 23 bp, Mus musculus
tagatggttctattgttctgtca

SEQ ID NO: 200551 - DNA, 23 bp, Mus musculus
agtgactcgctctctccctgcgt

SEQ ID NO: 200552 - DNA, 23 bp, Mus musculus
tcagagctagttctttctaatct

SEQ ID NO: 200553 - DNA, 23 bp, Mus musculus
gtatgtgcatgtgcaagtgtgtg

SEQ ID NO: 200554 - DNA, 23 bp, Mus musculus
tgcctgcctgcctgcctgcctgc

SEQ ID NO: 200555 - DNA, 18 bp, Mus musculus
tctgagatacattagtgt

SEQ ID NO: 200556 - DNA, 22 bp, Mus musculus
aatgaaatcaatatcttctgga

SEQ ID NO: 200557 - DNA, 23 bp, Mus musculus
ggctaggacgtagcttgtatagt

SEQ ID NO: 200558 - DNA, 23 bp, Mus musculus
tcttaagtgtgcatccttaggtt

SEQ ID NO: 200559 - DNA, 23 bp, Mus musculus
atatatgtgtatgtatgtgtgtg

SEQ ID NO: 200560 - DNA, 23 bp, Mus musculus
tggctctgagtgtctctgtctcc

SEQ ID NO: 200561 - DNA, 23 bp, Mus musculus
agcgtggatttctcatgttcttc

SEQ ID NO: 200562 - DNA, 22 bp, Mus musculus
tctctgtggtacttgtgagtct

SEQ ID NO: 200563 - DNA, 23 bp, Mus musculus
ttacagtcactgattcatggtca

SEQ ID NO: 200564 - DNA, 19 bp, Mus musculus
tggagatgactctgagctc

SEQ ID NO: 200565 - DNA, 19 bp, Mus musculus
cacaaggtccagcacgctc

SEQ ID NO: 200566 - DNA, 23 bp, Mus musculus
tactttgtctgcatgtacatctg

SEQ ID NO: 200567 - DNA, 21 bp, Mus musculus
tgtctctgtgagtcagcctga

SEQ ID NO: 200568 - DNA, 18 bp, Mus musculus
tgtgtgtgagtgtgtgtg

SEQ ID NO: 200569 - DNA, 22 bp, Mus musculus
atggtagatctactttagttta

SEQ ID NO: 200570 - DNA, 20 bp, Mus musculus
tttcagacataagtggcagt

SEQ ID NO: 200571 - DNA, 23 bp, Mus musculus
actctgtctgtctgtctgtgtgc

SEQ ID NO: 200572 - DNA, 23 bp, Mus musculus
tggctgtcctggaactcagagag

SEQ ID NO: 200573 - DNA, 23 bp, Mus musculus
tgtctgcctccctgactgctggg

SEQ ID NO: 200574 - DNA, 19 bp, Mus musculus
cactgaaccttctctccag

SEQ ID NO: 200575 - DNA, 18 bp, Mus musculus
tccctagaagaggggaaa

SEQ ID NO: 200576 - DNA, 23 bp, Mus musculus
tgtgcctcacagtctctgtccct

SEQ ID NO: 200577 - DNA, 23 bp, Mus musculus
aagtacttaacattggtttctta

SEQ ID NO: 200578 - DNA, 23 bp, Mus musculus
tttgtgtctggctgtgggtctct

SEQ ID NO: 200579 - DNA, 23 bp, Mus musculus
tctgtgtatgtatatgtgtgcct

SEQ ID NO: 200580 - DNA, 19 bp, Mus musculus
ctccatgaggagaagattc

SEQ ID NO: 200581 - DNA, 23 bp, Mus musculus
aggagatggttaagcagcacata

SEQ ID NO: 200582 - DNA, 23 bp, Mus musculus
tgggctcgctctttctctctgtg

SEQ ID NO: 200583 - DNA, 23 bp, Mus musculus
gagaggctctgtcagtgcctgac

SEQ ID NO: 200584 - DNA, 23 bp, Mus musculus
tgtgtagtctttttcttatagac

SEQ ID NO: 200585 - DNA, 18 bp, Mus musculus
tgtctactgggaacatgc

SEQ ID NO: 200586 - DNA, 23 bp, Mus musculus
atgtctgtgtagatgcaatcact

SEQ ID NO: 200587 - DNA, 18 bp, Mus musculus
tgcctctcactgactgac

SEQ ID NO: 200588 - DNA, 23 bp, Mus musculus
aacactgtgaagttgagtcagag

SEQ ID NO: 200589 - DNA, 18 bp, Mus musculus
accttatttcttgagaca

SEQ ID NO: 200590 - DNA, 23 bp, Mus musculus
tcactgactcagatttgggtaga

SEQ ID NO: 200591 - DNA, 23 bp, Mus musculus
gttagtgacttctgtccttatgg

SEQ ID NO: 200592 - DNA, 23 bp, Mus musculus
atgtatgtatgtatgtgtgtgtg

SEQ ID NO: 200593 - DNA, 20 bp, Mus musculus
tctctgacagtctcactggg

SEQ ID NO: 200594 - DNA, 23 bp, Mus musculus
tcagacactctgcttcactgtct

SEQ ID NO: 200595 - DNA, 23 bp, Mus musculus
ctgtctgtgtctctgtgtgtcca

SEQ ID NO: 200596 - DNA, 20 bp, Mus musculus
agacctcatctgcatgggat

SEQ ID NO: 200597 - DNA, 23 bp, Mus musculus
tgtctcactcactgagtcctttc

SEQ ID NO: 200598 - DNA, 22 bp, Mus musculus
gactggaatactaatgcgtatc

SEQ ID NO: 200599 - DNA, 21 bp, Mus musculus
tgggtgtctgtctccctgtgt

SEQ ID NO: 200600 - DNA, 23 bp, Mus musculus
tatatatgtatgtgtatatatgt

SEQ ID NO: 200601 - DNA, 21 bp, Mus musculus
tgcagaaacagtttgatgact

SEQ ID NO: 200602 - DNA, 23 bp, Mus musculus
gtgagtgtgtgtgtgtctgtgta

SEQ ID NO: 200603 - DNA, 19 bp, Mus musculus
tatgtgcatttgtatatct

SEQ ID NO: 200604 - DNA, 23 bp, Mus musculus
gctcagactcattctgtctcatt

SEQ ID NO: 200605 - DNA, 23 bp, Mus musculus
tgtctgtctttctgtctgtctca

SEQ ID NO: 200606 - DNA, 23 bp, Mus musculus
gtgtgtgcatgttcatgtgcaca

SEQ ID NO: 200607 - DNA, 23 bp, Mus musculus
tatgcatatgtgtatgcagttgt

SEQ ID NO: 200608 - DNA, 23 bp, Mus musculus
tttgtgtatatatatatgtgtgt

SEQ ID NO: 200609 - DNA, 22 bp, Mus musculus
atatgcgtgcctgtgtgtttag

SEQ ID NO: 200610 - DNA, 22 bp, Mus musculus
acacacacatatgtgtgtgtat

SEQ ID NO: 200611 - DNA, 20 bp, Mus musculus
atacacacgcatatatatgt

SEQ ID NO: 200612 - DNA, 21 bp, Mus musculus
ttcagtgatgagtgtgagctg

SEQ ID NO: 200613 - DNA, 21 bp, Mus musculus
tatgtgtatatatatgtgtgt

SEQ ID NO: 200614 - DNA, 21 bp, Mus musculus
ttagacctttggtgttgtgcc

SEQ ID NO: 200615 - DNA, 22 bp, Mus musculus
tgactctgtgattctgtgactg

SEQ ID NO: 200616 - DNA, 18 bp, Mus musculus
ggtgatcagataggatgt

SEQ ID NO: 200617 - DNA, 22 bp, Mus musculus
atgtatgtatgtatgtgtgtac

SEQ ID NO: 200618 - DNA, 22 bp, Mus musculus
taacacacccagcttagataag

SEQ ID NO: 200619 - DNA, 22 bp, Mus musculus
tgttttgtgaccaattatatgg

SEQ ID NO: 200620 - DNA, 20 bp, Mus musculus
ttgagagaagacagaggcct

SEQ ID NO: 200621 - DNA, 22 bp, Mus musculus
ttctctgggtcacacactccct

SEQ ID NO: 200622 - DNA, 21 bp, Mus musculus
tgtgtgcctgtgtgcttgcgc

SEQ ID NO: 200623 - DNA, 20 bp, Mus musculus
ttcagtctgtccagtgctgg

SEQ ID NO: 200624 - DNA, 23 bp, Mus musculus
gcctgcctgcctgcctgcctgtc

SEQ ID NO: 200625 - DNA, 23 bp, Mus musculus
tctgcatgtctgtgtgtctgtat

SEQ ID NO: 200626 - DNA, 21 bp, Mus musculus
tgcctgtctctgtctctgtct

SEQ ID NO: 200627 - DNA, 22 bp, Mus musculus
tgcatgtatgtatgtatgtatg

SEQ ID NO: 200628 - DNA, 23 bp, Mus musculus
actgaggtatgtatgtatgtatg

SEQ ID NO: 200629 - DNA, 21 bp, Mus musculus
ctgggtcactgtcaggagaca

SEQ ID NO: 200630 - DNA, 23 bp, Mus musculus
cactgctgtgctagtattgttgt

SEQ ID NO: 200631 - DNA, 23 bp, Mus musculus
ctatcagcagcagcagcagcatc

SEQ ID NO: 200632 - DNA, 23 bp, Mus musculus
cactctgtccctgagtagcttta

SEQ ID NO: 200633 - DNA, 23 bp, Mus musculus
tgtatatttgtatgtatgtatgt

SEQ ID NO: 200634 - DNA, 23 bp, Mus musculus
tgtgtgtatatatgtatatgtga

SEQ ID NO: 200635 - DNA, 23 bp, Mus musculus
tgagtctctgcctgtgtgggtct

SEQ ID NO: 200636 - DNA, 23 bp, Mus musculus
atagtgaagagagacagcacaga

SEQ ID NO: 200637 - DNA, 18 bp, Mus musculus
actctgtagaccaggctg

SEQ ID NO: 200638 - DNA, 23 bp, Mus musculus
tgcctgcctgcctgcctgcctgc

SEQ ID NO: 200639 - DNA, 23 bp, Mus musculus
aagctctgtctcacactgtccct

SEQ ID NO: 200640 - DNA, 23 bp, Mus musculus
tgacactgtgacctgacaagctg

SEQ ID NO: 200641 - DNA, 23 bp, Mus musculus
agatctctttctgacagctaagg

SEQ ID NO: 200642 - DNA, 20 bp, Mus musculus
gagcctgtctcactccctct

SEQ ID NO: 200643 - DNA, 23 bp, Mus musculus
tgtgtccatctacatgtgtgtgt

SEQ ID NO: 200644 - DNA, 23 bp, Mus musculus
tgcatatgtgtgtctatgtatat

SEQ ID NO: 200645 - DNA, 21 bp, Mus musculus
tgacaccttctgtctgtctgt

SEQ ID NO: 200646 - DNA, 23 bp, Mus musculus
agagctacatacacacacacaca

SEQ ID NO: 200647 - DNA, 23 bp, Mus musculus
tctctctctggctctcagagccc

SEQ ID NO: 200648 - DNA, 23 bp, Mus musculus
tgtcactgggcatggactttgag

SEQ ID NO: 200649 - DNA, 23 bp, Mus musculus
cccagtgtctctctctctctgcc

SEQ ID NO: 200650 - DNA, 23 bp, Mus musculus
tatgcatgtatgtatgtttgtat

SEQ ID NO: 200651 - DNA, 23 bp, Mus musculus
ctctgtctgactgcctgtttctg

SEQ ID NO: 200652 - DNA, 23 bp, Mus musculus
gagcctctctcactgcctgatga

SEQ ID NO: 200653 - DNA, 23 bp, Mus musculus
actggaactgactgggaggctct

SEQ ID NO: 200654 - DNA, 21 bp, Mus musculus
tcaatgcaacttagactcagg

SEQ ID NO: 200655 - DNA, 23 bp, Mus musculus
aggtgcttacagtctgagcactc

SEQ ID NO: 200656 - DNA, 18 bp, Mus musculus
aatgaagtagtcatggtg

SEQ ID NO: 200657 - DNA, 21 bp, Mus musculus
tcccaggttctgatttcgttc

SEQ ID NO: 200658 - DNA, 23 bp, Mus musculus
gagatgttcatttgtttgggacg

SEQ ID NO: 200659 - DNA, 20 bp, Mus musculus
cactcagggacagtgtggcc

SEQ ID NO: 200660 - DNA, 22 bp, Mus musculus
tgcttttatgtgcatttgtatt

SEQ ID NO: 200661 - DNA, 23 bp, Mus musculus
agcagctgacagtctgcatctgc

SEQ ID NO: 200662 - DNA, 22 bp, Mus musculus
ttctgagtttctgttttgctcc

SEQ ID NO: 200663 - DNA, 19 bp, Mus musculus
gaacaggctgacttgaact

SEQ ID NO: 200664 - DNA, 23 bp, Mus musculus
tgtctgtctttctgtctgtctgt

SEQ ID NO: 200665 - DNA, 23 bp, Mus musculus
tctgccagtgtctctccttccct

SEQ ID NO: 200666 - DNA, 23 bp, Mus musculus
agacagatctctgtgagctcaag

SEQ ID NO: 200667 - DNA, 23 bp, Mus musculus
tctagcttgtagaagtgcacaca

SEQ ID NO: 200668 - DNA, 23 bp, Mus musculus
aactcacactcagtctcactgct

SEQ ID NO: 200669 - DNA, 23 bp, Mus musculus
ttactgtctgactttctgtctct

SEQ ID NO: 200670 - DNA, 23 bp, Mus musculus
tctgtctgtctgtctacctatct

SEQ ID NO: 200671 - DNA, 18 bp, Mus musculus
tagcacacttttgtgaga

SEQ ID NO: 200672 - DNA, 22 bp, Mus musculus
tgttttgtgaccaattatatgg

SEQ ID NO: 200673 - DNA, 18 bp, Mus musculus
ctcactgtggaagctgta

SEQ ID NO: 200674 - DNA, 22 bp, Mus musculus
tgtactatgcatgcatgtgtat

SEQ ID NO: 200675 - DNA, 23 bp, Mus musculus
tctctgtgtgtgcatgtgtgtgg

SEQ ID NO: 200676 - DNA, 20 bp, Mus musculus
tgtatatatgcatgtgtgtg

SEQ ID NO: 200677 - DNA, 21 bp, Mus musculus
aactgaatagtaggtgttctt

SEQ ID NO: 200678 - DNA, 22 bp, Mus musculus
tgagaccctgtctctctgcccc

SEQ ID NO: 200679 - DNA, 20 bp, Mus musculus
tctgagaactgtgtgaggcc

SEQ ID NO: 200680 - DNA, 23 bp, Mus musculus
tatatgtatgtacacaagtgtgt

SEQ ID NO: 200681 - DNA, 23 bp, Mus musculus
gtgtctctctctcacttcttgct

SEQ ID NO: 200682 - DNA, 19 bp, Mus musculus
aatggttttgacagtgtag

SEQ ID NO: 200683 - DNA, 21 bp, Mus musculus
atttgcatatatacttgggag

SEQ ID NO: 200684 - DNA, 19 bp, Mus musculus
tctctgtctgtgtatatgc

SEQ ID NO: 200685 - DNA, 22 bp, Mus musculus
cacacacatttaaataaggatg

SEQ ID NO: 200686 - DNA, 18 bp, Mus musculus
tgtgtgtgtgtgtgtgtg

SEQ ID NO: 200687 - DNA, 23 bp, Mus musculus
acatccagctttgtacatgggtt

SEQ ID NO: 200688 - DNA, 23 bp, Mus musculus
atgtgtgagtgcatgtgcatgca

SEQ ID NO: 200689 - DNA, 19 bp, Mus musculus
ggaagaagttcctgaagta

SEQ ID NO: 200690 - DNA, 23 bp, Mus musculus
atctgggtcactcagtcgctctc

SEQ ID NO: 200691 - DNA, 23 bp, Mus musculus
agggagagagtgtttatggacag

SEQ ID NO: 200692 - DNA, 23 bp, Mus musculus
tgtgcatgtgcatgagtatgtgt

SEQ ID NO: 200693 - DNA, 23 bp, Mus musculus
atgatacaatgcacatgtagagg

SEQ ID NO: 200694 - DNA, 23 bp, Mus musculus
atatatgtatgtatatatgtatg

SEQ ID NO: 200695 - DNA, 22 bp, Mus musculus
tgttttgtgaccaattatatgg

SEQ ID NO: 200696 - DNA, 22 bp, Mus musculus
tatatacatatgttgttataca

SEQ ID NO: 200697 - DNA, 23 bp, Mus musculus
atgtctgtgcagcatctgtgtgt

SEQ ID NO: 200698 - DNA, 23 bp, Mus musculus
tgttaacctagctatagttatca

SEQ ID NO: 200699 - DNA, 20 bp, Mus musculus
agccaacagtatcccacaac

SEQ ID NO: 200700 - DNA, 23 bp, Mus musculus
tctctgcctcactgggtgagtga

SEQ ID NO: 200701 - DNA, 23 bp, Mus musculus
tcttcacacacactctctgggag

SEQ ID NO: 200702 - DNA, 23 bp, Mus musculus
tcacagagtgttctagtggagcc

SEQ ID NO: 200703 - DNA, 21 bp, Mus musculus
tttcaatgtgctgtgggtttg

SEQ ID NO: 200704 - DNA, 23 bp, Mus musculus
tggtgaggctagagagacagctc

SEQ ID NO: 200705 - DNA, 18 bp, Mus musculus
atggactagcagacctgt

SEQ ID NO: 200706 - DNA, 20 bp, Mus musculus
gtgactgtctgtgggccact

SEQ ID NO: 200707 - DNA, 22 bp, Mus musculus
ctggctggctctgtggctgaga

SEQ ID NO: 200708 - DNA, 22 bp, Mus musculus
taggttgtagtcgttcccatct

SEQ ID NO: 200709 - DNA, 20 bp, Mus musculus
attgacattatatgttctac

SEQ ID NO: 200710 - DNA, 20 bp, Mus musculus
atatgtgtatttgtgtgtgc

SEQ ID NO: 200711 - DNA, 23 bp, Mus musculus
taatcagaatgtgtagctcagtt

SEQ ID NO: 200712 - DNA, 23 bp, Mus musculus
ggatttgttctcctgctgcagat

SEQ ID NO: 200713 - DNA, 23 bp, Mus musculus
tgcatgtctgtaaatgcagagga

SEQ ID NO: 200714 - DNA, 23 bp, Mus musculus
agtagaaatccatgcaaaacaca

SEQ ID NO: 200715 - DNA, 22 bp, Mus musculus
agtcagggggatcatgatgagt

SEQ ID NO: 200716 - DNA, 23 bp, Mus musculus
ctccatgctggttttagagcagg

SEQ ID NO: 200717 - DNA, 20 bp, Mus musculus
tgtgtgtgtgtgtcctgtga

SEQ ID NO: 200718 - DNA, 23 bp, Mus musculus
tgccagtctctatgtctgtgtac

SEQ ID NO: 200719 - DNA, 22 bp, Mus musculus
tgtaatgtttcatttctttcca

SEQ ID NO: 200720 - DNA, 23 bp, Mus musculus
tgtgtctctgtgtggctgtcact

SEQ ID NO: 200721 - DNA, 23 bp, Mus musculus
taaactgtgtgcatcgctacagt

SEQ ID NO: 200722 - DNA, 23 bp, Mus musculus
tgtggagttgtttgcagtttggt

SEQ ID NO: 200723 - DNA, 19 bp, Mus musculus
gagagtagagagtctggag

SEQ ID NO: 200724 - DNA, 22 bp, Mus musculus
ttctttgtgcctctcttctgca

SEQ ID NO: 200725 - DNA, 23 bp, Mus musculus
gtcactagagagtcaccacagtg

SEQ ID NO: 200726 - DNA, 22 bp, Mus musculus
ttctcactacgtgctttactga

SEQ ID NO: 200727 - DNA, 21 bp, Mus musculus
tcagcttcagctttctagttt

SEQ ID NO: 200728 - DNA, 23 bp, Mus musculus
aatgcttcagattaggtagtagg

SEQ ID NO: 200729 - DNA, 23 bp, Mus musculus
ttctgttgtctggtcttaggtgt

SEQ ID NO: 200730 - DNA, 18 bp, Mus musculus
aacatctcgggctggagc

SEQ ID NO: 200731 - DNA, 23 bp, Mus musculus
aagtactgactgctcttccagag

SEQ ID NO: 200732 - DNA, 19 bp, Mus musculus
tgtctggcagtgtctgtgg

SEQ ID NO: 200733 - DNA, 23 bp, Mus musculus
gttgagagatttgagtgtggact

SEQ ID NO: 200734 - DNA, 23 bp, Mus musculus
atacatttgtatatgtttatgag

SEQ ID NO: 200735 - DNA, 23 bp, Mus musculus
tatgcatatatgtgtgtatgtgt

SEQ ID NO: 200736 - DNA, 23 bp, Mus musculus
tatgcatgtgtatgtatatgtat

SEQ ID NO: 200737 - DNA, 23 bp, Mus musculus
tatgcatatatgtgtgtatgtgt

SEQ ID NO: 200738 - DNA, 23 bp, Mus musculus
tatgcatgtgtatgtatatgtat

SEQ ID NO: 200739 - DNA, 23 bp, Mus musculus
ctgtctgtctctgctttcctagt

SEQ ID NO: 200740 - DNA, 23 bp, Mus musculus
cagagacagaagacaatctgctc

SEQ ID NO: 200741 - DNA, 23 bp, Mus musculus
ttcattctctggaagacactgtg

SEQ ID NO: 200742 - DNA, 23 bp, Mus musculus
cctctctggcactgtgattacag

SEQ ID NO: 200743 - DNA, 19 bp, Mus musculus
tacaggtggcattctattc

SEQ ID NO: 200744 - DNA, 23 bp, Mus musculus
agagaagtgagagacaagagtgc

SEQ ID NO: 200745 - DNA, 23 bp, Mus musculus
tgccagcctctgtctatgtctct

SEQ ID NO: 200746 - DNA, 23 bp, Mus musculus
tgtctacatgtgtgcctgggtgt

SEQ ID NO: 200747 - DNA, 23 bp, Mus musculus
ctacaggaggttgagcatctgat

SEQ ID NO: 200748 - DNA, 23 bp, Mus musculus
cactcactgtctgactcactcgc

SEQ ID NO: 200749 - DNA, 23 bp, Mus musculus
tgtctggctcactgcttcagtat

SEQ ID NO: 200750 - DNA, 18 bp, Mus musculus
acatatactgtatgtatg

SEQ ID NO: 200751 - DNA, 20 bp, Mus musculus
atgtatgtatgtatgtatgt

SEQ ID NO: 200752 - DNA, 19 bp, Mus musculus
ttcagattcctgtttggct

SEQ ID NO: 200753 - DNA, 23 bp, Mus musculus
tgtttacatcctgctctgctggc

SEQ ID NO: 200754 - DNA, 23 bp, Mus musculus
tgtatgtctgtgtgagggtgtca

SEQ ID NO: 200755 - DNA, 22 bp, Mus musculus
ttatagacagtagtgagctgcc

SEQ ID NO: 200756 - DNA, 23 bp, Mus musculus
ggctcagtgggtaaaatgtctgc

SEQ ID NO: 200757 - DNA, 23 bp, Mus musculus
ctgtgtgtctcagtgtctgtggg

SEQ ID NO: 200758 - DNA, 23 bp, Mus musculus
gtactgtttgcatatatatgcgt

SEQ ID NO: 200759 - DNA, 23 bp, Mus musculus
atcttcctacacacacacacata

SEQ ID NO: 200760 - DNA, 22 bp, Mus musculus
cctcctttgtagagggctttct

SEQ ID NO: 200761 - DNA, 23 bp, Mus musculus
ctgtctgtctgtctgtctgcttg

SEQ ID NO: 200762 - DNA, 23 bp, Mus musculus
ctttgtgtagttctggctgtcct

SEQ ID NO: 200763 - DNA, 23 bp, Mus musculus
tttggtagaacagacagtgctct

SEQ ID NO: 200764 - DNA, 23 bp, Mus musculus
tattgtgtatgcatgtacatgta

SEQ ID NO: 200765 - DNA, 23 bp, Mus musculus
atgtgtatatatgtatgtgtata

SEQ ID NO: 200766 - DNA, 23 bp, Mus musculus
gtctctctctctgaatctagagt

SEQ ID NO: 200767 - DNA, 23 bp, Mus musculus
gaaagaatactggtgtgtgagtt

SEQ ID NO: 200768 - DNA, 19 bp, Mus musculus
tatgtatatatgtatgtac

SEQ ID NO: 200769 - DNA, 23 bp, Mus musculus
ggttctcctcctcatacagtcac

SEQ ID NO: 200770 - DNA, 22 bp, Mus musculus
tgttttgtgaccaattatatgg

SEQ ID NO: 200771 - DNA, 22 bp, Mus musculus
tgttttgtgaccaattatatgg

SEQ ID NO: 200772 - DNA, 23 bp, Mus musculus
gaaattcttcctggagctggaga

SEQ ID NO: 200773 - DNA, 21 bp, Mus musculus
taagagcactgagtgctcttc

SEQ ID NO: 200774 - DNA, 23 bp, Mus musculus
aactgcctgtgcttcaattatat

SEQ ID NO: 200775 - DNA, 23 bp, Mus musculus
tgtctctctctctgctgttggct

SEQ ID NO: 200776 - DNA, 23 bp, Mus musculus
gtgtatatgagtatttctgcctg

SEQ ID NO: 200777 - DNA, 18 bp, Mus musculus
aggtagatagatagatag

SEQ ID NO: 200778 - DNA, 22 bp, Mus musculus
tatgtgtgtgaatatgcatatg

SEQ ID NO: 200779 - DNA, 23 bp, Mus musculus
agtggtagtagtaggttcttttc

SEQ ID NO: 200780 - DNA, 19 bp, Mus musculus
tgtgtgtgactggtgctcc

SEQ ID NO: 200781 - DNA, 22 bp, Mus musculus
agtttggttttactttgaccta

SEQ ID NO: 200782 - DNA, 22 bp, Mus musculus
aatctcagaagagactctggac

SEQ ID NO: 200783 - DNA, 22 bp, Mus musculus
tcacacagaacagccatggcaa

SEQ ID NO: 200784 - DNA, 22 bp, Mus musculus
agacttgaggcttatgacagag

SEQ ID NO: 200785 - DNA, 18 bp, Mus musculus
tgggaagatgaaaggcct

SEQ ID NO: 200786 - DNA, 21 bp, Mus musculus
gttcaggccgcctttcttctg

SEQ ID NO: 200787 - DNA, 23 bp, Mus musculus
cacattgtctctgtggctccctg

SEQ ID NO: 200788 - DNA, 19 bp, Mus musculus
gtctgcttccaactctcag

SEQ ID NO: 200789 - DNA, 18 bp, Mus musculus
aagggtgtgaccaggggt

SEQ ID NO: 200790 - DNA, 23 bp, Mus musculus
agagcctgtctgtctatctgtct

SEQ ID NO: 200791 - DNA, 21 bp, Mus musculus
tatatgcatatatatgcatat

SEQ ID NO: 200792 - DNA, 21 bp, Mus musculus
atatgcatatatatgcacata

SEQ ID NO: 200793 - DNA, 21 bp, Mus musculus
tatgactgtgtcacttgttac

SEQ ID NO: 200794 - DNA, 21 bp, Mus musculus
taattgttcctgttttggtgt

SEQ ID NO: 200795 - DNA, 21 bp, Mus musculus
tgtcacagctacaggagccat

SEQ ID NO: 200796 - DNA, 23 bp, Mus musculus
tgcatattacatgagcctgtgca

SEQ ID NO: 200797 - DNA, 20 bp, Mus musculus
tagtctcaccttcagcagag

SEQ ID NO: 200798 - DNA, 23 bp, Mus musculus
cctttgcactatctggagggaga

SEQ ID NO: 200799 - DNA, 20 bp, Mus musculus
tctcccacagattttttttt

SEQ ID NO: 200800 - DNA, 20 bp, Mus musculus
gacagtgtttctctgtgtag

SEQ ID NO: 200801 - DNA, 23 bp, Mus musculus
gtatgtatgtatgtatgtatgta

SEQ ID NO: 200802 - DNA, 22 bp, Mus musculus
tgttttgtgaccaattatatgg

SEQ ID NO: 200803 - DNA, 23 bp, Mus musculus
tattatgtatatgtatacatgtg

SEQ ID NO: 200804 - DNA, 23 bp, Mus musculus
tgcagagttctgtgaggattgat

SEQ ID NO: 200805 - DNA, 23 bp, Mus musculus
gcctgcctgcctgcctgcctgcc

SEQ ID NO: 200806 - DNA, 21 bp, Mus musculus
atgaacacagaggctctgggt

SEQ ID NO: 200807 - DNA, 23 bp, Mus musculus
ctctgtctttgtctctcatttct

SEQ ID NO: 200808 - DNA, 22 bp, Mus musculus
tgagctttggggttctgtccgt

SEQ ID NO: 200809 - DNA, 23 bp, Mus musculus
gtgcatgtgtgtgtatgtgtatg

SEQ ID NO: 200810 - DNA, 23 bp, Mus musculus
tgccacatttttgtcatagcctt

SEQ ID NO: 200811 - DNA, 21 bp, Mus musculus
atgagagaagaatggctgctg

SEQ ID NO: 200812 - DNA, 23 bp, Mus musculus
caggctggagagatagcttagag

SEQ ID NO: 200813 - DNA, 23 bp, Mus musculus
tacatatacttttactatacggg

SEQ ID NO: 200814 - DNA, 20 bp, Mus musculus
ctgacttcagtttcagtcac

SEQ ID NO: 200815 - DNA, 23 bp, Mus musculus
tgtcaatgtttttgtacctgatt

SEQ ID NO: 200816 - DNA, 22 bp, Mus musculus
atgtacttctcataggaacttc

SEQ ID NO: 200817 - DNA, 21 bp, Mus musculus
tatatgtatgtatatatatgt

SEQ ID NO: 200818 - DNA, 23 bp, Mus musculus
tagtgcatggtgatctgatagga

SEQ ID NO: 200819 - DNA, 22 bp, Mus musculus
tgatttgtgacctattatgtgg

SEQ ID NO: 200820 - DNA, 23 bp, Mus musculus
tgcaagtgtgttgaatagttata

SEQ ID NO: 200821 - DNA, 23 bp, Mus musculus
agctgcattgttgaggcctgagc

SEQ ID NO: 200822 - DNA, 21 bp, Mus musculus
tacatgtacatatacatatac

SEQ ID NO: 200823 - DNA, 21 bp, Mus musculus
ttatagtatatgtgtatatgt

SEQ ID NO: 200824 - DNA, 23 bp, Mus musculus
aatgtgtttgtatatgtatatat

SEQ ID NO: 200825 - DNA, 23 bp, Mus musculus
ttagagaatcggagataagtgtg

SEQ ID NO: 200826 - DNA, 23 bp, Mus musculus
tgtgtgtgcatgtgcatgtgtgt

SEQ ID NO: 200827 - DNA, 23 bp, Mus musculus
agtcagtccctcaatctgcggga

SEQ ID NO: 200828 - DNA, 21 bp, Mus musculus
tcaagtgaccatagctgtgtg

SEQ ID NO: 200829 - DNA, 23 bp, Mus musculus
atatgcatgtatatatgtgtgta

SEQ ID NO: 200830 - DNA, 19 bp, Mus musculus
gtatattatatgtgtgtac

SEQ ID NO: 200831 - DNA, 22 bp, Mus musculus
tgttttgtgaccaattatatgg

SEQ ID NO: 200832 - DNA, 22 bp, Mus musculus
tgttttgtgaccaattatatgg

SEQ ID NO: 200833 - DNA, 23 bp, Mus musculus
acagcctcacaaattcatctgcc

SEQ ID NO: 200834 - DNA, 23 bp, Mus musculus
tacatatacattatgtattcata

SEQ ID NO: 200835 - DNA, 23 bp, Mus musculus
tgtaacaatgtatctgtgtatat

SEQ ID NO: 200836 - DNA, 23 bp, Mus musculus
agtctgcctgtctgcctgacttc

SEQ ID NO: 200837 - DNA, 22 bp, Mus musculus
tgttttgtgaccaattatatgg

SEQ ID NO: 200838 - DNA, 22 bp, Mus musculus
tttatttttttgaccaggctgg

SEQ ID NO: 200839 - DNA, 23 bp, Mus musculus
agagactggaagagcttcaaggg

SEQ ID NO: 200840 - DNA, 21 bp, Mus musculus
tttctcagccttctttgacgg

SEQ ID NO: 200841 - DNA, 23 bp, Mus musculus
ttgtgtggcttgaacttgtgtag

SEQ ID NO: 200842 - DNA, 20 bp, Mus musculus
tgagtggagtgagaggacaa

SEQ ID NO: 200843 - DNA, 21 bp, Mus musculus
tcttcagtcctcctaattcat

SEQ ID NO: 200844 - DNA, 18 bp, Mus musculus
acctcgggtagcagctga

SEQ ID NO: 200845 - DNA, 23 bp, Mus musculus
tttctttggaccatttgcttgga

SEQ ID NO: 200846 - DNA, 23 bp, Mus musculus
gcagtgtgtctctgactctttgg

SEQ ID NO: 200847 - DNA, 23 bp, Mus musculus
atatgtaacaactctgaggattt

SEQ ID NO: 200848 - DNA, 22 bp, Mus musculus
tgttttgtgaccaattatatgg

SEQ ID NO: 200849 - DNA, 23 bp, Mus musculus
tgttaccatgcaaaagatatcct

SEQ ID NO: 200850 - DNA, 23 bp, Mus musculus
ggtctctgtctcttgctgtctct

SEQ ID NO: 200851 - DNA, 23 bp, Mus musculus
tctttcagagatattgtagttct

SEQ ID NO: 200852 - DNA, 21 bp, Mus musculus
agcagatgatgataatgagag

SEQ ID NO: 200853 - DNA, 20 bp, Mus musculus
agtgagaagacagtgagatg

SEQ ID NO: 200854 - DNA, 23 bp, Mus musculus
ttaagagcactgactgctcttcc

SEQ ID NO: 200855 - DNA, 22 bp, Mus musculus
tttcagactgtggattcagtgt

SEQ ID NO: 200856 - DNA, 21 bp, Mus musculus
tgagacagtattgcaaccagt

SEQ ID NO: 200857 - DNA, 20 bp, Mus musculus
atgtatgtatatatgtatgt

SEQ ID NO: 200858 - DNA, 23 bp, Mus musculus
agaactgactggtttactttatt

SEQ ID NO: 200859 - DNA, 23 bp, Mus musculus
tgatccctgtctctgtatagcca

SEQ ID NO: 200860 - DNA, 22 bp, Mus musculus
tctactgtacatagagagctca

SEQ ID NO: 200861 - DNA, 22 bp, Mus musculus
tatatgtgtgtgtatatataga

SEQ ID NO: 200862 - DNA, 23 bp, Mus musculus
tgtatgtatgtatgtatgtgtgt

SEQ ID NO: 200863 - DNA, 23 bp, Mus musculus
tctgtgactctgaggcactttgg

SEQ ID NO: 200864 - DNA, 21 bp, Mus musculus
cagtcactgtctgtccctgtg

SEQ ID NO: 200865 - DNA, 18 bp, Mus musculus
agtggacagtttgagtct

SEQ ID NO: 200866 - DNA, 23 bp, Mus musculus
aatgtttgaatttttgactgagc

SEQ ID NO: 200867 - DNA, 23 bp, Mus musculus
tcccagactgtctctgcaaatca

SEQ ID NO: 200868 - DNA, 19 bp, Mus musculus
tatggaactgtgagtgtgt

SEQ ID NO: 200869 - DNA, 22 bp, Mus musculus
tatgagtgtgtgtgtgtctgtg

SEQ ID NO: 200870 - DNA, 23 bp, Mus musculus
tctctcactctagtccttcccat

SEQ ID NO: 200871 - DNA, 23 bp, Mus musculus
tctcactcagtcatcgaagagag

SEQ ID NO: 200872 - DNA, 21 bp, Mus musculus
ctgtgtctgtcactgaacctg

SEQ ID NO: 200873 - DNA, 23 bp, Mus musculus
atgtatgtctatattgtatgtgt

SEQ ID NO: 200874 - DNA, 22 bp, Mus musculus
tgttttgtgaccaattatatgg

SEQ ID NO: 200875 - DNA, 23 bp, Mus musculus
taagagcactgactgctcttcca

SEQ ID NO: 200876 - DNA, 22 bp, Mus musculus
tattggttatatatgtgtatgt

SEQ ID NO: 200877 - DNA, 23 bp, Mus musculus
ctgactgctcttccagaggtcct

SEQ ID NO: 200878 - DNA, 19 bp, Mus musculus
tttcacggagtctaactag

SEQ ID NO: 200879 - DNA, 23 bp, Mus musculus
gttgggaagttcttagtgttctg

SEQ ID NO: 200880 - DNA, 23 bp, Mus musculus
agaaggaagaggatgtgaatgct

SEQ ID NO: 200881 - DNA, 23 bp, Mus musculus
tgactgctagtgtgtgtgactct

SEQ ID NO: 200882 - DNA, 23 bp, Mus musculus
acatgtaagtgtgcatatgcatg

SEQ ID NO: 200883 - DNA, 22 bp, Mus musculus
tgttttgtgaccaattatatgg

SEQ ID NO: 200884 - DNA, 23 bp, Mus musculus
gcctgggtctctctgtgagtgtg

SEQ ID NO: 200885 - DNA, 23 bp, Mus musculus
atagatgagtgggctaatagtgt

SEQ ID NO: 200886 - DNA, 23 bp, Mus musculus
tcactcagtttctctcaccatca

SEQ ID NO: 200887 - DNA, 19 bp, Mus musculus
aagtggtggtcttacctgt

SEQ ID NO: 200888 - DNA, 21 bp, Mus musculus
gcactcctgagatacactctc

SEQ ID NO: 200889 - DNA, 23 bp, Mus musculus
aggggctggagagataggctcag

SEQ ID NO: 200890 - DNA, 23 bp, Mus musculus
ggtcgtttagaaagatttcatta

SEQ ID NO: 200891 - DNA, 22 bp, Mus musculus
tgtgccagggtgagaggctgtg

SEQ ID NO: 200892 - DNA, 23 bp, Mus musculus
ctctctctctctctcacacacac

SEQ ID NO: 200893 - DNA, 23 bp, Mus musculus
agagttacaaatgacagagtcat

SEQ ID NO: 200894 - DNA, 21 bp, Mus musculus
tatgtgcaagtgtgtatatgt

SEQ ID NO: 200895 - DNA, 22 bp, Mus musculus
ttcccagtatatgaatatttct

SEQ ID NO: 200896 - DNA, 22 bp, Mus musculus
tgttttgtgaccaattatatgg

SEQ ID NO: 200897 - DNA, 23 bp, Mus musculus
tatgtgcatatgtatagatatgt

SEQ ID NO: 200898 - DNA, 23 bp, Mus musculus
tatgtgcaaatgtgtttgtgttt

SEQ ID NO: 200899 - DNA, 23 bp, Mus musculus
caagagtgtacatgctggactca

SEQ ID NO: 200900 - DNA, 19 bp, Mus musculus
tgctgagtttaaaagtatg

SEQ ID NO: 200901 - DNA, 22 bp, Mus musculus
tgttttgtgaccaattatatgg

SEQ ID NO: 200902 - DNA, 23 bp, Mus musculus
gtttcactctgtggctgtgacag

SEQ ID NO: 200903 - DNA, 21 bp, Mus musculus
ttgagaaagattttgtagcgt

SEQ ID NO: 200904 - DNA, 22 bp, Mus musculus
tgttttgtgaccaattatatgg

SEQ ID NO: 200905 - DNA, 21 bp, Mus musculus
tccatggtggtctgataggat

SEQ ID NO: 200906 - DNA, 18 bp, Mus musculus
tttgtttttttgtaaaac

SEQ ID NO: 200907 - DNA, 20 bp, Mus musculus
agcgatgtgtcgaagcagta

SEQ ID NO: 200908 - DNA, 23 bp, Mus musculus
ttgcaactggttactttggagat

SEQ ID NO: 200909 - DNA, 20 bp, Mus musculus
tctctgtgtctcatctctct

SEQ ID NO: 200910 - DNA, 20 bp, Mus musculus
tgtgtgtatatatatatatg

SEQ ID NO: 200911 - DNA, 21 bp, Mus musculus
acaggaagactcaggctctct

SEQ ID NO: 200912 - DNA, 22 bp, Mus musculus
aaacagagcttacttcataaag

SEQ ID NO: 200913 - DNA, 23 bp, Mus musculus
aaggagcatgaatgatatgacaa

SEQ ID NO: 200914 - DNA, 22 bp, Mus musculus
ccatgagatatgtgttagaaag

SEQ ID NO: 200915 - DNA, 23 bp, Mus musculus
tgtgtgtgtactaaacaaaccta

SEQ ID NO: 200916 - DNA, 23 bp, Mus musculus
tgggcctcacactgtctctatgg

SEQ ID NO: 200917 - DNA, 23 bp, Mus musculus
tctactgagttcagtgtcagtgt

SEQ ID NO: 200918 - DNA, 23 bp, Mus musculus
cataaatgtttagaattgtaatg

SEQ ID NO: 200919 - DNA, 19 bp, Mus musculus
cagaggtgacttggagccc

SEQ ID NO: 200920 - DNA, 22 bp, Mus musculus
tgcctgtgacactttcagctgt

SEQ ID NO: 200921 - DNA, 21 bp, Mus musculus
ttctgaggaacctccagactg

SEQ ID NO: 200922 - DNA, 23 bp, Mus musculus
tgtcaccctctcagtgtgtctcc

SEQ ID NO: 200923 - DNA, 22 bp, Mus musculus
tgttttgtgaccaattatatgg

SEQ ID NO: 200924 - DNA, 23 bp, Mus musculus
gtgtctgtatttgtcatgctctg

SEQ ID NO: 200925 - DNA, 22 bp, Mus musculus
tgttttgtgaccaattatatgg

SEQ ID NO: 200926 - DNA, 23 bp, Mus musculus
gggcctctctcttgctctcagtg

SEQ ID NO: 200927 - DNA, 23 bp, Mus musculus
tagtccatggtgatctgatagga

SEQ ID NO: 200928 - DNA, 22 bp, Mus musculus
tgttcagttaccaattatatgg

SEQ ID NO: 200929 - DNA, 22 bp, Mus musculus
tgttttgtgaccaattatatgg

SEQ ID NO: 200930 - DNA, 23 bp, Mus musculus
gtatgctgttgatgatgattgac

SEQ ID NO: 200931 - DNA, 21 bp, Mus musculus
ctgtgattatcatcatcatca

SEQ ID NO: 200932 - DNA, 23 bp, Mus musculus
tctgtctgtgtgtctgtgactac

SEQ ID NO: 200933 - DNA, 23 bp, Mus musculus
aactgtgtcaccttctgctatgt

SEQ ID NO: 200934 - DNA, 22 bp, Mus musculus
ttaagagctctgactgctcttc

SEQ ID NO: 200935 - DNA, 22 bp, Mus musculus
tgttttgtgaccaattatatgg

SEQ ID NO: 200936 - DNA, 22 bp, Mus musculus
tgttttgtgaccaattatatgg

SEQ ID NO: 200937 - DNA, 23 bp, Mus musculus
ctccactcagtgcctgactgtct

SEQ ID NO: 200938 - DNA, 22 bp, Mus musculus
acagtgaacagtgtgaggtgat

SEQ ID NO: 200939 - DNA, 22 bp, Mus musculus
tgttttgtgaccaattatatgg

SEQ ID NO: 200940 - DNA, 21 bp, Mus musculus
agagagtggcactataaggag

SEQ ID NO: 200941 - DNA, 23 bp, Mus musculus
aagtgtgtcactgtgtgggtgtg

SEQ ID NO: 200942 - DNA, 23 bp, Mus musculus
tgtgtgtatgtatgtatgtatgt

SEQ ID NO: 200943 - DNA, 22 bp, Mus musculus
gcctgtctctgcttctgtttgc

SEQ ID NO: 200944 - DNA, 23 bp, Mus musculus
gggcactgactgctcttccagag

SEQ ID NO: 200945 - DNA, 23 bp, Mus musculus
ttctcttactgctggactttagc

SEQ ID NO: 200946 - DNA, 23 bp, Mus musculus
gaggagagagtacagagtgagaa

SEQ ID NO: 200947 - DNA, 19 bp, Mus musculus
cagaggacaattcaaggaa

SEQ ID NO: 200948 - DNA, 23 bp, Mus musculus
ctctctgtctctgtctgtctgtc

SEQ ID NO: 200949 - DNA, 23 bp, Mus musculus
ttgagactagagagtgaggcagt

SEQ ID NO: 200950 - DNA, 23 bp, Mus musculus
tgagctacttactggctcaattt

SEQ ID NO: 200951 - DNA, 23 bp, Mus musculus
agagatgagagttggttctcgag

SEQ ID NO: 200952 - DNA, 22 bp, Mus musculus
tctgacaccctgagtggctcag

SEQ ID NO: 200953 - DNA, 23 bp, Mus musculus
tcacctgtgggtggagcctgtgc

SEQ ID NO: 200954 - DNA, 19 bp, Mus musculus
agggacagagtatggcgtt

SEQ ID NO: 200955 - DNA, 19 bp, Mus musculus
tctcccacactcacaccct

SEQ ID NO: 200956 - DNA, 23 bp, Mus musculus
ctctgggtctgtctgtgtggctc

SEQ ID NO: 200957 - DNA, 23 bp, Mus musculus
agtcctattgattggaaagtgta

SEQ ID NO: 200958 - DNA, 22 bp, Mus musculus
tcagagtggagagagtgtactt

SEQ ID NO: 200959 - DNA, 18 bp, Mus musculus
ctggttgtacacatttgt

SEQ ID NO: 200960 - DNA, 23 bp, Mus musculus
gtgtctgtatgtctctctctgtg

SEQ ID NO: 200961 - DNA, 22 bp, Mus musculus
tctatatcctacattttctact

SEQ ID NO: 200962 - DNA, 23 bp, Mus musculus
gaatagttgctagtttccgtatc

SEQ ID NO: 200963 - DNA, 21 bp, Mus musculus
ttctgagtcccacatttgggc

SEQ ID NO: 200964 - DNA, 23 bp, Mus musculus
tgtctgtctgtctgtctgtctgt

SEQ ID NO: 200965 - DNA, 23 bp, Mus musculus
ctgtctgtctgtgtgtctgctcg

SEQ ID NO: 200966 - DNA, 23 bp, Mus musculus
agactgactggcttattgctgtg

SEQ ID NO: 200967 - DNA, 20 bp, Mus musculus
aggctgaagtcactcaggag

SEQ ID NO: 200968 - DNA, 23 bp, Mus musculus
tatgtgtgtgtctgtgcatgtat

SEQ ID NO: 200969 - DNA, 23 bp, Mus musculus
tattactggggctggaaagatgg

SEQ ID NO: 200970 - DNA, 23 bp, Mus musculus
gtaactgctgctcctgctccagg

SEQ ID NO: 200971 - DNA, 23 bp, Mus musculus
gggctcagtcactgcctctcagt

SEQ ID NO: 200972 - DNA, 21 bp, Mus musculus
tacaaccatctgtaatgagat

SEQ ID NO: 200973 - DNA, 18 bp, Mus musculus
acaggggctggagagatg

SEQ ID NO: 200974 - DNA, 23 bp, Mus musculus
agtaatggcttgaggaagatgga

SEQ ID NO: 200975 - DNA, 20 bp, Mus musculus
caaagtgttctgtcagctgt

SEQ ID NO: 200976 - DNA, 23 bp, Mus musculus
tcacaggctctgtgcgactgctg

SEQ ID NO: 200977 - DNA, 21 bp, Mus musculus
tggctcagaggttaagagtgc

SEQ ID NO: 200978 - DNA, 23 bp, Mus musculus
ctgtctgtctgtctgcctgcctg

SEQ ID NO: 200979 - DNA, 21 bp, Mus musculus
tatgcatgtatgtatatatgt

SEQ ID NO: 200980 - DNA, 18 bp, Mus musculus
ttgaagctaagagagagt

SEQ ID NO: 200981 - DNA, 23 bp, Mus musculus
tgtgtgtgtatgtgcatgtgcat

SEQ ID NO: 200982 - DNA, 23 bp, Mus musculus
gcctgtgtctgtcactgactaca

SEQ ID NO: 200983 - DNA, 21 bp, Mus musculus
tgctgactactcttccagagg

SEQ ID NO: 200984 - DNA, 23 bp, Mus musculus
agtgtgatacttgaaagggacaa

SEQ ID NO: 200985 - DNA, 18 bp, Mus musculus
tatgtgtacttgtgtatg

SEQ ID NO: 200986 - DNA, 23 bp, Mus musculus
ttgtatgtatgtatgtgtgtgtg

SEQ ID NO: 200987 - DNA, 23 bp, Mus musculus
tgtctgcctgtctccctgtctgt

SEQ ID NO: 200988 - DNA, 19 bp, Mus musculus
cacagaagtcagacagcag

SEQ ID NO: 200989 - DNA, 18 bp, Mus musculus
atatgtgtgcatatatat

SEQ ID NO: 200990 - DNA, 23 bp, Mus musculus
tatgcatgtatgtatgtatgttc

SEQ ID NO: 200991 - DNA, 23 bp, Mus musculus
gacactctgtgtgactgtgaact

SEQ ID NO: 200992 - DNA, 23 bp, Mus musculus
tttagtcaactagcactttgttg

SEQ ID NO: 200993 - DNA, 23 bp, Mus musculus
attgtctgttctttgcagcttag

SEQ ID NO: 200994 - DNA, 18 bp, Mus musculus
ccaagctcttggtctgct

SEQ ID NO: 200995 - DNA, 23 bp, Mus musculus
ctcaagagagtgaggaaaggcct

SEQ ID NO: 200996 - DNA, 23 bp, Mus musculus
tgtgtgtgtgagtgtgcatgtgc

SEQ ID NO: 200997 - DNA, 23 bp, Mus musculus
tgcttggctgtctgtctctctgc

SEQ ID NO: 200998 - DNA, 21 bp, Mus musculus
tttgctctagtttctgaaaga

SEQ ID NO: 200999 - DNA, 23 bp, Mus musculus
tgtagtactacagcaagtcagaa

SEQ ID NO: 201000 - DNA, 23 bp, Mus musculus
gggtctctcactctcttagccca

SEQ ID NO: 201001 - DNA, 21 bp, Mus musculus
tctctgtgtgggagaggtgac

SEQ ID NO: 201002 - DNA, 20 bp, Mus musculus
atgtgtgttcatgtgtggct

SEQ ID NO: 201003 - DNA, 23 bp, Mus musculus
tatgtacatgtatgtatgtgtat

SEQ ID NO: 201004 - DNA, 23 bp, Mus musculus
tcactgaatatatgtctgatgaa

SEQ ID NO: 201005 - DNA, 23 bp, Mus musculus
cagtagattctgtgcattgcatt

SEQ ID NO: 201006 - DNA, 23 bp, Mus musculus
tgtgtgtgtgtgtctgcctgtgt

SEQ ID NO: 201007 - DNA, 18 bp, Mus musculus
tctgacagacaaatactc

SEQ ID NO: 201008 - DNA, 23 bp, Mus musculus
tgtctctccttctctagactgta

SEQ ID NO: 201009 - DNA, 23 bp, Mus musculus
tctttctctctgtcactgttctc

SEQ ID NO: 201010 - DNA, 20 bp, Mus musculus
cctacaacttgggctggaga

SEQ ID NO: 201011 - DNA, 23 bp, Mus musculus
gttttgtcagtctctgtgtgtgc

SEQ ID NO: 201012 - DNA, 19 bp, Mus musculus
tcgctcactcaccggcact

SEQ ID NO: 201013 - DNA, 22 bp, Mus musculus
caagagtaagaggtgggatgtg

SEQ ID NO: 201014 - DNA, 20 bp, Mus musculus
tctgcctatctctgtctctc

SEQ ID NO: 201015 - DNA, 23 bp, Mus musculus
gcgtcagtctcagactgtctttc

SEQ ID NO: 201016 - DNA, 23 bp, Mus musculus
gtgcacacagatactttgtagcc

SEQ ID NO: 201017 - DNA, 23 bp, Mus musculus
agaacactggctcagttcagggg

SEQ ID NO: 201018 - DNA, 22 bp, Mus musculus
tctgaaagagatcaggcagctg

SEQ ID NO: 201019 - DNA, 20 bp, Mus musculus
agatgaagagtagctaaggg

SEQ ID NO: 201020 - DNA, 21 bp, Mus musculus
tctccttatgatttctcactg

SEQ ID NO: 201021 - DNA, 23 bp, Mus musculus
gctgtgtgaccctctcactcact

SEQ ID NO: 201022 - DNA, 18 bp, Mus musculus
atgcacacatatgcatgt

SEQ ID NO: 201023 - DNA, 20 bp, Mus musculus
aatgtgtatatgtatgtgtg

SEQ ID NO: 201024 - DNA, 23 bp, Mus musculus
atgtaatgtatatatgtatatgt

SEQ ID NO: 201025 - DNA, 20 bp, Mus musculus
agggagagagatatagaaga

SEQ ID NO: 201026 - DNA, 22 bp, Mus musculus
tgtatgtgcatgtgcttgtctg

SEQ ID NO: 201027 - DNA, 19 bp, Mus musculus
ggacatttcagagtcaaca

SEQ ID NO: 201028 - DNA, 23 bp, Mus musculus
tggtctgtgagcatatctatgga

SEQ ID NO: 201029 - DNA, 23 bp, Mus musculus
ttaattcatgtagaatgtcccag

SEQ ID NO: 201030 - DNA, 23 bp, Mus musculus
ccctggttgttttcactatgtgt

SEQ ID NO: 201031 - DNA, 23 bp, Mus musculus
gtatgtatgtgtgtatgcatgta

SEQ ID NO: 201032 - DNA, 21 bp, Mus musculus
tatgcatgtatgtatatatgt

SEQ ID NO: 201033 - DNA, 23 bp, Mus musculus
ccctcacacagacatgtgtaggc

SEQ ID NO: 201034 - DNA, 23 bp, Mus musculus
atactttctgattttcatgttga

SEQ ID NO: 201035 - DNA, 22 bp, Mus musculus
ttttgtttcatattagctgtga

SEQ ID NO: 201036 - DNA, 23 bp, Mus musculus
tggaacaaatatgttgttgtatg

SEQ ID NO: 201037 - DNA, 22 bp, Mus musculus
tgtatatatgtgtatgtatgta

SEQ ID NO: 201038 - DNA, 23 bp, Mus musculus
aattttccatgcttaaggtgaga

SEQ ID NO: 201039 - DNA, 20 bp, Mus musculus
tgtgtatagtatgtgatgta

SEQ ID NO: 201040 - DNA, 22 bp, Mus musculus
ggtctctgtgtttctctgtctg

SEQ ID NO: 201041 - DNA, 23 bp, Mus musculus
gcatatatattcatgtatatgtg

SEQ ID NO: 201042 - DNA, 22 bp, Mus musculus
tctcagtctctgtaacatcttt

SEQ ID NO: 201043 - DNA, 22 bp, Mus musculus
tgttttgtgaccaattatatgg

SEQ ID NO: 201044 - DNA, 23 bp, Mus musculus
gtctcacacagactttcctctga

SEQ ID NO: 201045 - DNA, 18 bp, Mus musculus
gtgtgtgtttgcatgtgg

SEQ ID NO: 201046 - DNA, 22 bp, Mus musculus
tatgtgtatatgtatgtgtgtg

SEQ ID NO: 201047 - DNA, 22 bp, Mus musculus
tgtgtttatctgagtgcatgca

SEQ ID NO: 201048 - DNA, 23 bp, Mus musculus
tgtgtctctcagtgacaaatggc

SEQ ID NO: 201049 - DNA, 23 bp, Mus musculus
actcagtcactggtagagctcag

SEQ ID NO: 201050 - DNA, 20 bp, Mus musculus
aagcacatgtcagagtttta

SEQ ID NO: 201051 - DNA, 23 bp, Mus musculus
tatggctttttattcctatgtga

SEQ ID NO: 201052 - DNA, 23 bp, Mus musculus
ctgaggtagtagtttgtacagtt

SEQ ID NO: 201053 - DNA, 18 bp, Mus musculus
tggtcctggttgtaggag

SEQ ID NO: 201054 - DNA, 18 bp, Mus musculus
gctcagtgtgtgtgtgag

SEQ ID NO: 201055 - DNA, 23 bp, Mus musculus
aaggaagtacatgggaaggtctg

SEQ ID NO: 201056 - DNA, 22 bp, Mus musculus
tgcctctggctgtgttacttaa

SEQ ID NO: 201057 - DNA, 23 bp, Mus musculus
aagaagatcaggagctcaaggtc

SEQ ID NO: 201058 - DNA, 21 bp, Mus musculus
tatatttaactttcataacag

SEQ ID NO: 201059 - DNA, 23 bp, Mus musculus
cagaatttgggtagtatgtggga

SEQ ID NO: 201060 - DNA, 23 bp, Mus musculus
tgtttctgtcagtctgtttgcac

SEQ ID NO: 201061 - DNA, 23 bp, Mus musculus
acagtgtctgtggctctctctgc

SEQ ID NO: 201062 - DNA, 22 bp, Mus musculus
taagagtgaaggctgtctctga

SEQ ID NO: 201063 - DNA, 21 bp, Mus musculus
aggggaggatctttgtgaggg

SEQ ID NO: 201064 - DNA, 20 bp, Mus musculus
aagaagcacctcaatttctc

SEQ ID NO: 201065 - DNA, 23 bp, Mus musculus
aaagagagctataattatcagag

SEQ ID NO: 201066 - DNA, 23 bp, Mus musculus
aacacagacacttaggtgtagga

SEQ ID NO: 201067 - DNA, 22 bp, Mus musculus
aaagtgctatgaataagctgac

SEQ ID NO: 201068 - DNA, 22 bp, Mus musculus
tgttttgtgaccaattatatgg

SEQ ID NO: 201069 - DNA, 23 bp, Mus musculus
actgcctctctcagagcctgact

SEQ ID NO: 201070 - DNA, 23 bp, Mus musculus
gtctccatctctctgtggctctc

SEQ ID NO: 201071 - DNA, 23 bp, Mus musculus
cccaactctctctgtcacttatc

SEQ ID NO: 201072 - DNA, 23 bp, Mus musculus
tctgtcagtgactccctcggtgc

SEQ ID NO: 201073 - DNA, 23 bp, Mus musculus
acacgcacacactcagcttcaga

SEQ ID NO: 201074 - DNA, 19 bp, Mus musculus
aggctggcaggtaaggagg

SEQ ID NO: 201075 - DNA, 23 bp, Mus musculus
atgactgtctaactcactctcct

SEQ ID NO: 201076 - DNA, 23 bp, Mus musculus
ctctgcctgtctcactgccgctc

SEQ ID NO: 201077 - DNA, 21 bp, Mus musculus
agtagcagagtgaggagccag

SEQ ID NO: 201078 - DNA, 23 bp, Mus musculus
atagcactgactgctcttccaga

SEQ ID NO: 201079 - DNA, 22 bp, Mus musculus
ctccatttctctctcacacaca

SEQ ID NO: 201080 - DNA, 23 bp, Mus musculus
tgacagcagtgagtgagggcaag

SEQ ID NO: 201081 - DNA, 23 bp, Mus musculus
taagagcactgactgctcttcca

SEQ ID NO: 201082 - DNA, 22 bp, Mus musculus
tacagctcgtttgaataggctt

SEQ ID NO: 201083 - DNA, 23 bp, Mus musculus
ttagaggcagtgtatagagaagg

SEQ ID NO: 201084 - DNA, 21 bp, Mus musculus
tgtgactgtggaaggggtcag

SEQ ID NO: 201085 - DNA, 20 bp, Mus musculus
tccctccctccctgtttggg

SEQ ID NO: 201086 - DNA, 19 bp, Mus musculus
aggagcgtctcagaggccc

SEQ ID NO: 201087 - DNA, 18 bp, Mus musculus
agagcacacactgctgtt

SEQ ID NO: 201088 - DNA, 22 bp, Mus musculus
tgttttgtgaccaattatatgg

SEQ ID NO: 201089 - DNA, 20 bp, Mus musculus
gtatgtgcacatctgtgtgt

SEQ ID NO: 201090 - DNA, 22 bp, Mus musculus
tccctgagacactaacatgtca

SEQ ID NO: 201091 - DNA, 23 bp, Mus musculus
tgtcactgtgtgtgtgtgtcact

SEQ ID NO: 201092 - DNA, 23 bp, Mus musculus
ggtctgtctgtctgtctgtcagc

SEQ ID NO: 201093 - DNA, 23 bp, Mus musculus
tctgagaagagcctgagcacttg

SEQ ID NO: 201094 - DNA, 21 bp, Mus musculus
gggaacaaaatgctgtgtgaa

SEQ ID NO: 201095 - DNA, 19 bp, Mus musculus
cagttcctcctccactgtg

SEQ ID NO: 201096 - DNA, 21 bp, Mus musculus
atagcagaggggctggggaga

SEQ ID NO: 201097 - DNA, 21 bp, Mus musculus
acatctcgaattgagttgagg

SEQ ID NO: 201098 - DNA, 23 bp, Mus musculus
tcagtcagagctatgggtcccct

SEQ ID NO: 201099 - DNA, 23 bp, Mus musculus
ggacactgactgctcttccagag

SEQ ID NO: 201100 - DNA, 21 bp, Mus musculus
tgtgtatatgtacatgtctgt

SEQ ID NO: 201101 - DNA, 22 bp, Mus musculus
tctgtgggtgtgtctgagggtg

SEQ ID NO: 201102 - DNA, 23 bp, Mus musculus
acacatgcatatatatacatatg

SEQ ID NO: 201103 - DNA, 23 bp, Mus musculus
acaacctgtctgtgtatctctaa

SEQ ID NO: 201104 - DNA, 19 bp, Mus musculus
agtgctaagagtaaagggt

SEQ ID NO: 201105 - DNA, 22 bp, Mus musculus
tcacacagtctgaaacttatga

SEQ ID NO: 201106 - DNA, 19 bp, Mus musculus
gtttttaaatgctttgtga

SEQ ID NO: 201107 - DNA, 23 bp, Mus musculus
tgtgtgtatatgtatacaattag

SEQ ID NO: 201108 - DNA, 23 bp, Mus musculus
ttctaattgttatttgtgtgtgt

SEQ ID NO: 201109 - DNA, 23 bp, Mus musculus
tatctgtgcctgtgtctgtgtct

SEQ ID NO: 201110 - DNA, 23 bp, Mus musculus
tgcatgcatgtatgtatgtatgt

SEQ ID NO: 201111 - DNA, 20 bp, Mus musculus
agattttccttggtcatggt

SEQ ID NO: 201112 - DNA, 18 bp, Mus musculus
tatgtatgtatatatgta

SEQ ID NO: 201113 - DNA, 21 bp, Mus musculus
atgtatgtatgcatgtatgtg

SEQ ID NO: 201114 - DNA, 23 bp, Mus musculus
ttctctatcaggttatgatagga

SEQ ID NO: 201115 - DNA, 21 bp, Mus musculus
tcaagtctatagctcagtgag

SEQ ID NO: 201116 - DNA, 23 bp, Mus musculus
tatgtatctatatgtgtatgtat

SEQ ID NO: 201117 - DNA, 23 bp, Mus musculus
tctcacactgtctcttttccttg

SEQ ID NO: 201118 - DNA, 22 bp, Mus musculus
tgtatatatgtatgtatatatg

SEQ ID NO: 201119 - DNA, 20 bp, Mus musculus
gtatttttgcatgtatgtgg

SEQ ID NO: 201120 - DNA, 23 bp, Mus musculus
ctgtagttggctgaagatgcctt

SEQ ID NO: 201121 - DNA, 23 bp, Mus musculus
aagacacttagctcacagtctgt

SEQ ID NO: 201122 - DNA, 23 bp, Mus musculus
agacaagtaatagctgtctattt

SEQ ID NO: 201123 - DNA, 19 bp, Mus musculus
tagttctgtgtgatatttt

SEQ ID NO: 201124 - DNA, 22 bp, Mus musculus
tgttttgtgaccaattatatgg

SEQ ID NO: 201125 - DNA, 20 bp, Mus musculus
tgctctgtgcttctgcactg

SEQ ID NO: 201126 - DNA, 23 bp, Mus musculus
gtgtgtgtgtctgtaatatatgt

SEQ ID NO: 201127 - DNA, 23 bp, Mus musculus
tgtgtttgtgtttaatgcataat

SEQ ID NO: 201128 - DNA, 23 bp, Mus musculus
tgtatatgtatatgtatatgtat

SEQ ID NO: 201129 - DNA, 22 bp, Mus musculus
tgtgtctctgtttagtttctgt

SEQ ID NO: 201130 - DNA, 19 bp, Mus musculus
actcctcagagtccagctt

SEQ ID NO: 201131 - DNA, 22 bp, Mus musculus
catgtgtagtgtatgtgttctt

SEQ ID NO: 201132 - DNA, 23 bp, Mus musculus
tatatgtatgtgtatagggatga

SEQ ID NO: 201133 - DNA, 23 bp, Mus musculus
atgtatgtgtgtatgtgcatgtg

SEQ ID NO: 201134 - DNA, 22 bp, Mus musculus
ttcagtcttgatttaggctttg

SEQ ID NO: 201135 - DNA, 21 bp, Mus musculus
aggttctagaaagcttttagt

SEQ ID NO: 201136 - DNA, 23 bp, Mus musculus
tgagtgtgcatgtgcatgtgtgt

SEQ ID NO: 201137 - DNA, 23 bp, Mus musculus
ataacactgagtctctaaaggcc

SEQ ID NO: 201138 - DNA, 22 bp, Mus musculus
cactgtgcctctgagcctcagt

SEQ ID NO: 201139 - DNA, 21 bp, Mus musculus
gtggggtctctgtggctctct

SEQ ID NO: 201140 - DNA, 23 bp, Mus musculus
accgtgggtctgtctgactctga

SEQ ID NO: 201141 - DNA, 22 bp, Mus musculus
gtagacctgcacctcgatgatg

SEQ ID NO: 201142 - DNA, 23 bp, Mus musculus
cacactcaggctgcctcactcca

SEQ ID NO: 201143 - DNA, 23 bp, Mus musculus
gtctcactctgtcaccctggctg

SEQ ID NO: 201144 - DNA, 23 bp, Mus musculus
acgacctgtgtctgtctgtctgt

SEQ ID NO: 201145 - DNA, 23 bp, Mus musculus
ctttgttactcactgtgtctgtg

SEQ ID NO: 201146 - DNA, 23 bp, Mus musculus
tgtttgtctgtctgactctcagc

SEQ ID NO: 201147 - DNA, 18 bp, Mus musculus
gtctgaatgaaatgagcg

SEQ ID NO: 201148 - DNA, 20 bp, Mus musculus
acagaggagactgagcacac

SEQ ID NO: 201149 - DNA, 23 bp, Mus musculus
tgtctatctctgaagtgtatgtg

SEQ ID NO: 201150 - DNA, 23 bp, Mus musculus
aaagcactgactgctcttccaga

SEQ ID NO: 201151 - DNA, 20 bp, Mus musculus
gcttgtatgtgtacacatct

SEQ ID NO: 201152 - DNA, 23 bp, Mus musculus
tgtcactctgtgtgtgtgtgtgc

SEQ ID NO: 201153 - DNA, 20 bp, Mus musculus
gcttgtatgtgtacacatct

SEQ ID NO: 201154 - DNA, 23 bp, Mus musculus
tgtcactctgtgtgtgtgtgtgc

SEQ ID NO: 201155 - DNA, 20 bp, Mus musculus
ctggctcactcactggctct

SEQ ID NO: 201156 - DNA, 20 bp, Mus musculus
agagatcatgagttcaaatc

SEQ ID NO: 201157 - DNA, 23 bp, Mus musculus
gtccatgtatgtatatatgtatg

SEQ ID NO: 201158 - DNA, 23 bp, Mus musculus
tatatccatgtatatatatccat

SEQ ID NO: 201159 - DNA, 23 bp, Mus musculus
atgtatgtatgcatgtatgtatg

SEQ ID NO: 201160 - DNA, 23 bp, Mus musculus
aatccatgtatatatgtatgaat

SEQ ID NO: 201161 - DNA, 21 bp, Mus musculus
atgtatgtttgctatacttgg

SEQ ID NO: 201162 - DNA, 22 bp, Mus musculus
atatatgtatatgtatatgtat

SEQ ID NO: 201163 - DNA, 23 bp, Mus musculus
ctctttctacattctggtagctg

SEQ ID NO: 201164 - DNA, 21 bp, Mus musculus
ttgacagatgacagccagcag

SEQ ID NO: 201165 - DNA, 22 bp, Mus musculus
acactcagtcagtgttttttct

SEQ ID NO: 201166 - DNA, 23 bp, Mus musculus
cactgagtgctcttccagaggtc

SEQ ID NO: 201167 - DNA, 23 bp, Mus musculus
agtgtcctgctctgtcactctgt

SEQ ID NO: 201168 - DNA, 23 bp, Mus musculus
ctatcatctatctatctgtctgt

SEQ ID NO: 201169 - DNA, 23 bp, Mus musculus
tgtctcactgtctttgtggctct

SEQ ID NO: 201170 - DNA, 23 bp, Mus musculus
acttctgaccctctgtctgaccc

SEQ ID NO: 201171 - DNA, 23 bp, Mus musculus
agccaggctcagtggctctctct

SEQ ID NO: 201172 - DNA, 19 bp, Mus musculus
gtgtgtatgtgtgtgtgct

SEQ ID NO: 201173 - DNA, 20 bp, Mus musculus
tgtatgcatgcatatgtgct

SEQ ID NO: 201174 - DNA, 21 bp, Mus musculus
atatgtgcatatgtatatgta

SEQ ID NO: 201175 - DNA, 19 bp, Mus musculus
tgtgtatatgtatgcatat

SEQ ID NO: 201176 - DNA, 23 bp, Mus musculus
tgtctctcactgttgctgtggta

SEQ ID NO: 201177 - DNA, 23 bp, Mus musculus
tgcatgtgtgtatctctgtgtgt

SEQ ID NO: 201178 - DNA, 22 bp, Mus musculus
tggtatgtatagaacttagaac

SEQ ID NO: 201179 - DNA, 18 bp, Mus musculus
tcatttcctacatgtaag

SEQ ID NO: 201180 - DNA, 23 bp, Mus musculus
tctctccgactctctgtggctgg

SEQ ID NO: 201181 - DNA, 23 bp, Mus musculus
tctctgcctgtctggcactgggt

SEQ ID NO: 201182 - DNA, 23 bp, Mus musculus
ctcacactctcagtcttgcatga

SEQ ID NO: 201183 - DNA, 23 bp, Mus musculus
aaacagtgagcacagatgctatc

SEQ ID NO: 201184 - DNA, 23 bp, Mus musculus
tcttgctcagagactctagagtc

SEQ ID NO: 201185 - DNA, 21 bp, Mus musculus
tctctgtctgtctgtctgact

SEQ ID NO: 201186 - DNA, 19 bp, Mus musculus
gtgtgtgtgtgtgtgtgtg

SEQ ID NO: 201187 - DNA, 23 bp, Mus musculus
acatgtgtgtttgtaaatgtgtg

SEQ ID NO: 201188 - DNA, 23 bp, Mus musculus
tgccaggctgcctgtctccctcg

SEQ ID NO: 201189 - DNA, 22 bp, Mus musculus
agcatgtgtgcttgtgtgtaca

SEQ ID NO: 201190 - DNA, 23 bp, Mus musculus
tctcacacacacttgctcgttga

SEQ ID NO: 201191 - DNA, 23 bp, Mus musculus
gtgactcagtcactgttttccca

SEQ ID NO: 201192 - DNA, 23 bp, Mus musculus
tctctctctgtgtgtgtgtatct

SEQ ID NO: 201193 - DNA, 23 bp, Mus musculus
agactctgttcctgtctctctct

SEQ ID NO: 201194 - DNA, 23 bp, Mus musculus
tttgcagtgacaggaaacagatt

SEQ ID NO: 201195 - DNA, 23 bp, Mus musculus
ttgtgtgtgtgcatttggttgtg

SEQ ID NO: 201196 - DNA, 23 bp, Mus musculus
agagctactgaaatacttccgat

SEQ ID NO: 201197 - DNA, 22 bp, Mus musculus
gtatgaatttgtatatgtatgt

SEQ ID NO: 201198 - DNA, 19 bp, Mus musculus
tatgcatgtatgtacatgt

SEQ ID NO: 201199 - DNA, 23 bp, Mus musculus
tgcatatgtgtatgtatatacat

SEQ ID NO: 201200 - DNA, 22 bp, Mus musculus
atatatacatatgtatacatgt

SEQ ID NO: 201201 - DNA, 21 bp, Mus musculus
ttgcatgaacattgtggtgag

SEQ ID NO: 201202 - DNA, 20 bp, Mus musculus
tgcctgagagcggaacatga

SEQ ID NO: 201203 - DNA, 23 bp, Mus musculus
tgtgtgtgaatttgtatatgtgt

SEQ ID NO: 201204 - DNA, 20 bp, Mus musculus
tgtgttcatgtgcatgcatg

SEQ ID NO: 201205 - DNA, 21 bp, Mus musculus
gtgtgtgtgtgtgcatgtgca

SEQ ID NO: 201206 - DNA, 23 bp, Mus musculus
tgagtgtgtgtgtgcatgtgcat

SEQ ID NO: 201207 - DNA, 23 bp, Mus musculus
gtatgtgtgtgtgcatgtgcatg

SEQ ID NO: 201208 - DNA, 23 bp, Mus musculus
tgtgtatctgtgtgtgtgtgtgt

SEQ ID NO: 201209 - DNA, 23 bp, Mus musculus
ctgagtgtgtgtgtgcatgtgca

SEQ ID NO: 201210 - DNA, 23 bp, Mus musculus
tgtgtatctgtgtgtgtgtgtgt

SEQ ID NO: 201211 - DNA, 23 bp, Mus musculus
gagtgtgtgtgtgcatgtgcatg

SEQ ID NO: 201212 - DNA, 23 bp, Mus musculus
ttcagaagtagcagcagtcttca

SEQ ID NO: 201213 - DNA, 23 bp, Mus musculus
tattttagaagtagcaccagact

SEQ ID NO: 201214 - DNA, 22 bp, Mus musculus
tgttttgtgaccaattatatgg

SEQ ID NO: 201215 - DNA, 21 bp, Mus musculus
ctctcctgactctctctctct

SEQ ID NO: 201216 - DNA, 23 bp, Mus musculus
ttacagaagtttgtgagctgtca

SEQ ID NO: 201217 - DNA, 20 bp, Mus musculus
ctgtgtctgtctctcagcaa

SEQ ID NO: 201218 - DNA, 23 bp, Mus musculus
gggtgtctgtgtgcctgtgttca

SEQ ID NO: 201219 - DNA, 23 bp, Mus musculus
cctgtctctctctgtttcttgac

SEQ ID NO: 201220 - DNA, 21 bp, Mus musculus
gtatgcatgtatgtatgtatg

SEQ ID NO: 201221 - DNA, 23 bp, Mus musculus
tctgtgtgtgcatgtgcttgtga

SEQ ID NO: 201222 - DNA, 23 bp, Mus musculus
tgtatgtaagtatgcatatgtat

SEQ ID NO: 201223 - DNA, 18 bp, Mus musculus
tatacaaaactatacata

SEQ ID NO: 201224 - DNA, 23 bp, Mus musculus
tgttttgtgacctattatatggt

SEQ ID NO: 201225 - DNA, 19 bp, Mus musculus
tgggtggttgctttttcta

SEQ ID NO: 201226 - DNA, 22 bp, Mus musculus
atgtatgtatgcacatgcatgg

SEQ ID NO: 201227 - DNA, 23 bp, Mus musculus
agcatgcctgcctgcctgcctgc

SEQ ID NO: 201228 - DNA, 22 bp, Mus musculus
tggcagagatcagcatgtgagg

SEQ ID NO: 201229 - DNA, 23 bp, Mus musculus
taaaatgaagactgaggctctga

SEQ ID NO: 201230 - DNA, 23 bp, Mus musculus
cagggctctctctctctcatttt

SEQ ID NO: 201231 - DNA, 23 bp, Mus musculus
tataaatgcatatatgtgtgtgt

SEQ ID NO: 201232 - DNA, 23 bp, Mus musculus
tgatgtctttacaacttcttagt

SEQ ID NO: 201233 - DNA, 23 bp, Mus musculus
agaagagagtgaaatcactaact

SEQ ID NO: 201234 - DNA, 21 bp, Mus musculus
tccatgacttcagtagctcaa

SEQ ID NO: 201235 - DNA, 23 bp, Mus musculus
tgtctcagtcactgaattctggg

SEQ ID NO: 201236 - DNA, 23 bp, Mus musculus
taaagtgcaatttgaattctaag

SEQ ID NO: 201237 - DNA, 23 bp, Mus musculus
tgtctgtctgtctgtctgtctat

SEQ ID NO: 201238 - DNA, 22 bp, Mus musculus
tagcaatgaaatgattctgtgg

SEQ ID NO: 201239 - DNA, 23 bp, Mus musculus
tgccactcgctctcttgagttgg

SEQ ID NO: 201240 - DNA, 23 bp, Mus musculus
gtctctctgacactgggactcct

SEQ ID NO: 201241 - DNA, 18 bp, Mus musculus
tgactgatcagagagggc

SEQ ID NO: 201242 - DNA, 23 bp, Mus musculus
cagttctagcaagagactgagct

SEQ ID NO: 201243 - DNA, 18 bp, Mus musculus
atgtgtgtatgtatatgt

SEQ ID NO: 201244 - DNA, 23 bp, Mus musculus
tgtgtgtctctctttctaaatcc

SEQ ID NO: 201245 - DNA, 23 bp, Mus musculus
tgtgtgctctgagagcacagaga

SEQ ID NO: 201246 - DNA, 23 bp, Mus musculus
cacagcctctctgtctgttgtta

SEQ ID NO: 201247 - DNA, 23 bp, Mus musculus
tattgttattgtgttggagaggc

SEQ ID NO: 201248 - DNA, 21 bp, Mus musculus
ttctgacagatgggtgtgtgg

SEQ ID NO: 201249 - DNA, 19 bp, Mus musculus
agacctggtgtcaccgtgt

SEQ ID NO: 201250 - DNA, 23 bp, Mus musculus
tctgatgtctgtctctctgtctg

SEQ ID NO: 201251 - DNA, 22 bp, Mus musculus
agacagcacagagtgacctgac

SEQ ID NO: 201252 - DNA, 23 bp, Mus musculus
gtctcactgagtctctgccacac

SEQ ID NO: 201253 - DNA, 21 bp, Mus musculus
taaagtgaactgtgagagctc

SEQ ID NO: 201254 - DNA, 22 bp, Mus musculus
ttcaagtaatccaggataggct

SEQ ID NO: 201255 - DNA, 22 bp, Mus musculus
gctctctctctctctcagcgtg

SEQ ID NO: 201256 - DNA, 20 bp, Mus musculus
atcatctggggctggagaga

SEQ ID NO: 201257 - DNA, 23 bp, Mus musculus
agctcagtgtagaatgtgtgctg

SEQ ID NO: 201258 - DNA, 22 bp, Mus musculus
atgtctgtctttatcactctcc

SEQ ID NO: 201259 - DNA, 18 bp, Mus musculus
aggcatgatgaaggccca

SEQ ID NO: 201260 - DNA, 22 bp, Mus musculus
tctctctgcctctgtatcagcc

SEQ ID NO: 201261 - DNA, 20 bp, Mus musculus
tgaggctgtggctctttcca

SEQ ID NO: 201262 - DNA, 23 bp, Mus musculus
tctgtctctgcctcactagagct

SEQ ID NO: 201263 - DNA, 23 bp, Mus musculus
taactggctggagagtggctcag

SEQ ID NO: 201264 - DNA, 23 bp, Mus musculus
ttatgtgcatgtgggtttgtgtg

SEQ ID NO: 201265 - DNA, 23 bp, Mus musculus
gctggatctgactgtctctgtcc

SEQ ID NO: 201266 - DNA, 23 bp, Mus musculus
cactgattgaaatctgatggctg

SEQ ID NO: 201267 - DNA, 22 bp, Mus musculus
gaaagtgctctctgtgctccgt

SEQ ID NO: 201268 - DNA, 23 bp, Mus musculus
cttgagtctcagtcagtcttttg

SEQ ID NO: 201269 - DNA, 23 bp, Mus musculus
cacgctcacacacagtcatcctt

SEQ ID NO: 201270 - DNA, 23 bp, Mus musculus
gtctgtctgtctgtctgtctgtc

SEQ ID NO: 201271 - DNA, 21 bp, Mus musculus
aggaggtccagaacgtgctga

SEQ ID NO: 201272 - DNA, 23 bp, Mus musculus
acagtgtctctctgtgtagttcg

SEQ ID NO: 201273 - DNA, 19 bp, Mus musculus
acacacacatatgtatgta

SEQ ID NO: 201274 - DNA, 23 bp, Mus musculus
tgtgcatacacatgcatatgtga

SEQ ID NO: 201275 - DNA, 22 bp, Mus musculus
ctcagtctcacagtatacaccc

SEQ ID NO: 201276 - DNA, 23 bp, Mus musculus
tgtctgtctgtctgtctgtccgt

SEQ ID NO: 201277 - DNA, 21 bp, Mus musculus
aaagtcagggagctttgaggt

SEQ ID NO: 201278 - DNA, 23 bp, Mus musculus
agatgtgaaggagatgcaagaga

SEQ ID NO: 201279 - DNA, 21 bp, Mus musculus
tctgtggcctttgcctgtcac

SEQ ID NO: 201280 - DNA, 19 bp, Mus musculus
gtgagtgaaagtagagtac

SEQ ID NO: 201281 - DNA, 21 bp, Mus musculus
actgagctgagggtgcacaca

SEQ ID NO: 201282 - DNA, 19 bp, Mus musculus
actgagctgagggtgcaca

SEQ ID NO: 201283 - DNA, 18 bp, Mus musculus
actgagctgagggtgcac

SEQ ID NO: 201284 - DNA, 23 bp, Mus musculus
acacactgagctgagggtgcaca

SEQ ID NO: 201285 - DNA, 19 bp, Mus musculus
actgagctgagggtgcaca

SEQ ID NO: 201286 - DNA, 19 bp, Mus musculus
actgagctgagggtgcaca

SEQ ID NO: 201287 - DNA, 19 bp, Mus musculus
actgagctgagggtgcaca

SEQ ID NO: 201288 - DNA, 18 bp, Mus musculus
actgagctgagggtgcac

SEQ ID NO: 201289 - DNA, 18 bp, Mus musculus
actgagctgagggtgcac

SEQ ID NO: 201290 - DNA, 19 bp, Mus musculus
cactgagctgagggtgcac

SEQ ID NO: 201291 - DNA, 21 bp, Mus musculus
gagcactgactctcttcaagg

SEQ ID NO: 201292 - DNA, 23 bp, Mus musculus
gtgtgtgtgtggttctgcatccc

SEQ ID NO: 201293 - DNA, 20 bp, Mus musculus
gcttggctgccaccctctgt

SEQ ID NO: 201294 - DNA, 23 bp, Mus musculus
actctctcagtgagtcatacttc

SEQ ID NO: 201295 - DNA, 23 bp, Mus musculus
agagagacattctggttggctgg

SEQ ID NO: 201296 - DNA, 23 bp, Mus musculus
gtatatatgcatgtatgtgtata

SEQ ID NO: 201297 - DNA, 23 bp, Mus musculus
tctgtctctgtctctgtatttgg

SEQ ID NO: 201298 - DNA, 20 bp, Mus musculus
tactgactgctcttccagag

SEQ ID NO: 201299 - DNA, 21 bp, Mus musculus
tctgagaactaacagtgctca

SEQ ID NO: 201300 - DNA, 23 bp, Mus musculus
ttctttggatgacttctcatttt

SEQ ID NO: 201301 - DNA, 19 bp, Mus musculus
tctatctatctatctatct

SEQ ID NO: 201302 - DNA, 23 bp, Mus musculus
tgtgcatgtgtgtgtctgtgtgc

SEQ ID NO: 201303 - DNA, 23 bp, Mus musculus
tctgtgtctatatctgtgtttgt

SEQ ID NO: 201304 - DNA, 23 bp, Mus musculus
tgtctgtctgtctgctctagtag

SEQ ID NO: 201305 - DNA, 18 bp, Mus musculus
aagcagacccacttaaca

SEQ ID NO: 201306 - DNA, 23 bp, Mus musculus
ttcttgagaaagatgtctgatag

SEQ ID NO: 201307 - DNA, 20 bp, Mus musculus
atgagaactgtcagtcctgt

SEQ ID NO: 201308 - DNA, 23 bp, Mus musculus
agtctctctgtgtaacattttac

SEQ ID NO: 201309 - DNA, 23 bp, Mus musculus
tagagtctgattgttctataggg

SEQ ID NO: 201310 - DNA, 22 bp, Mus musculus
ccagctttgggtctccctcact

SEQ ID NO: 201311 - DNA, 21 bp, Mus musculus
tttgtttactgaggtacggtt

SEQ ID NO: 201312 - DNA, 23 bp, Mus musculus
gtcaggctgcctgtctgccttgc

SEQ ID NO: 201313 - DNA, 19 bp, Mus musculus
cactgatcacactgtgcag

SEQ ID NO: 201314 - DNA, 23 bp, Mus musculus
tgtccatctgtctgtctgagaca

SEQ ID NO: 201315 - DNA, 23 bp, Mus musculus
agtttgaaaagtgattttggaga

SEQ ID NO: 201316 - DNA, 23 bp, Mus musculus
aagagcactgactgctcttccag

SEQ ID NO: 201317 - DNA, 23 bp, Mus musculus
tgacacgctcagagtcttgcttc

SEQ ID NO: 201318 - DNA, 23 bp, Mus musculus
tagtgcatggtgatctgatagga

SEQ ID NO: 201319 - DNA, 23 bp, Mus musculus
tctctcactcagtgctatggccc

SEQ ID NO: 201320 - DNA, 23 bp, Mus musculus
tcccactctgtatctaacttgta

SEQ ID NO: 201321 - DNA, 21 bp, Mus musculus
tctctgatagtcactgtctgt

SEQ ID NO: 201322 - DNA, 21 bp, Mus musculus
tctctgatagtcactgtctgt

SEQ ID NO: 201323 - DNA, 23 bp, Mus musculus
atatgtatgtatgtatatatgta

SEQ ID NO: 201324 - DNA, 18 bp, Mus musculus
cacacgtgtactgacaca

SEQ ID NO: 201325 - DNA, 22 bp, Mus musculus
tcagtctctctgtgtcttcgta

SEQ ID NO: 201326 - DNA, 23 bp, Mus musculus
tctctacttctggggaaaggaga

SEQ ID NO: 201327 - DNA, 23 bp, Mus musculus
agtgagaagacactgagtaaggt

SEQ ID NO: 201328 - DNA, 22 bp, Mus musculus
tactcctttttgatcacttcca

SEQ ID NO: 201329 - DNA, 23 bp, Mus musculus
tctttccagtccctggtatagta

SEQ ID NO: 201330 - DNA, 23 bp, Mus musculus
gcaatacattctatatttgatac

SEQ ID NO: 201331 - DNA, 23 bp, Mus musculus
atgtatctctgcatgtgctttcc

SEQ ID NO: 201332 - DNA, 23 bp, Mus musculus
agtttctccatcaggatctggat

SEQ ID NO: 201333 - DNA, 23 bp, Mus musculus
tttcttggtctcagtctctccat

SEQ ID NO: 201334 - DNA, 21 bp, Mus musculus
atctgtgtctctttatctctg

SEQ ID NO: 201335 - DNA, 23 bp, Mus musculus
gatctgtatgtgttgttgctgct

SEQ ID NO: 201336 - DNA, 22 bp, Mus musculus
tgttttgtgaccaattatatgg

SEQ ID NO: 201337 - DNA, 22 bp, Mus musculus
acagcttgttcaggctggagag

SEQ ID NO: 201338 - DNA, 20 bp, Mus musculus
tcactgacagctttcatgag

SEQ ID NO: 201339 - DNA, 23 bp, Mus musculus
cactgagtcttgtgagtttgatc

SEQ ID NO: 201340 - DNA, 23 bp, Mus musculus
tgtctctgtctgtgtgcctgttt

SEQ ID NO: 201341 - DNA, 23 bp, Mus musculus
gctagaaggaggtgagttggtgt

SEQ ID NO: 201342 - DNA, 19 bp, Mus musculus
agtagcaagttttgtttag

SEQ ID NO: 201343 - DNA, 23 bp, Mus musculus
gctagaaggaggtgagttggtgt

SEQ ID NO: 201344 - DNA, 19 bp, Mus musculus
agtagcaagttttgtttag

SEQ ID NO: 201345 - DNA, 22 bp, Mus musculus
ttaggagtgattttcaagtgtc

SEQ ID NO: 201346 - DNA, 23 bp, Mus musculus
ctctgtgcctcagtctctgcatc

SEQ ID NO: 201347 - DNA, 18 bp, Mus musculus
acagctgggacacagagg

SEQ ID NO: 201348 - DNA, 22 bp, Mus musculus
gggactgtctctgactctgggt

SEQ ID NO: 201349 - DNA, 18 bp, Mus musculus
cgtgtctctctctgtgtc

SEQ ID NO: 201350 - DNA, 21 bp, Mus musculus
tgtccctggctcagtcccggt

SEQ ID NO: 201351 - DNA, 23 bp, Mus musculus
cactcactgtgtgtgtgtgtgca

SEQ ID NO: 201352 - DNA, 22 bp, Mus musculus
agccagagatgtgtttttcatg

SEQ ID NO: 201353 - DNA, 23 bp, Mus musculus
tcaaaggagagaagtgtggctcg

SEQ ID NO: 201354 - DNA, 23 bp, Mus musculus
agtcacagtatagtgtcaggact

SEQ ID NO: 201355 - DNA, 22 bp, Mus musculus
ctcaggctctgaatctgctttc

SEQ ID NO: 201356 - DNA, 23 bp, Mus musculus
gtgcctctctgtctgtctcacag

SEQ ID NO: 201357 - DNA, 23 bp, Mus musculus
tgtaatgctccttcagtgagctg

SEQ ID NO: 201358 - DNA, 23 bp, Mus musculus
tctgtatctctctgtctctctct

SEQ ID NO: 201359 - DNA, 23 bp, Mus musculus
gagtgactgtggctgactattgc

SEQ ID NO: 201360 - DNA, 23 bp, Mus musculus
atatgtgtttgtatatgtgtgag

SEQ ID NO: 201361 - DNA, 23 bp, Mus musculus
gtgggtgtctctcaggctctgtt

SEQ ID NO: 201362 - DNA, 19 bp, Mus musculus
gtatgcgtgcatgtgcatg

SEQ ID NO: 201363 - DNA, 23 bp, Mus musculus
gaagtgggtctgttgtttagagc

SEQ ID NO: 201364 - DNA, 21 bp, Mus musculus
tctctctgggtgcctttagct

SEQ ID NO: 201365 - DNA, 20 bp, Mus musculus
aactcagctgcaaattgttt

SEQ ID NO: 201366 - DNA, 23 bp, Mus musculus
tgcaggacctgtttcctgtttcc

SEQ ID NO: 201367 - DNA, 18 bp, Mus musculus
tattttcagtaagacatg

SEQ ID NO: 201368 - DNA, 19 bp, Mus musculus
ctgtgtgtatgtagtgtgt

SEQ ID NO: 201369 - DNA, 23 bp, Mus musculus
tgagatcctgtgtgatgttcact

SEQ ID NO: 201370 - DNA, 23 bp, Mus musculus
ctgtcccactctctgacttgtga

SEQ ID NO: 201371 - DNA, 23 bp, Mus musculus
ttcagactagatcccttattggt

SEQ ID NO: 201372 - DNA, 23 bp, Mus musculus
tgtctgtctgtctgtctgttctt

SEQ ID NO: 201373 - DNA, 19 bp, Mus musculus
tgagaacctggaggaggca

SEQ ID NO: 201374 - DNA, 23 bp, Mus musculus
atgtgtgtgtaaatatatgtgtg

SEQ ID NO: 201375 - DNA, 23 bp, Mus musculus
tatgtgtatatatatgtgtgtgt

SEQ ID NO: 201376 - DNA, 22 bp, Mus musculus
atatgtgtgtaaatatatgtgt

SEQ ID NO: 201377 - DNA, 22 bp, Mus musculus
tatgtgtatatatatgtgtgtg

SEQ ID NO: 201378 - DNA, 22 bp, Mus musculus
atatgtgtgtaaatatatgtgt

SEQ ID NO: 201379 - DNA, 20 bp, Mus musculus
tgtgtatatatatgtgtgtg

SEQ ID NO: 201380 - DNA, 22 bp, Mus musculus
tatgtgtatatatatgtgtgtg

SEQ ID NO: 201381 - DNA, 21 bp, Mus musculus
atatatgtgtgtaaatatatg

SEQ ID NO: 201382 - DNA, 23 bp, Mus musculus
ctggcctctctctgtctctcttg

SEQ ID NO: 201383 - DNA, 23 bp, Mus musculus
tttgtgtcaggctgagatcaagc

SEQ ID NO: 201384 - DNA, 20 bp, Mus musculus
tgtggctctcatgggttcag

SEQ ID NO: 201385 - DNA, 23 bp, Mus musculus
tattcctgcgtgtgtgtgtgtgt

SEQ ID NO: 201386 - DNA, 21 bp, Mus musculus
agagagacagagaagttggcc

SEQ ID NO: 201387 - DNA, 22 bp, Mus musculus
tgactctctctttctgactctg

SEQ ID NO: 201388 - DNA, 23 bp, Mus musculus
ctccctgtgagtgtctgtgcctc

SEQ ID NO: 201389 - DNA, 18 bp, Mus musculus
ctctcactctgggaccca

SEQ ID NO: 201390 - DNA, 23 bp, Mus musculus
tctgtgtacctctctgtgtgtat

SEQ ID NO: 201391 - DNA, 23 bp, Mus musculus
acatggtggctcacaattatctg

SEQ ID NO: 201392 - DNA, 19 bp, Mus musculus
acacactgatgccaggtgc

SEQ ID NO: 201393 - DNA, 22 bp, Mus musculus
tctgatgtggctgctggcttca

SEQ ID NO: 201394 - DNA, 23 bp, Mus musculus
tcagcacgtcctggaatgagatg

SEQ ID NO: 201395 - DNA, 23 bp, Mus musculus
cttgtctgtgtgtctgtgtgcca

SEQ ID NO: 201396 - DNA, 23 bp, Mus musculus
atgtaagtacactgtagctgtct

SEQ ID NO: 201397 - DNA, 23 bp, Mus musculus
tgtgtgtgtctctgtgtgattac

SEQ ID NO: 201398 - DNA, 20 bp, Mus musculus
agtgtgtggctatcctgtgt

SEQ ID NO: 201399 - DNA, 23 bp, Mus musculus
atgtatgtatgtatatgtgtgta

SEQ ID NO: 201400 - DNA, 23 bp, Mus musculus
ctgagtctgtctgtctgtctgtc

SEQ ID NO: 201401 - DNA, 23 bp, Mus musculus
tgcctgcctgcctggctctgtgc

SEQ ID NO: 201402 - DNA, 18 bp, Mus musculus
acagatgtgagagaacac

SEQ ID NO: 201403 - DNA, 23 bp, Mus musculus
tatagagtgtggtttagcaacag

SEQ ID NO: 201404 - DNA, 21 bp, Mus musculus
atatacacaggtgtgtaaagg

SEQ ID NO: 201405 - DNA, 23 bp, Mus musculus
gtgcctctgtgtgtgtgtgtgtg

SEQ ID NO: 201406 - DNA, 23 bp, Mus musculus
ggctgactctgtcactcatttgt

SEQ ID NO: 201407 - DNA, 23 bp, Mus musculus
ttgagctgtgagtcctggagctg

SEQ ID NO: 201408 - DNA, 18 bp, Mus musculus
accttctcctccagctca

SEQ ID NO: 201409 - DNA, 23 bp, Mus musculus
agtgaaaggctgaagagatggct

SEQ ID NO: 201410 - DNA, 23 bp, Mus musculus
atgtatgtatgtatgtatgtatg

SEQ ID NO: 201411 - DNA, 22 bp, Mus musculus
tgcatgcgtgcgtgagtgtgtg

SEQ ID NO: 201412 - DNA, 22 bp, Mus musculus
tgtcagagtctctgcctgcctc

SEQ ID NO: 201413 - DNA, 22 bp, Mus musculus
attgtgactgtcagtcttgatc

SEQ ID NO: 201414 - DNA, 23 bp, Mus musculus
gaatgaatgaatgagtgaaggag

SEQ ID NO: 201415 - DNA, 22 bp, Mus musculus
ctgctacacatttactatacag

SEQ ID NO: 201416 - DNA, 23 bp, Mus musculus
cattgtctctgtctctgtcccca

SEQ ID NO: 201417 - DNA, 23 bp, Mus musculus
tatctgtctgtctgcctgcctgt

SEQ ID NO: 201418 - DNA, 21 bp, Mus musculus
gtatgtatatatgtatgtatg

SEQ ID NO: 201419 - DNA, 23 bp, Mus musculus
acgtatgtatatatgtatgtatg

SEQ ID NO: 201420 - DNA, 21 bp, Mus musculus
actgtcagcatgttgtaatgt

SEQ ID NO: 201421 - DNA, 23 bp, Mus musculus
acacacaggctcactgccagcct

SEQ ID NO: 201422 - DNA, 22 bp, Mus musculus
acacagactcactgtcagcctg

SEQ ID NO: 201423 - DNA, 23 bp, Mus musculus
cacaggctcactgtcagcctgtt

SEQ ID NO: 201424 - DNA, 23 bp, Mus musculus
acacacaggctctctgccagcct

SEQ ID NO: 201425 - DNA, 18 bp, Mus musculus
atgtgtgtaataggtgat

SEQ ID NO: 201426 - DNA, 22 bp, Mus musculus
ttcaagttcatcaggtgcttag

SEQ ID NO: 201427 - DNA, 22 bp, Mus musculus
atgtatgtatgtatgtatgtgt

SEQ ID NO: 201428 - DNA, 22 bp, Mus musculus
tcattcctgccttggctgtgag

SEQ ID NO: 201429 - DNA, 21 bp, Mus musculus
tgagaattgtaatacttgggt

SEQ ID NO: 201430 - DNA, 23 bp, Mus musculus
cttgtcattctgtgtttctgtct

SEQ ID NO: 201431 - DNA, 23 bp, Mus musculus
tgtatgtatgtatttatgtatgg

SEQ ID NO: 201432 - DNA, 22 bp, Mus musculus
atgaatatatgcatgtatgtgt

SEQ ID NO: 201433 - DNA, 23 bp, Mus musculus
atgtgtgtctttatgtttgtgca

SEQ ID NO: 201434 - DNA, 22 bp, Mus musculus
acacacactgtatatatacaca

SEQ ID NO: 201435 - DNA, 23 bp, Mus musculus
tctcattgttagtctctctgact

SEQ ID NO: 201436 - DNA, 23 bp, Mus musculus
tgtcagaagagagtgacctgata

SEQ ID NO: 201437 - DNA, 19 bp, Mus musculus
actgaagattgtgcagcct

SEQ ID NO: 201438 - DNA, 23 bp, Mus musculus
tctgtctgtctgtctgtctgtca

SEQ ID NO: 201439 - DNA, 20 bp, Mus musculus
tgtcactgtgccaaacatgt

SEQ ID NO: 201440 - DNA, 20 bp, Mus musculus
tctgagcaggcttctttctc

SEQ ID NO: 201441 - DNA, 23 bp, Mus musculus
tatgtatgtatgtatgtatgtgt

SEQ ID NO: 201442 - DNA, 22 bp, Mus musculus
tttggctatagtatatcacttt

SEQ ID NO: 201443 - DNA, 19 bp, Mus musculus
tgtggtgattttttcttat

SEQ ID NO: 201444 - DNA, 22 bp, Mus musculus
acacacacatgtgtacgtgtgt

SEQ ID NO: 201445 - DNA, 23 bp, Mus musculus
ttgtgtgtgtgtatctgtgtgca

SEQ ID NO: 201446 - DNA, 23 bp, Mus musculus
atctgtgtatatgtgtatgtgtg

SEQ ID NO: 201447 - DNA, 23 bp, Mus musculus
tatatatcatatagtatatgtat

SEQ ID NO: 201448 - DNA, 19 bp, Mus musculus
agccaatgatgtaagcaag

SEQ ID NO: 201449 - DNA, 23 bp, Mus musculus
tccctccctgagtcagtggctga

SEQ ID NO: 201450 - DNA, 22 bp, Mus musculus
taatatctagattatgtgatgt

SEQ ID NO: 201451 - DNA, 23 bp, Mus musculus
tcagtctttgtctgtcactgagg

SEQ ID NO: 201452 - DNA, 23 bp, Mus musculus
tgtttgtttttcctgaagccttg

SEQ ID NO: 201453 - DNA, 20 bp, Mus musculus
tggcctccttatctactgtt

SEQ ID NO: 201454 - DNA, 23 bp, Mus musculus
actgtctcactctctgtgactcc

SEQ ID NO: 201455 - DNA, 23 bp, Mus musculus
tctggggctgaaaagatggctta

SEQ ID NO: 201456 - DNA, 23 bp, Mus musculus
tgagagcactgactgctctttca

SEQ ID NO: 201457 - DNA, 23 bp, Mus musculus
aagttactgtgctaaagaattgc

SEQ ID NO: 201458 - DNA, 20 bp, Mus musculus
ctgaaactcattctgtagac

SEQ ID NO: 201459 - DNA, 20 bp, Mus musculus
atctgtctgtttctgtctcc

SEQ ID NO: 201460 - DNA, 23 bp, Mus musculus
tctctcactctcaaatttcagat

SEQ ID NO: 201461 - DNA, 22 bp, Mus musculus
atgagtggataggcttgtgaac

SEQ ID NO: 201462 - DNA, 22 bp, Mus musculus
ttcactcagtctgtcatattcc

SEQ ID NO: 201463 - DNA, 18 bp, Mus musculus
agcttccagtatccatct

SEQ ID NO: 201464 - DNA, 19 bp, Mus musculus
tcaggacccagactctgtc

SEQ ID NO: 201465 - DNA, 23 bp, Mus musculus
tgtatgcatgcatgcatgtgtat

SEQ ID NO: 201466 - DNA, 23 bp, Mus musculus
aagcaggctgagcaagctgtgag

SEQ ID NO: 201467 - DNA, 23 bp, Mus musculus
attctgcctgtgttcctgcttca

SEQ ID NO: 201468 - DNA, 23 bp, Mus musculus
ttagaactcagccagcagacagg

SEQ ID NO: 201469 - DNA, 23 bp, Mus musculus
tcaggcactgtctgtctgcatac

SEQ ID NO: 201470 - DNA, 23 bp, Mus musculus
acctagagagtctgttctgttgc

SEQ ID NO: 201471 - DNA, 21 bp, Mus musculus
cgagtgtgtgcatgtgtgtgc

SEQ ID NO: 201472 - DNA, 23 bp, Mus musculus
tggctctgaggttaagagcactg

SEQ ID NO: 201473 - DNA, 23 bp, Mus musculus
ccagtgtatatatacatgtgtgt

SEQ ID NO: 201474 - DNA, 18 bp, Mus musculus
agccacactactcagatg

SEQ ID NO: 201475 - DNA, 21 bp, Mus musculus
atgtatgtatgtgtgcatgtg

SEQ ID NO: 201476 - DNA, 23 bp, Mus musculus
agagatctgtctgtgtctgcctc

SEQ ID NO: 201477 - DNA, 23 bp, Mus musculus
gccagtgtttcttatggtagtgg

SEQ ID NO: 201478 - DNA, 23 bp, Mus musculus
ctgaagctgtctcactgactgtc

SEQ ID NO: 201479 - DNA, 23 bp, Mus musculus
caggattctgtctctgtctgtgc

SEQ ID NO: 201480 - DNA, 21 bp, Mus musculus
gacaggcctgaagcagcacag

SEQ ID NO: 201481 - DNA, 22 bp, Mus musculus
acaggcctgaagcagcatgact

SEQ ID NO: 201482 - DNA, 22 bp, Mus musculus
tatgtgtatatgtatgtgtgtg

SEQ ID NO: 201483 - DNA, 20 bp, Mus musculus
acagtcagtcactcactgcc

SEQ ID NO: 201484 - DNA, 23 bp, Mus musculus
actctgtctcaggaacaagtgac

SEQ ID NO: 201485 - DNA, 23 bp, Mus musculus
tatgtgtgtctgtgtgcctgtgt

SEQ ID NO: 201486 - DNA, 21 bp, Mus musculus
tatgtacattatatatctatg

SEQ ID NO: 201487 - DNA, 23 bp, Mus musculus
ctctgtctgtctctgtgtgtgca

SEQ ID NO: 201488 - DNA, 21 bp, Mus musculus
tcagagggagcctctctgttg

SEQ ID NO: 201489 - DNA, 23 bp, Mus musculus
atcagtgcatttgttgttatatt

SEQ ID NO: 201490 - DNA, 23 bp, Mus musculus
tgagatgacagcttctgcttgcc

SEQ ID NO: 201491 - DNA, 23 bp, Mus musculus
acatgtgtatatatatgtgtgtg

SEQ ID NO: 201492 - DNA, 23 bp, Mus musculus
ttctcagtgtggaatctagtctc

SEQ ID NO: 201493 - DNA, 23 bp, Mus musculus
ttattactttatgtatatgagtg

SEQ ID NO: 201494 - DNA, 23 bp, Mus musculus
cacacacatgagagagcacacac

SEQ ID NO: 201495 - DNA, 20 bp, Mus musculus
ggaagtagcagttggtggtg

SEQ ID NO: 201496 - DNA, 22 bp, Mus musculus
tgttttgtgaccaattatatgg

SEQ ID NO: 201497 - DNA, 21 bp, Mus musculus
catgtatgtatgtatgtatac

SEQ ID NO: 201498 - DNA, 22 bp, Mus musculus
attttacaaaggaaaggaaatg

SEQ ID NO: 201499 - DNA, 22 bp, Mus musculus
actcaggctctctgtgagagtc

SEQ ID NO: 201500 - DNA, 21 bp, Mus musculus
tgtataggtgcatgtgtgtgt

SEQ ID NO: 201501 - DNA, 23 bp, Mus musculus
tttgtgcatgtatatatgaatgt

SEQ ID NO: 201502 - DNA, 23 bp, Mus musculus
aggaatgtgtcaaaggtgtccct

SEQ ID NO: 201503 - DNA, 19 bp, Mus musculus
cactgcaatctcattggag

SEQ ID NO: 201504 - DNA, 23 bp, Mus musculus
atagacagctattacttgtctgt

SEQ ID NO: 201505 - DNA, 21 bp, Mus musculus
catagtgcatatggtggaggt

SEQ ID NO: 201506 - DNA, 23 bp, Mus musculus
cttcctctgtcagtgtctgtgcc

SEQ ID NO: 201507 - DNA, 23 bp, Mus musculus
tctcacagtgaaccggtctcttt

SEQ ID NO: 201508 - DNA, 23 bp, Mus musculus
tctctgtgtgtgtgtctgtgtat

SEQ ID NO: 201509 - DNA, 23 bp, Mus musculus
tcactagccagacagtctgtctc

SEQ ID NO: 201510 - DNA, 20 bp, Mus musculus
tgcatgtatgtatgtatgta

SEQ ID NO: 201511 - DNA, 23 bp, Mus musculus
agacacagtaagaactcaggaac

SEQ ID NO: 201512 - DNA, 21 bp, Mus musculus
cgtttccttgattctctctgt

SEQ ID NO: 201513 - DNA, 23 bp, Mus musculus
tctgtgtctgtgtgtctgtgtat

SEQ ID NO: 201514 - DNA, 23 bp, Mus musculus
gtatgtatgtatatttgtgtgta

SEQ ID NO: 201515 - DNA, 23 bp, Mus musculus
gtatgtatgtatgtatatgtgtg

SEQ ID NO: 201516 - DNA, 23 bp, Mus musculus
tctctctatctgagtctgtgggt

SEQ ID NO: 201517 - DNA, 23 bp, Mus musculus
tctctcagcctgtgtattctacc

SEQ ID NO: 201518 - DNA, 19 bp, Mus musculus
tgtgtgtatatatatatgc

SEQ ID NO: 201519 - DNA, 23 bp, Mus musculus
tctgtctgtctgtctgtctgtcg

SEQ ID NO: 201520 - DNA, 19 bp, Mus musculus
aatgttcttttaagggctg

SEQ ID NO: 201521 - DNA, 20 bp, Mus musculus
agtgagtgagcaaatcttca

SEQ ID NO: 201522 - DNA, 23 bp, Mus musculus
ctcattttgtctgtccttgaggt

SEQ ID NO: 201523 - DNA, 23 bp, Mus musculus
tctgactctgtctctgtcacctc

SEQ ID NO: 201524 - DNA, 19 bp, Mus musculus
gatgacaagagtgtcagca

SEQ ID NO: 201525 - DNA, 21 bp, Mus musculus
ggactctgactagagacctgg

SEQ ID NO: 201526 - DNA, 19 bp, Mus musculus
tgtcgggctggaaagatgg

SEQ ID NO: 201527 - DNA, 23 bp, Mus musculus
aggctctctctgtgtcccagtgt

SEQ ID NO: 201528 - DNA, 23 bp, Mus musculus
gacacactgtgcgatttgggtct

SEQ ID NO: 201529 - DNA, 23 bp, Mus musculus
tctcaggtatttctctgtgtgtg

SEQ ID NO: 201530 - DNA, 21 bp, Mus musculus
tgcatttaggtatgcgtccat

SEQ ID NO: 201531 - DNA, 23 bp, Mus musculus
agcgcctttggatatgagtggta

SEQ ID NO: 201532 - DNA, 21 bp, Mus musculus
ctctgagctgttgctcctgca

SEQ ID NO: 201533 - DNA, 23 bp, Mus musculus
tagagtgcctgagaaacaagctt

SEQ ID NO: 201534 - DNA, 23 bp, Mus musculus
catttcactgccattttgaagct

SEQ ID NO: 201535 - DNA, 23 bp, Mus musculus
ctgagtgtctgagtgagtgtgtg

SEQ ID NO: 201536 - DNA, 22 bp, Mus musculus
tgttactttgcaaagctgagaa

SEQ ID NO: 201537 - DNA, 21 bp, Mus musculus
ttgtagttttccaggtttgga

SEQ ID NO: 201538 - DNA, 22 bp, Mus musculus
gtgtgtgcctgactccctgcct

SEQ ID NO: 201539 - DNA, 21 bp, Mus musculus
gcatgtgtgtgtgtgtgtgtg

SEQ ID NO: 201540 - DNA, 23 bp, Mus musculus
tccctgactgactgactctctag

SEQ ID NO: 201541 - DNA, 22 bp, Mus musculus
atgactggagacccagcactca

SEQ ID NO: 201542 - DNA, 19 bp, Mus musculus
gtgaggcagtctgtggctc

SEQ ID NO: 201543 - DNA, 19 bp, Mus musculus
tcctctgtggggctggaga

SEQ ID NO: 201544 - DNA, 20 bp, Mus musculus
catctcactgactctcacca

SEQ ID NO: 201545 - DNA, 23 bp, Mus musculus
tgtcagtggctgagatctgcagg

SEQ ID NO: 201546 - DNA, 21 bp, Mus musculus
tgtctctgtgtatctgtactg

SEQ ID NO: 201547 - DNA, 23 bp, Mus musculus
gtctgtctgtctgtctgtctccc

SEQ ID NO: 201548 - DNA, 21 bp, Mus musculus
agcttggtctacaaggtgagt

SEQ ID NO: 201549 - DNA, 23 bp, Mus musculus
cagcttttcttcttctgattgct

SEQ ID NO: 201550 - DNA, 20 bp, Mus musculus
agagagaccacagagtccag

SEQ ID NO: 201551 - DNA, 22 bp, Mus musculus
atgttgtgtgtcatgatggtta

SEQ ID NO: 201552 - DNA, 23 bp, Mus musculus
aggcactgactgctcttccagag

SEQ ID NO: 201553 - DNA, 23 bp, Mus musculus
tgcctgcctgcctgcctgcctgc

SEQ ID NO: 201554 - DNA, 18 bp, Mus musculus
aggaggtacacattgggg

SEQ ID NO: 201555 - DNA, 23 bp, Mus musculus
agagctctgacagcagtgagtga

SEQ ID NO: 201556 - DNA, 23 bp, Mus musculus
tggtagcagttgatggtctctgt

SEQ ID NO: 201557 - DNA, 22 bp, Mus musculus
aagaggagtctgttcattgaga

SEQ ID NO: 201558 - DNA, 19 bp, Mus musculus
tgtatgtatgtgtgtatgt

SEQ ID NO: 201559 - DNA, 23 bp, Mus musculus
gtatgtatgtatgtatgtatgta

SEQ ID NO: 201560 - DNA, 23 bp, Mus musculus
gcaacctgcttctgtcttgaagt

SEQ ID NO: 201561 - DNA, 23 bp, Mus musculus
tggctgggtctcagcagttcctc

SEQ ID NO: 201562 - DNA, 23 bp, Mus musculus
tgtattctagcatagacattatg

SEQ ID NO: 201563 - DNA, 23 bp, Mus musculus
tgtgtgtatgcttatatatgtgt

SEQ ID NO: 201564 - DNA, 22 bp, Mus musculus
tgttttgtgaccaattatatgg

SEQ ID NO: 201565 - DNA, 21 bp, Mus musculus
tctgtgaatttcatgatgtga

SEQ ID NO: 201566 - DNA, 23 bp, Mus musculus
gagggtagagactgagcagtgtg

SEQ ID NO: 201567 - DNA, 22 bp, Mus musculus
taagattctctaagtaagctgt

SEQ ID NO: 201568 - DNA, 19 bp, Mus musculus
tctcagacgtactcatctc

SEQ ID NO: 201569 - DNA, 22 bp, Mus musculus
agagacaagtgagtcagctgaa

SEQ ID NO: 201570 - DNA, 23 bp, Mus musculus
aatgtacagtcatcctttgttct

SEQ ID NO: 201571 - DNA, 23 bp, Mus musculus
cagggtctgtctgcctctctggc

SEQ ID NO: 201572 - DNA, 23 bp, Mus musculus
ggccctctcaccctctgactccg

SEQ ID NO: 201573 - DNA, 18 bp, Mus musculus
tccttagagtttgagaag

SEQ ID NO: 201574 - DNA, 23 bp, Mus musculus
tgtgatggtgactgtctctatct

SEQ ID NO: 201575 - DNA, 23 bp, Mus musculus
atctcacatcctgatcttctaca

SEQ ID NO: 201576 - DNA, 23 bp, Mus musculus
tctcacagtgtctctcctcttcg

SEQ ID NO: 201577 - DNA, 23 bp, Mus musculus
tctcagttactctctggctctgg

SEQ ID NO: 201578 - DNA, 23 bp, Mus musculus
agcctgtcttctgttagtgtcag

SEQ ID NO: 201579 - DNA, 23 bp, Mus musculus
acactgtctgcaaaagaaaaggt

SEQ ID NO: 201580 - DNA, 23 bp, Mus musculus
agtcacagttttgtgttgcagtt

SEQ ID NO: 201581 - DNA, 22 bp, Mus musculus
gatgacagaagagtgaggccac

SEQ ID NO: 201582 - DNA, 23 bp, Mus musculus
atgtctactgtttttcatgtttt

SEQ ID NO: 201583 - DNA, 21 bp, Mus musculus
atgcagttgaacaggtccttt

SEQ ID NO: 201584 - DNA, 23 bp, Mus musculus
tctctctgtgacactaatgatag

SEQ ID NO: 201585 - DNA, 23 bp, Mus musculus
tggttttagtactgataggcact

SEQ ID NO: 201586 - DNA, 18 bp, Mus musculus
gcgagggattttcctggg

SEQ ID NO: 201587 - DNA, 23 bp, Mus musculus
agtgtgtctggctctctgcctcg

SEQ ID NO: 201588 - DNA, 23 bp, Mus musculus
gtgagattcactgactgactctc

SEQ ID NO: 201589 - DNA, 23 bp, Mus musculus
tgtgtaggtgtaggtgtgtatat

SEQ ID NO: 201590 - DNA, 22 bp, Mus musculus
tgttttgtgaccaattatatgg

SEQ ID NO: 201591 - DNA, 19 bp, Mus musculus
agtgaagaaatagagctct

SEQ ID NO: 201592 - DNA, 20 bp, Mus musculus
atacatacacatatacatga

SEQ ID NO: 201593 - DNA, 23 bp, Mus musculus
accctcagcctctgtctctggga

SEQ ID NO: 201594 - DNA, 23 bp, Mus musculus
tgatagaagacagtgagcttgga

SEQ ID NO: 201595 - DNA, 23 bp, Mus musculus
atgtgtgtgtgcatatatgtata

SEQ ID NO: 201596 - DNA, 19 bp, Mus musculus
ttcaattttaaagatgtat

SEQ ID NO: 201597 - DNA, 23 bp, Mus musculus
agagaggagtctgtgtgcacttg

SEQ ID NO: 201598 - DNA, 22 bp, Mus musculus
cactgtctctgactatattgcc

SEQ ID NO: 201599 - DNA, 23 bp, Mus musculus
cgtgtgtgcctctgtgtgtgtgt

SEQ ID NO: 201600 - DNA, 19 bp, Mus musculus
aagagctctgactgctctt

SEQ ID NO: 201601 - DNA, 18 bp, Mus musculus
tgtgttactgcctgctct

SEQ ID NO: 201602 - DNA, 20 bp, Mus musculus
ctctgtcactgtgcctgtcc

SEQ ID NO: 201603 - DNA, 21 bp, Mus musculus
acatgtgtcctgccatgtttg

SEQ ID NO: 201604 - DNA, 23 bp, Mus musculus
gtctctctcacaggctctatctt

SEQ ID NO: 201605 - DNA, 23 bp, Mus musculus
gttctcactgactctcttccctg

SEQ ID NO: 201606 - DNA, 22 bp, Mus musculus
agttcaacagcttcccctggag

SEQ ID NO: 201607 - DNA, 23 bp, Mus musculus
ggctctgtctgtctgacacaatg

SEQ ID NO: 201608 - DNA, 23 bp, Mus musculus
acacagatgtatgtgtgcacaca

SEQ ID NO: 201609 - DNA, 19 bp, Mus musculus
tctctctctctctctctct

SEQ ID NO: 201610 - DNA, 20 bp, Mus musculus
tatgtatatgtatatgtatg

SEQ ID NO: 201611 - DNA, 22 bp, Mus musculus
tcaactgttgcacactaaggca

SEQ ID NO: 201612 - DNA, 23 bp, Mus musculus
tgtgtatatataggtatgtgtat

SEQ ID NO: 201613 - DNA, 20 bp, Mus musculus
ttcaggtaggtgtatgtgtg

SEQ ID NO: 201614 - DNA, 23 bp, Mus musculus
tcagaaagcagagagaaatgagt

SEQ ID NO: 201615 - DNA, 21 bp, Mus musculus
tggtacttgatggtgtcactg

SEQ ID NO: 201616 - DNA, 20 bp, Mus musculus
tcccacatagtcacaatcct

SEQ ID NO: 201617 - DNA, 19 bp, Mus musculus
atgctagtccaggggatct

SEQ ID NO: 201618 - DNA, 23 bp, Mus musculus
ttcaattttcagcaaccacatgg

SEQ ID NO: 201619 - DNA, 23 bp, Mus musculus
tgtgtctgtgcctgtgtttgtgc

SEQ ID NO: 201620 - DNA, 19 bp, Mus musculus
tgcatctgtgtatctgtgt

SEQ ID NO: 201621 - DNA, 23 bp, Mus musculus
tgtctgtctctgtctgtgtttac

SEQ ID NO: 201622 - DNA, 22 bp, Mus musculus
tgttttgtgaccaattatatgg

SEQ ID NO: 201623 - DNA, 23 bp, Mus musculus
tgtacacctgtgtgtgcacacac

SEQ ID NO: 201624 - DNA, 23 bp, Mus musculus
gcacacacatatgtatacctgta

SEQ ID NO: 201625 - DNA, 23 bp, Mus musculus
actacacaatgctgtccatgctg

SEQ ID NO: 201626 - DNA, 23 bp, Mus musculus
aggctggctgcgtgcctgactcc

SEQ ID NO: 201627 - DNA, 23 bp, Mus musculus
tgatcactccctgtgtgtctcta

SEQ ID NO: 201628 - DNA, 19 bp, Mus musculus
tgtgtacatgccatagtgt

SEQ ID NO: 201629 - DNA, 18 bp, Mus musculus
tcagtgtgtgtgtctgtc

SEQ ID NO: 201630 - DNA, 23 bp, Mus musculus
ccctgtctccgtctgtttcaggt

SEQ ID NO: 201631 - DNA, 19 bp, Mus musculus
aggctgcaacttgtaagga

SEQ ID NO: 201632 - DNA, 22 bp, Mus musculus
ctgtgtgttttagctgcagtct

SEQ ID NO: 201633 - DNA, 23 bp, Mus musculus
ttatccaggctgacaattcagct

SEQ ID NO: 201634 - DNA, 20 bp, Mus musculus
aatagatgctcagtgagtgt

SEQ ID NO: 201635 - DNA, 23 bp, Mus musculus
atctatatatgcatgtgtgtaca

SEQ ID NO: 201636 - DNA, 21 bp, Mus musculus
acatcacagaggctctggaca

SEQ ID NO: 201637 - DNA, 23 bp, Mus musculus
tgagagtacagactctgctatgc

SEQ ID NO: 201638 - DNA, 23 bp, Mus musculus
tgggatgtgtctgtgtctgtcac

SEQ ID NO: 201639 - DNA, 23 bp, Mus musculus
atctgcatttctgactctctctt

SEQ ID NO: 201640 - DNA, 23 bp, Mus musculus
ctcagtggttgtctagtgcatcc

SEQ ID NO: 201641 - DNA, 23 bp, Mus musculus
tgggacagggtctgtgtctctct

SEQ ID NO: 201642 - DNA, 22 bp, Mus musculus
gttcacagtcacacagagtgtc

SEQ ID NO: 201643 - DNA, 23 bp, Mus musculus
gtatgggtatgtgtgtgtatgca

SEQ ID NO: 201644 - DNA, 23 bp, Mus musculus
tctctgtgtctctgtgagcctgt

SEQ ID NO: 201645 - DNA, 23 bp, Mus musculus
cgtctgtctgtctgtctgtggtc

SEQ ID NO: 201646 - DNA, 19 bp, Mus musculus
ctgtgatcatggtgtctct

SEQ ID NO: 201647 - DNA, 20 bp, Mus musculus
tatagcaaaagaattgaaat

SEQ ID NO: 201648 - DNA, 23 bp, Mus musculus
tgcgagtaagtgtgtgtgctcat

SEQ ID NO: 201649 - DNA, 21 bp, Mus musculus
tgtgtgtgtgcacatgtgtag

SEQ ID NO: 201650 - DNA, 23 bp, Mus musculus
tgcatgcacgtgttcatgtgtgt

SEQ ID NO: 201651 - DNA, 23 bp, Mus musculus
gtgtgtatgtgtgtgtgcatgtg

SEQ ID NO: 201652 - DNA, 23 bp, Mus musculus
gtgtgtgcatttgcatgtgtgtg

SEQ ID NO: 201653 - DNA, 18 bp, Mus musculus
ctaaaggagctggagaga

SEQ ID NO: 201654 - DNA, 23 bp, Mus musculus
agcagtctgctcttccagaggtc

SEQ ID NO: 201655 - DNA, 23 bp, Mus musculus
ggactgtctctgactctgttgtc

SEQ ID NO: 201656 - DNA, 23 bp, Mus musculus
tctctgcctctttcagtctctct

SEQ ID NO: 201657 - DNA, 22 bp, Mus musculus
aacagatagtaaaccaaagcat

SEQ ID NO: 201658 - DNA, 21 bp, Mus musculus
tgtttatggtgtacatggttt

SEQ ID NO: 201659 - DNA, 20 bp, Mus musculus
tgcatctttcttatatagta

SEQ ID NO: 201660 - DNA, 23 bp, Mus musculus
tatatcgtctagaaaacttgtac

SEQ ID NO: 201661 - DNA, 18 bp, Mus musculus
tgcagaatatatagatga

SEQ ID NO: 201662 - DNA, 20 bp, Mus musculus
tcactgtttgttttttagtt

SEQ ID NO: 201663 - DNA, 19 bp, Mus musculus
acattagactgaaagacca

SEQ ID NO: 201664 - DNA, 23 bp, Mus musculus
tctgtctgtctgtctctctgtgc

SEQ ID NO: 201665 - DNA, 23 bp, Mus musculus
gagtctgagtctgactcggtctc

SEQ ID NO: 201666 - DNA, 23 bp, Mus musculus
tgagaggatttttgtctgtcttt

SEQ ID NO: 201667 - DNA, 23 bp, Mus musculus
agtccattcttatagatgcttct

SEQ ID NO: 201668 - DNA, 21 bp, Mus musculus
atatgtatgtgtgtatatgca

SEQ ID NO: 201669 - DNA, 20 bp, Mus musculus
tctgggagaaaggttggaat

SEQ ID NO: 201670 - DNA, 19 bp, Mus musculus
tgtctgtgtgcgttggtgc

SEQ ID NO: 201671 - DNA, 22 bp, Mus musculus
actcaagagccatttgcatatt

SEQ ID NO: 201672 - DNA, 22 bp, Mus musculus
ttctggttttaggatgtattct

SEQ ID NO: 201673 - DNA, 23 bp, Mus musculus
tatgtgtatatatatgtatgtat

SEQ ID NO: 201674 - DNA, 23 bp, Mus musculus
atcacactgtgaaacttgagaat

SEQ ID NO: 201675 - DNA, 22 bp, Mus musculus
acttatatctagttttggtgtg

SEQ ID NO: 201676 - DNA, 23 bp, Mus musculus
actctgactgcctgtctagcttt

SEQ ID NO: 201677 - DNA, 20 bp, Mus musculus
tatgtgtgtgtgtgtttgtg

SEQ ID NO: 201678 - DNA, 20 bp, Mus musculus
tcagtgcactaaatttctgc

SEQ ID NO: 201679 - DNA, 20 bp, Mus musculus
tgacacaagtgagagtcatc

SEQ ID NO: 201680 - DNA, 21 bp, Mus musculus
agaggtagacagatgttcagt

SEQ ID NO: 201681 - DNA, 21 bp, Mus musculus
agagaggatgacagatgtttt

SEQ ID NO: 201682 - DNA, 18 bp, Mus musculus
tgttgatacacacacaca

SEQ ID NO: 201683 - DNA, 21 bp, Mus musculus
tatgtatgtatgtatatgtat

SEQ ID NO: 201684 - DNA, 20 bp, Mus musculus
tcacagttagttttacagtc

SEQ ID NO: 201685 - DNA, 23 bp, Mus musculus
tactatgtatatatgtatatgta

SEQ ID NO: 201686 - DNA, 22 bp, Mus musculus
tgtacatgtgtatgtatgtata

SEQ ID NO: 201687 - DNA, 22 bp, Mus musculus
tttatgtgcatatgcgtatgca

SEQ ID NO: 201688 - DNA, 21 bp, Mus musculus
atatatgtgtgtatgtgtata

SEQ ID NO: 201689 - DNA, 22 bp, Mus musculus
tgggtgtatatgtatgtgtgtg

SEQ ID NO: 201690 - DNA, 23 bp, Mus musculus
tttggtcatcttcatcttgatga

SEQ ID NO: 201691 - DNA, 19 bp, Mus musculus
tgaggtagacaattctgga

SEQ ID NO: 201692 - DNA, 23 bp, Mus musculus
tgtgtgtagagtgtgtgtatata

SEQ ID NO: 201693 - DNA, 23 bp, Mus musculus
ttagctttagtaaaggaaagctt

SEQ ID NO: 201694 - DNA, 22 bp, Mus musculus
agcgagacaagtgttggtgtgg

SEQ ID NO: 201695 - DNA, 22 bp, Mus musculus
aaggtccacttcttgctgctta

SEQ ID NO: 201696 - DNA, 23 bp, Mus musculus
gagactcaggagttcagtgcttt

SEQ ID NO: 201697 - DNA, 23 bp, Mus musculus
agaacactgactgctcttccaga

SEQ ID NO: 201698 - DNA, 23 bp, Mus musculus
ctgtgtgcacatggaggtcagag

SEQ ID NO: 201699 - DNA, 21 bp, Mus musculus
agtctctgaatcactgtctgt

SEQ ID NO: 201700 - DNA, 23 bp, Mus musculus
gagtaggtacagatggctttctg

SEQ ID NO: 201701 - DNA, 23 bp, Mus musculus
atagcactgactgctcttccaga

SEQ ID NO: 201702 - DNA, 21 bp, Mus musculus
agcagtcttcagggccggaga

SEQ ID NO: 201703 - DNA, 20 bp, Mus musculus
aagagctctgactgctcttc

SEQ ID NO: 201704 - DNA, 23 bp, Mus musculus
ttctgtatggaattgtacctgta

SEQ ID NO: 201705 - DNA, 20 bp, Mus musculus
agacgaacatgcaaaactct

SEQ ID NO: 201706 - DNA, 22 bp, Mus musculus
tgagtgcttgtgtgtttgtatg

SEQ ID NO: 201707 - DNA, 22 bp, Mus musculus
tgacagtgacataatgaagaca

SEQ ID NO: 201708 - DNA, 23 bp, Mus musculus
ttgaatgcttaagctctatcagc

SEQ ID NO: 201709 - DNA, 23 bp, Mus musculus
taatgtatatgtgtatatgtata

SEQ ID NO: 201710 - DNA, 23 bp, Mus musculus
agtggagagagagaactgagcac

SEQ ID NO: 201711 - DNA, 23 bp, Mus musculus
tcttgactgtggatgagatgtga

SEQ ID NO: 201712 - DNA, 20 bp, Mus musculus
gtgctcagtcagcagtttgt

SEQ ID NO: 201713 - DNA, 23 bp, Mus musculus
tatgtcttcagagacattgatgt

SEQ ID NO: 201714 - DNA, 21 bp, Mus musculus
tgtgacacagtactcactgcc

SEQ ID NO: 201715 - DNA, 23 bp, Mus musculus
tgctattcatttctcagcctgct

SEQ ID NO: 201716 - DNA, 19 bp, Mus musculus
tgactgaggcaggatctgc

SEQ ID NO: 201717 - DNA, 23 bp, Mus musculus
ttgacagaagacagagagcttga

SEQ ID NO: 201718 - DNA, 22 bp, Mus musculus
ttttcagtgaggaagacttctc

SEQ ID NO: 201719 - DNA, 23 bp, Mus musculus
atgtatgtatatatgtatgcatg

SEQ ID NO: 201720 - DNA, 22 bp, Mus musculus
tatgtctatatatatgtgtgtg

SEQ ID NO: 201721 - DNA, 23 bp, Mus musculus
tgcttgaacagaatagagactct

SEQ ID NO: 201722 - DNA, 23 bp, Mus musculus
gtcacagtcactgtcagcacatg

SEQ ID NO: 201723 - DNA, 23 bp, Mus musculus
ttatgtctggaaaacagtgctac

SEQ ID NO: 201724 - DNA, 23 bp, Mus musculus
atatgtgtatatgtatatgtatc

SEQ ID NO: 201725 - DNA, 23 bp, Mus musculus
ctctgcctcactctgtggcacag

SEQ ID NO: 201726 - DNA, 21 bp, Mus musculus
atgtgtatacatgcttgtatg

SEQ ID NO: 201727 - DNA, 23 bp, Mus musculus
acaaaatgtctttgaaagaaaac

SEQ ID NO: 201728 - DNA, 21 bp, Mus musculus
ttttttttaaagaggatggag

SEQ ID NO: 201729 - DNA, 19 bp, Mus musculus
ctaagttcaagtcccagca

SEQ ID NO: 201730 - DNA, 23 bp, Mus musculus
attttagcaagcaaatgttagta

SEQ ID NO: 201731 - DNA, 23 bp, Mus musculus
gtatgtgctttattttttactaa

SEQ ID NO: 201732 - DNA, 23 bp, Mus musculus
atgtatgtatgcatgtatgtacg

SEQ ID NO: 201733 - DNA, 18 bp, Mus musculus
tgtcttgagattttattg

SEQ ID NO: 201734 - DNA, 22 bp, Mus musculus
tatatgtatatgtatatgtata

SEQ ID NO: 201735 - DNA, 23 bp, Mus musculus
tttaattcgaggtgtctgaaact

SEQ ID NO: 201736 - DNA, 23 bp, Mus musculus
tttaggattgaattgaaatgacc

SEQ ID NO: 201737 - DNA, 23 bp, Mus musculus
tgtcactttcttaactggagtga

SEQ ID NO: 201738 - DNA, 22 bp, Mus musculus
tgtgtgtctatgtgtgtgtcta

SEQ ID NO: 201739 - DNA, 22 bp, Mus musculus
tgcgtctatgtgtgtgtatagg

SEQ ID NO: 201740 - DNA, 23 bp, Mus musculus
agtaaaaatgcctgtttacaggg

SEQ ID NO: 201741 - DNA, 22 bp, Mus musculus
atgtatgaaatacttggaaact

SEQ ID NO: 201742 - DNA, 23 bp, Mus musculus
atactgcaagtccaagtgcatcg

SEQ ID NO: 201743 - DNA, 23 bp, Mus musculus
tgtgtgagttcatgcttttttct

SEQ ID NO: 201744 - DNA, 22 bp, Mus musculus
tgttttgtgaccaattatatgg

SEQ ID NO: 201745 - DNA, 20 bp, Mus musculus
ataattagaagaaaggagga

SEQ ID NO: 201746 - DNA, 18 bp, Mus musculus
ttttctttctttttttga

SEQ ID NO: 201747 - DNA, 22 bp, Mus musculus
tgagagggtctctggatgcttt

SEQ ID NO: 201748 - DNA, 23 bp, Mus musculus
catctctctctgtgtctgtgggg

SEQ ID NO: 201749 - DNA, 22 bp, Mus musculus
tctgtgtctgtgtgtgagtgtg

SEQ ID NO: 201750 - DNA, 23 bp, Mus musculus
caccagtcattttgttgatgtca

SEQ ID NO: 201751 - DNA, 23 bp, Mus musculus
ctctcactcacagcttctctcag

SEQ ID NO: 201752 - DNA, 23 bp, Mus musculus
atgaattgttgaagaaaacagca

SEQ ID NO: 201753 - DNA, 23 bp, Mus musculus
ttttctttttcagatagagtggg

SEQ ID NO: 201754 - DNA, 23 bp, Mus musculus
tatatgagtgtttttcatgtatg

SEQ ID NO: 201755 - DNA, 23 bp, Mus musculus
gtgagtgatatatatgtaagggg

SEQ ID NO: 201756 - DNA, 20 bp, Mus musculus
atattcctagtatgtgtata

SEQ ID NO: 201757 - DNA, 23 bp, Mus musculus
tgtatgtatatatatatgtgtgt

SEQ ID NO: 201758 - DNA, 23 bp, Mus musculus
tgagacagtctcactctcatttc

SEQ ID NO: 201759 - DNA, 23 bp, Mus musculus
gagtggaaagatgtttgtggatc

SEQ ID NO: 201760 - DNA, 23 bp, Mus musculus
tgacagaacacagagtctcctga

SEQ ID NO: 201761 - DNA, 23 bp, Mus musculus
agaactgtggaaggttctgtccc

SEQ ID NO: 201762 - DNA, 23 bp, Mus musculus
tgtttacatctaatactggaaga

SEQ ID NO: 201763 - DNA, 23 bp, Mus musculus
tgtctgtctctctctctcccaac

SEQ ID NO: 201764 - DNA, 23 bp, Mus musculus
gtgtgtgtgtgtgtgagagagag

SEQ ID NO: 201765 - DNA, 23 bp, Mus musculus
ataactcagtggttaagagcact

SEQ ID NO: 201766 - DNA, 23 bp, Mus musculus
ctgtctgtgtgtgggagagctgt

SEQ ID NO: 201767 - DNA, 22 bp, Mus musculus
atgtctctgactctgaacccat

SEQ ID NO: 201768 - DNA, 22 bp, Mus musculus
agtctgtctggttaacttaacc

SEQ ID NO: 201769 - DNA, 23 bp, Mus musculus
atgtcacacaggttagggttgcc

SEQ ID NO: 201770 - DNA, 18 bp, Mus musculus
tcagtcttagtcagtcac

SEQ ID NO: 201771 - DNA, 23 bp, Mus musculus
gttggacggagaactgataaggg

SEQ ID NO: 201772 - DNA, 23 bp, Mus musculus
tcatttctgattttgttaattag

SEQ ID NO: 201773 - DNA, 22 bp, Mus musculus
tgttttgtgaccaattatatgg

SEQ ID NO: 201774 - DNA, 23 bp, Mus musculus
aatgtttggctctgtgtctctgt

SEQ ID NO: 201775 - DNA, 22 bp, Mus musculus
gtcactgttaagccatcagaag

SEQ ID NO: 201776 - DNA, 22 bp, Mus musculus
ctcagggactttagggtgacaa

SEQ ID NO: 201777 - DNA, 22 bp, Mus musculus
tcagagagtggatagctggttg

SEQ ID NO: 201778 - DNA, 23 bp, Mus musculus
tctctctttgactcatatcacat

SEQ ID NO: 201779 - DNA, 23 bp, Mus musculus
gtatctctgtgtggttatgcaca

SEQ ID NO: 201780 - DNA, 20 bp, Mus musculus
atagtttatatagctataag

SEQ ID NO: 201781 - DNA, 20 bp, Mus musculus
tttgtacatatacatttgta

SEQ ID NO: 201782 - DNA, 18 bp, Mus musculus
tcagatgttgggctggag

SEQ ID NO: 201783 - DNA, 23 bp, Mus musculus
agtgattgagaaattcttgttga

SEQ ID NO: 201784 - DNA, 23 bp, Mus musculus
agccagtggctcagttcaccagg

SEQ ID NO: 201785 - DNA, 23 bp, Mus musculus
attctccctgactggctgtccat

SEQ ID NO: 201786 - DNA, 22 bp, Mus musculus
tgttttgtgaccaattatatgg

SEQ ID NO: 201787 - DNA, 23 bp, Mus musculus
tgagttctgcatctgcatctgga

SEQ ID NO: 201788 - DNA, 22 bp, Mus musculus
actctcagtgactgattctaga

SEQ ID NO: 201789 - DNA, 21 bp, Mus musculus
tgtgtgcatatgtgtgtgcac

SEQ ID NO: 201790 - DNA, 23 bp, Mus musculus
tgcatgtgtgtgcatatgtgtgt

SEQ ID NO: 201791 - DNA, 21 bp, Mus musculus
tgtcagtctgtctgttgctcc

SEQ ID NO: 201792 - DNA, 23 bp, Mus musculus
tctccctcagtgcctctctgatt

SEQ ID NO: 201793 - DNA, 23 bp, Mus musculus
taactgcaagggattaaagtgct

SEQ ID NO: 201794 - DNA, 21 bp, Mus musculus
ctgagagatggggtttgcttc

SEQ ID NO: 201795 - DNA, 19 bp, Mus musculus
actctccctccctcactgg

SEQ ID NO: 201796 - DNA, 23 bp, Mus musculus
gtatgtatgtatatgatgtgtta

SEQ ID NO: 201797 - DNA, 20 bp, Mus musculus
tcagtatgtcttttgcatct

SEQ ID NO: 201798 - DNA, 23 bp, Mus musculus
tctgtctcagtgtctgcaaagtc

SEQ ID NO: 201799 - DNA, 23 bp, Mus musculus
aagggtggggatgtagctctgtg

SEQ ID NO: 201800 - DNA, 22 bp, Mus musculus
ttcactgatgaaagtgagaact

SEQ ID NO: 201801 - DNA, 21 bp, Mus musculus
acagcaataggtttcactagc

SEQ ID NO: 201802 - DNA, 23 bp, Mus musculus
tctctgcacactgtctgtctgtg

SEQ ID NO: 201803 - DNA, 22 bp, Mus musculus
tactgactgctcttccagaggt

SEQ ID NO: 201804 - DNA, 22 bp, Mus musculus
gatcactactgattttcatcag

SEQ ID NO: 201805 - DNA, 18 bp, Mus musculus
aaggaattcagaatgtgc

SEQ ID NO: 201806 - DNA, 21 bp, Mus musculus
tgtatatatatatgtgtgtgt

SEQ ID NO: 201807 - DNA, 22 bp, Mus musculus
atatgtgcatgatatatatgca

SEQ ID NO: 201808 - DNA, 22 bp, Mus musculus
actcacgacactgtctgtctct

SEQ ID NO: 201809 - DNA, 22 bp, Mus musculus
tgttttgtgaccaattatatgg

SEQ ID NO: 201810 - DNA, 20 bp, Mus musculus
tattggatactttgttctgt

SEQ ID NO: 201811 - DNA, 19 bp, Mus musculus
tgtttttcattatgaagga

SEQ ID NO: 201812 - DNA, 22 bp, Mus musculus
aaaattgttacatatatttagt

SEQ ID NO: 201813 - DNA, 19 bp, Mus musculus
agagttgaacatttgagac

SEQ ID NO: 201814 - DNA, 22 bp, Mus musculus
atgtgtgtgtatatatgtgtgt

SEQ ID NO: 201815 - DNA, 23 bp, Mus musculus
atgtatatgtatgtatatgtata

SEQ ID NO: 201816 - DNA, 20 bp, Mus musculus
aggtggaatgttctctgctt

SEQ ID NO: 201817 - DNA, 22 bp, Mus musculus
tatgtatatatgatatatatgt

SEQ ID NO: 201818 - DNA, 18 bp, Mus musculus
atatatgatgtatatgta

SEQ ID NO: 201819 - DNA, 22 bp, Mus musculus
ttgtgtgtatgtgcatatgtat

SEQ ID NO: 201820 - DNA, 23 bp, Mus musculus
atatatgtacatatacacagtgc

SEQ ID NO: 201821 - DNA, 23 bp, Mus musculus
gatgtgtctgtctgtctgtctct

SEQ ID NO: 201822 - DNA, 23 bp, Mus musculus
tgtatgtgtgtatatgatgtgtg

SEQ ID NO: 201823 - DNA, 21 bp, Mus musculus
atgtgtgtggtgtatgcatat

SEQ ID NO: 201824 - DNA, 20 bp, Mus musculus
tgtgtgtctatggtatatgt

SEQ ID NO: 201825 - DNA, 23 bp, Mus musculus
tgagagtagagacagtgagctaa

SEQ ID NO: 201826 - DNA, 23 bp, Mus musculus
ggtgttcactgtctctctgcttg

SEQ ID NO: 201827 - DNA, 21 bp, Mus musculus
tgacttttcaatttgttgtag

SEQ ID NO: 201828 - DNA, 23 bp, Mus musculus
agttgcttaagtattctgtgtct

SEQ ID NO: 201829 - DNA, 23 bp, Mus musculus
ttttctttttgtacatcaaattg

SEQ ID NO: 201830 - DNA, 22 bp, Mus musculus
tgttttgtgaccaattatatgg

SEQ ID NO: 201831 - DNA, 18 bp, Mus musculus
gggctgtctctgactcgg

SEQ ID NO: 201832 - DNA, 23 bp, Mus musculus
ttagatctctttgccctaactgt

SEQ ID NO: 201833 - DNA, 23 bp, Mus musculus
tatgcatgtatgtatgtatgtag

SEQ ID NO: 201834 - DNA, 23 bp, Mus musculus
atgtatgtatgtatgtatgtatg

SEQ ID NO: 201835 - DNA, 23 bp, Mus musculus
gatgctgtaatactgtctgctaa

SEQ ID NO: 201836 - DNA, 23 bp, Mus musculus
catgcgagagagagtgcttttca

SEQ ID NO: 201837 - DNA, 23 bp, Mus musculus
gtctgtctgtctgtctgtctgtc

SEQ ID NO: 201838 - DNA, 23 bp, Mus musculus
tgtgcatgcatgtgtgtgtgtgt

SEQ ID NO: 201839 - DNA, 23 bp, Mus musculus
tcactgtgtgtgtgtatgttgac

SEQ ID NO: 201840 - DNA, 22 bp, Mus musculus
ttttgtagtaggatctgatgat

SEQ ID NO: 201841 - DNA, 23 bp, Mus musculus
tgtgcctgactggatgaggatca

SEQ ID NO: 201842 - DNA, 23 bp, Mus musculus
tcagactctggcagagcctctca

SEQ ID NO: 201843 - DNA, 23 bp, Mus musculus
tctttgactagtgattttgtggt

SEQ ID NO: 201844 - DNA, 19 bp, Mus musculus
ataattcagtttctctaga

SEQ ID NO: 201845 - DNA, 23 bp, Mus musculus
acacttgtaccagcactttgaaa

SEQ ID NO: 201846 - DNA, 22 bp, Mus musculus
tgttttgtgaccaattatatgg

SEQ ID NO: 201847 - DNA, 19 bp, Mus musculus
ttatagaacagaaaggaag

SEQ ID NO: 201848 - DNA, 23 bp, Mus musculus
atgtctgtgtgagtttaagtgct

SEQ ID NO: 201849 - DNA, 23 bp, Mus musculus
atttttcattagtaaacaagtgc

SEQ ID NO: 201850 - DNA, 23 bp, Mus musculus
tctctttcacactctgctaaaat

SEQ ID NO: 201851 - DNA, 22 bp, Mus musculus
tgttttgtgaccaattatatgg

SEQ ID NO: 201852 - DNA, 22 bp, Mus musculus
tgttttgtgaccaattatatgg

SEQ ID NO: 201853 - DNA, 22 bp, Mus musculus
tgttttgtgaccaattatatgg

SEQ ID NO: 201854 - DNA, 21 bp, Mus musculus
cctcagttaagtctttctgta

SEQ ID NO: 201855 - DNA, 22 bp, Mus musculus
tgttttgtgaccaattatatgg

SEQ ID NO: 201856 - DNA, 22 bp, Mus musculus
tgttttgtgaccaattatatgg

SEQ ID NO: 201857 - DNA, 20 bp, Mus musculus
tatagtatgtgtatatatgt

SEQ ID NO: 201858 - DNA, 23 bp, Mus musculus
tgtgtgtgtatgtatacatgtat

SEQ ID NO: 201859 - DNA, 23 bp, Mus musculus
tgtgtgtgtgtgtgtatgtacac

SEQ ID NO: 201860 - DNA, 23 bp, Mus musculus
cagactcactgtggctggctcac

SEQ ID NO: 201861 - DNA, 22 bp, Mus musculus
tgttttgtgaccaattatatgg

SEQ ID NO: 201862 - DNA, 20 bp, Mus musculus
gtatatatatatgtgtgtgt

SEQ ID NO: 201863 - DNA, 21 bp, Mus musculus
taatgcagtggctgatttcag

SEQ ID NO: 201864 - DNA, 22 bp, Mus musculus
tcagagaacacagtttgctcaa

SEQ ID NO: 201865 - DNA, 23 bp, Mus musculus
gtatgcatgcatgtatgtatgta

SEQ ID NO: 201866 - DNA, 22 bp, Mus musculus
atgcatgtatgcttatgtatgc

SEQ ID NO: 201867 - DNA, 21 bp, Mus musculus
ctctcagtctctgcacattag

SEQ ID NO: 201868 - DNA, 23 bp, Mus musculus
ttaccacaagtttccttaatgag

SEQ ID NO: 201869 - DNA, 23 bp, Mus musculus
gtaaaagtatatgtatatgtgtg

SEQ ID NO: 201870 - DNA, 23 bp, Mus musculus
tctgtgaagtgggtgtgtcttat

SEQ ID NO: 201871 - DNA, 22 bp, Mus musculus
tgttttgtgaccaattatatgg

SEQ ID NO: 201872 - DNA, 23 bp, Mus musculus
gttgtgagagtggtagagctggc

SEQ ID NO: 201873 - DNA, 23 bp, Mus musculus
tctgcctctcactggcagtggca

SEQ ID NO: 201874 - DNA, 23 bp, Mus musculus
tgtcaccctctgtgtctcactga

SEQ ID NO: 201875 - DNA, 23 bp, Mus musculus
atgtgtgtacatatctatgtgta

SEQ ID NO: 201876 - DNA, 20 bp, Mus musculus
ctatgtatatatatacacat

SEQ ID NO: 201877 - DNA, 18 bp, Mus musculus
ttgtgaatgtcatggggt

SEQ ID NO: 201878 - DNA, 22 bp, Mus musculus
aattgcaccatgaagtatgcat

SEQ ID NO: 201879 - DNA, 20 bp, Mus musculus
tatacatacatatacatgtg

SEQ ID NO: 201880 - DNA, 23 bp, Mus musculus
agtcagtgcctctgacagtctct

SEQ ID NO: 201881 - DNA, 23 bp, Mus musculus
tgtgggggtgagtatcttatttc

SEQ ID NO: 201882 - DNA, 19 bp, Mus musculus
gagtgcttacattaaactg

SEQ ID NO: 201883 - DNA, 19 bp, Mus musculus
ctgcgctcgttatatatgc

SEQ ID NO: 201884 - DNA, 23 bp, Mus musculus
gagttttctgtcctgggaaaaga

SEQ ID NO: 201885 - DNA, 23 bp, Mus musculus
tactgctctctgtctgtctgtcc

SEQ ID NO: 201886 - DNA, 22 bp, Mus musculus
tatgtgcatatatatgcatata

SEQ ID NO: 201887 - DNA, 22 bp, Mus musculus
atatgcatatatatgcatatat

SEQ ID NO: 201888 - DNA, 21 bp, Mus musculus
tgcctgcctgcctgcctgcct

SEQ ID NO: 201889 - DNA, 19 bp, Mus musculus
taatgtcttttatttttag

SEQ ID NO: 201890 - DNA, 23 bp, Mus musculus
aattggatgtacttgagtttggt

SEQ ID NO: 201891 - DNA, 22 bp, Mus musculus
tgttttgtgaccaattatatgg

SEQ ID NO: 201892 - DNA, 22 bp, Mus musculus
tgtcactgagctatacctccag

SEQ ID NO: 201893 - DNA, 21 bp, Mus musculus
tatcctgaacttgctctgtag

SEQ ID NO: 201894 - DNA, 21 bp, Mus musculus
actcactctgtctgcctctgc

SEQ ID NO: 201895 - DNA, 23 bp, Mus musculus
accctggaaaccaaatgaaatac

SEQ ID NO: 201896 - DNA, 21 bp, Mus musculus
ctcagtagtgacagtgcagat

SEQ ID NO: 201897 - DNA, 23 bp, Mus musculus
ttctacatcttcatctgaaggct

SEQ ID NO: 201898 - DNA, 23 bp, Mus musculus
gtaagatttgggacactttatga

SEQ ID NO: 201899 - DNA, 23 bp, Mus musculus
catgttgcaaaagaatactcaat

SEQ ID NO: 201900 - DNA, 23 bp, Mus musculus
tgtgtgtgtatctgtgtgtgtgt

SEQ ID NO: 201901 - DNA, 18 bp, Mus musculus
aaagtagaggtgaaggtc

SEQ ID NO: 201902 - DNA, 22 bp, Mus musculus
tcactctgtccctggctgtgaa

SEQ ID NO: 201903 - DNA, 23 bp, Mus musculus
aatcatgaacattctgtaatttt

SEQ ID NO: 201904 - DNA, 23 bp, Mus musculus
tgtgtcagtacatatgcatgtgt

SEQ ID NO: 201905 - DNA, 20 bp, Mus musculus
atgtatacatagatatgtgt

SEQ ID NO: 201906 - DNA, 22 bp, Mus musculus
tctgttccttttcagcagcgtt

SEQ ID NO: 201907 - DNA, 22 bp, Mus musculus
gcatacatccttgtatctgcct

SEQ ID NO: 201908 - DNA, 23 bp, Mus musculus
gaagtctgtctgtctctgccaca

SEQ ID NO: 201909 - DNA, 20 bp, Mus musculus
tctctgcctgtctctgcctc

SEQ ID NO: 201910 - DNA, 23 bp, Mus musculus
tactctcactcactctttgtgta

SEQ ID NO: 201911 - DNA, 23 bp, Mus musculus
gcctctgtgagtggctgagttct

SEQ ID NO: 201912 - DNA, 23 bp, Mus musculus
tgtgtcactgtatagtgtgagct

SEQ ID NO: 201913 - DNA, 21 bp, Mus musculus
tgactgtgtgcctggctcgtt

SEQ ID NO: 201914 - DNA, 23 bp, Mus musculus
gtttttccacttcaagcacttgt

SEQ ID NO: 201915 - DNA, 23 bp, Mus musculus
tggaagaagacagactgcagatg

SEQ ID NO: 201916 - DNA, 23 bp, Mus musculus
gactcagtgtacatgcagagtgt

SEQ ID NO: 201917 - DNA, 23 bp, Mus musculus
tgagtgtgtctctgtgtgcatgt

SEQ ID NO: 201918 - DNA, 21 bp, Mus musculus
acatgtgtgtacaaagcttat

SEQ ID NO: 201919 - DNA, 23 bp, Mus musculus
aagagaactgagttagatgatgt

SEQ ID NO: 201920 - DNA, 18 bp, Mus musculus
agggagaagaatggtggt

SEQ ID NO: 201921 - DNA, 23 bp, Mus musculus
ataggtgtatatgtatatgtgtg

SEQ ID NO: 201922 - DNA, 21 bp, Mus musculus
tgtatgtctgtgtgtctgtgt

SEQ ID NO: 201923 - DNA, 22 bp, Mus musculus
aagtgttgctggattggttggt

SEQ ID NO: 201924 - DNA, 23 bp, Mus musculus
gatgagtgagtgagttcagtcag

SEQ ID NO: 201925 - DNA, 23 bp, Mus musculus
ttcagtagttggattgctggatc

SEQ ID NO: 201926 - DNA, 23 bp, Mus musculus
tagaatcacgttgcaaatgaatc

SEQ ID NO: 201927 - DNA, 22 bp, Mus musculus
tgttttgtgaccaattatatgg

SEQ ID NO: 201928 - DNA, 23 bp, Mus musculus
catgagacacatacaggttacag

SEQ ID NO: 201929 - DNA, 23 bp, Mus musculus
atatgtgtatgtgtatatgtgtc

SEQ ID NO: 201930 - DNA, 21 bp, Mus musculus
tgtatctatatttgcatctgt

SEQ ID NO: 201931 - DNA, 23 bp, Mus musculus
agaggactgactgctcttccaga

SEQ ID NO: 201932 - DNA, 18 bp, Mus musculus
cagaggtcctgagttcaa

SEQ ID NO: 201933 - DNA, 23 bp, Mus musculus
gtgtctgtctctgtgtgtgtgtg

SEQ ID NO: 201934 - DNA, 23 bp, Mus musculus
aaaatgctggatttcctgttaga

SEQ ID NO: 201935 - DNA, 23 bp, Mus musculus
gtatgtatgtatgtatgtatgtg

SEQ ID NO: 201936 - DNA, 20 bp, Mus musculus
tgtatgcatgcatgtatatg

SEQ ID NO: 201937 - DNA, 23 bp, Mus musculus
agaagttgaccttcatgtttctc

SEQ ID NO: 201938 - DNA, 23 bp, Mus musculus
ttttcaggactctgcatgtaggt

SEQ ID NO: 201939 - DNA, 23 bp, Mus musculus
cactcccagtcagtgtcacttgt

SEQ ID NO: 201940 - DNA, 23 bp, Mus musculus
gaactttagtgtggctatcttgt

SEQ ID NO: 201941 - DNA, 23 bp, Mus musculus
gtctgtatgtgtgtgtctgtgtg

SEQ ID NO: 201942 - DNA, 23 bp, Mus musculus
atgcttggtgagcctgtgtggca

SEQ ID NO: 201943 - DNA, 23 bp, Mus musculus
cagggtctcactcactcttgctg

SEQ ID NO: 201944 - DNA, 22 bp, Mus musculus
tgcatgtacatgtgcatgtgtg

SEQ ID NO: 201945 - DNA, 23 bp, Mus musculus
tctgagacacagtctctcactgg

SEQ ID NO: 201946 - DNA, 23 bp, Mus musculus
tgagagtgtatgtgtatatatat

SEQ ID NO: 201947 - DNA, 21 bp, Mus musculus
tgtgtgtgtgtgtgtatatac

SEQ ID NO: 201948 - DNA, 23 bp, Mus musculus
gccaggctcagtgtctcactctc

SEQ ID NO: 201949 - DNA, 23 bp, Mus musculus
tgtatgtatgtatgtatatatct

SEQ ID NO: 201950 - DNA, 23 bp, Mus musculus
tgtatgtgtgcttgtgcatgtgg

SEQ ID NO: 201951 - DNA, 23 bp, Mus musculus
tgtgtgtgtgtgtgtgtaactcg

SEQ ID NO: 201952 - DNA, 23 bp, Mus musculus
tgtgtgtgtgtgtgtgtaactcg

SEQ ID NO: 201953 - DNA, 23 bp, Mus musculus
tctgtgagcatctgcttctgtat

SEQ ID NO: 201954 - DNA, 23 bp, Mus musculus
tatatgcatgtgtgtgtgtgcgc

SEQ ID NO: 201955 - DNA, 23 bp, Mus musculus
tgtctgtctgtctgtgtgtgcac

SEQ ID NO: 201956 - DNA, 19 bp, Mus musculus
aagagcactgactgctctt

SEQ ID NO: 201957 - DNA, 22 bp, Mus musculus
aggtttgtctcttttacttcac

SEQ ID NO: 201958 - DNA, 22 bp, Mus musculus
tgttttgtgaccaattatatgg

SEQ ID NO: 201959 - DNA, 22 bp, Mus musculus
tgttttgtgaccaattatatgg

SEQ ID NO: 201960 - DNA, 22 bp, Mus musculus
acactgaactgtgagtgcacct

SEQ ID NO: 201961 - DNA, 20 bp, Mus musculus
aaaggttctgagttcaattc

SEQ ID NO: 201962 - DNA, 21 bp, Mus musculus
tgaatcggtcttgtgtgtgtg

SEQ ID NO: 201963 - DNA, 22 bp, Mus musculus
tgaggggctgtagtgatgctca

SEQ ID NO: 201964 - DNA, 20 bp, Mus musculus
tttcctcttgactcagcagt

SEQ ID NO: 201965 - DNA, 23 bp, Mus musculus
aaggatgaactggtttgcgagag

SEQ ID NO: 201966 - DNA, 19 bp, Mus musculus
tctgtgtatatgtctctgt

SEQ ID NO: 201967 - DNA, 23 bp, Mus musculus
tgtttgtgtgcatgtgcatatga

SEQ ID NO: 201968 - DNA, 20 bp, Mus musculus
ctgatgagggcgtgctgtgt

SEQ ID NO: 201969 - DNA, 23 bp, Mus musculus
ttagacacagccattaacctctc

SEQ ID NO: 201970 - DNA, 20 bp, Mus musculus
tacatacatgtacatgggca

SEQ ID NO: 201971 - DNA, 23 bp, Mus musculus
tacgtacatgtatgtatgtatgt

SEQ ID NO: 201972 - DNA, 23 bp, Mus musculus
gactctcaaactctgactcactt

SEQ ID NO: 201973 - DNA, 22 bp, Mus musculus
acagaaaacagtgtggtctgta

SEQ ID NO: 201974 - DNA, 23 bp, Mus musculus
ttttttcttcttcttgatggtgg

SEQ ID NO: 201975 - DNA, 23 bp, Mus musculus
actcagtggttttgatgttcttc

SEQ ID NO: 201976 - DNA, 22 bp, Mus musculus
acccttcacgagggcatagcat

SEQ ID NO: 201977 - DNA, 20 bp, Mus musculus
tgtgggtcagacacaggcag

SEQ ID NO: 201978 - DNA, 21 bp, Mus musculus
atgtgtgtggtatatatgcat

SEQ ID NO: 201979 - DNA, 23 bp, Mus musculus
agtgtctgtctctctgtttccct

SEQ ID NO: 201980 - DNA, 18 bp, Mus musculus
acggagctgttcgtcctg

SEQ ID NO: 201981 - DNA, 19 bp, Mus musculus
gtatgtatgtatgcatgtg

SEQ ID NO: 201982 - DNA, 18 bp, Mus musculus
tctcagctagtttgttct

SEQ ID NO: 201983 - DNA, 23 bp, Mus musculus
tctgtgcatgtgcttgtgcatat

SEQ ID NO: 201984 - DNA, 23 bp, Mus musculus
tctaaaacagtatctttttgtgt

SEQ ID NO: 201985 - DNA, 23 bp, Mus musculus
tctcactgtcacactatactcag

SEQ ID NO: 201986 - DNA, 22 bp, Mus musculus
tctttcagtgatgtctatgtgt

SEQ ID NO: 201987 - DNA, 23 bp, Mus musculus
catatgtctgggacactaagtcc

SEQ ID NO: 201988 - DNA, 23 bp, Mus musculus
tctctgtctccatctctctgtct

SEQ ID NO: 201989 - DNA, 20 bp, Mus musculus
atatatgtgtgtatgtgcat

SEQ ID NO: 201990 - DNA, 23 bp, Mus musculus
actctgcctcactggctctcctt

SEQ ID NO: 201991 - DNA, 19 bp, Mus musculus
tcccattgtgtcaggttgc

SEQ ID NO: 201992 - DNA, 23 bp, Mus musculus
ttatggtgctttatgaagtgtgt

SEQ ID NO: 201993 - DNA, 23 bp, Mus musculus
ctgttcactgtagtgtctgacaa

SEQ ID NO: 201994 - DNA, 23 bp, Mus musculus
ggtaatgagtcagctaaggcttt

SEQ ID NO: 201995 - DNA, 23 bp, Mus musculus
tgagtagccatttgtatgtgttc

SEQ ID NO: 201996 - DNA, 22 bp, Mus musculus
tctctcacacacatgggtgctg

SEQ ID NO: 201997 - DNA, 23 bp, Mus musculus
actctgacactgtcttattctgc

SEQ ID NO: 201998 - DNA, 23 bp, Mus musculus
tctgtgtgtgtgtgtgtgcatgt

SEQ ID NO: 201999 - DNA, 21 bp, Mus musculus
tgagacctgagagtcagctct

SEQ ID NO: 202000 - DNA, 23 bp, Mus musculus
tgacatgttcaaggtgtcactct

SEQ ID NO: 202001 - DNA, 23 bp, Mus musculus
ttctctctctcagaatcttcact

SEQ ID NO: 202002 - DNA, 20 bp, Mus musculus
gcatgcaatataatggtgta

SEQ ID NO: 202003 - DNA, 20 bp, Mus musculus
gttctgttttattgttgtat

SEQ ID NO: 202004 - DNA, 23 bp, Mus musculus
tggagtcataggctgtagagtct

SEQ ID NO: 202005 - DNA, 23 bp, Mus musculus
tgagcttctttgcctctgtgtct

SEQ ID NO: 202006 - DNA, 23 bp, Mus musculus
tctctgtctgactgtcttcatct

SEQ ID NO: 202007 - DNA, 21 bp, Mus musculus
agatcctgggatgtctgggag

SEQ ID NO: 202008 - DNA, 19 bp, Mus musculus
agcttacccaggactctca

SEQ ID NO: 202009 - DNA, 23 bp, Mus musculus
tgagccaccatgtgtttgctgag

SEQ ID NO: 202010 - DNA, 23 bp, Mus musculus
tgaaagaacagtcagtgctctta

SEQ ID NO: 202011 - DNA, 23 bp, Mus musculus
gtgtgtgactgtgagtgtgtgca

SEQ ID NO: 202012 - DNA, 23 bp, Mus musculus
tggctcgctgcctcgctctctgg

SEQ ID NO: 202013 - DNA, 22 bp, Mus musculus
ttagaaactctcaaaaggcagg

SEQ ID NO: 202014 - DNA, 21 bp, Mus musculus
atttctgcctttagagatcta

SEQ ID NO: 202015 - DNA, 19 bp, Mus musculus
tctcagcactcagagggtg

SEQ ID NO: 202016 - DNA, 23 bp, Mus musculus
tcactgactgctcttccagaggt

SEQ ID NO: 202017 - DNA, 19 bp, Mus musculus
tatgtatatatatatatgt

SEQ ID NO: 202018 - DNA, 23 bp, Mus musculus
tgagaagactgtgtggacattgt

SEQ ID NO: 202019 - DNA, 23 bp, Mus musculus
gtttgaggacagcctagtctaca

SEQ ID NO: 202020 - DNA, 23 bp, Mus musculus
atattcagggctatgtagacaga

SEQ ID NO: 202021 - DNA, 19 bp, Mus musculus
gtgtgtgtgtgtgtgtgtg

SEQ ID NO: 202022 - DNA, 19 bp, Mus musculus
aagtgaaatatgtatacat

SEQ ID NO: 202023 - DNA, 19 bp, Mus musculus
gtgtgacagttaaatcatt

SEQ ID NO: 202024 - DNA, 23 bp, Mus musculus
tcctgtcaaatagttaagatgat

SEQ ID NO: 202025 - DNA, 21 bp, Mus musculus
tttatttcatgtgtatggggt

SEQ ID NO: 202026 - DNA, 23 bp, Mus musculus
cagcgtgcctcagtccctacctg

SEQ ID NO: 202027 - DNA, 23 bp, Mus musculus
acccaccctgcctgtgagcctca

SEQ ID NO: 202028 - DNA, 19 bp, Mus musculus
ggctattttaaagaaagtc

SEQ ID NO: 202029 - DNA, 21 bp, Mus musculus
taagagcactgactgctcttc

SEQ ID NO: 202030 - DNA, 23 bp, Mus musculus
gtgtgtctctgtgtgagtgtgtg

SEQ ID NO: 202031 - DNA, 18 bp, Mus musculus
tctgccaggtctagaagg

SEQ ID NO: 202032 - DNA, 23 bp, Mus musculus
agaggctagagagatggctcagc

SEQ ID NO: 202033 - DNA, 23 bp, Mus musculus
gctgcctgggagtctctgtcagt

SEQ ID NO: 202034 - DNA, 23 bp, Mus musculus
gagtgtgtgtgcatgtgcatatg

SEQ ID NO: 202035 - DNA, 23 bp, Mus musculus
gactcactcagttactcttacca

SEQ ID NO: 202036 - DNA, 23 bp, Mus musculus
tccttgaagtttgagaggctgtc

SEQ ID NO: 202037 - DNA, 23 bp, Mus musculus
gtgagtacactgtagctgtactg

SEQ ID NO: 202038 - DNA, 23 bp, Mus musculus
taagtacactgtagctgattggg

SEQ ID NO: 202039 - DNA, 23 bp, Mus musculus
tctgtccctgggtctctcctcac

SEQ ID NO: 202040 - DNA, 23 bp, Mus musculus
tcactctctctgtcagcccttag

SEQ ID NO: 202041 - DNA, 22 bp, Mus musculus
tatgtatatatgtatatgtatg

SEQ ID NO: 202042 - DNA, 20 bp, Mus musculus
tatatgcatatataaacaaa

SEQ ID NO: 202043 - DNA, 23 bp, Mus musculus
tgtgtatgtgcatgtacatgtgc

SEQ ID NO: 202044 - DNA, 23 bp, Mus musculus
ctgagttcaattcttgacaacca

SEQ ID NO: 202045 - DNA, 23 bp, Mus musculus
tctctctgtgtatatgtgtgtgt

SEQ ID NO: 202046 - DNA, 22 bp, Mus musculus
agcaaaggctgtctctgtctct

SEQ ID NO: 202047 - DNA, 23 bp, Mus musculus
ctgtctgtctgtctgcttctgtt

SEQ ID NO: 202048 - DNA, 18 bp, Mus musculus
tgagttcaaattccagtg

SEQ ID NO: 202049 - DNA, 18 bp, Mus musculus
ataggtaatgaagtggaa

SEQ ID NO: 202050 - DNA, 23 bp, Mus musculus
agtctctcactctctgcacgttg

SEQ ID NO: 202051 - DNA, 20 bp, Mus musculus
ctcttgagccctgactctga

SEQ ID NO: 202052 - DNA, 19 bp, Mus musculus
atgatcagtggctggagct

SEQ ID NO: 202053 - DNA, 18 bp, Mus musculus
cagtgtctttctctctgt

SEQ ID NO: 202054 - DNA, 20 bp, Mus musculus
tcagaggaatgagatgtgag

SEQ ID NO: 202055 - DNA, 23 bp, Mus musculus
gaaagctttcactctctgacagt

SEQ ID NO: 202056 - DNA, 20 bp, Mus musculus
tgtatgtatgtatatgtata

SEQ ID NO: 202057 - DNA, 23 bp, Mus musculus
tgaaagagcaacaggaggtggct

SEQ ID NO: 202058 - DNA, 23 bp, Mus musculus
gaggcttgtgagcaagagaatgg

SEQ ID NO: 202059 - DNA, 23 bp, Mus musculus
tcacactgtctctatgtggtctc

SEQ ID NO: 202060 - DNA, 23 bp, Mus musculus
tccaactgtcagtcactgtgtgt

SEQ ID NO: 202061 - DNA, 22 bp, Mus musculus
tcttggcttagagacactcacc

SEQ ID NO: 202062 - DNA, 22 bp, Mus musculus
tgtaattccaagtccatgtcct

SEQ ID NO: 202063 - DNA, 23 bp, Mus musculus
cataatgtacatatgtgtgagtg

SEQ ID NO: 202064 - DNA, 22 bp, Mus musculus
gtgagagagctgggtgttggct

SEQ ID NO: 202065 - DNA, 23 bp, Mus musculus
tgggtgtctgtccctcagtgtca

SEQ ID NO: 202066 - DNA, 22 bp, Mus musculus
atgtgcatgtgcatgtgtgtgt

SEQ ID NO: 202067 - DNA, 20 bp, Mus musculus
tgtgtgtgcatgtgtatgca

SEQ ID NO: 202068 - DNA, 23 bp, Mus musculus
tgtgtgtgagcatgtgcatgtac

SEQ ID NO: 202069 - DNA, 23 bp, Mus musculus
tgtgtgtctgcatatgtatgcag

SEQ ID NO: 202070 - DNA, 23 bp, Mus musculus
atgtgtgtacatgtgtatgcagg

SEQ ID NO: 202071 - DNA, 21 bp, Mus musculus
tgtgtgtctgcatatgtatgc

SEQ ID NO: 202072 - DNA, 23 bp, Mus musculus
tctgcgtgtctgtgagtctgtga

SEQ ID NO: 202073 - DNA, 21 bp, Mus musculus
ttcagatcctggatcagtgag

SEQ ID NO: 202074 - DNA, 23 bp, Mus musculus
tgggtccctgcctggctctgtgg

SEQ ID NO: 202075 - DNA, 23 bp, Mus musculus
agtcattcagtcacttattcatt

SEQ ID NO: 202076 - DNA, 21 bp, Mus musculus
atcatgggagtgtgtgtgtgt

SEQ ID NO: 202077 - DNA, 21 bp, Mus musculus
tctgagactctgagaaaaccc

SEQ ID NO: 202078 - DNA, 23 bp, Mus musculus
caagccaggctcagtcacactct

SEQ ID NO: 202079 - DNA, 23 bp, Mus musculus
aagaaacatgtaggggggctgga

SEQ ID NO: 202080 - DNA, 23 bp, Mus musculus
tgtgtgtgcatgtgcatgtgtgt

SEQ ID NO: 202081 - DNA, 23 bp, Mus musculus
aatggaggctagagagatggctc

SEQ ID NO: 202082 - DNA, 23 bp, Mus musculus
tgacaggaacaacatccctgctc

SEQ ID NO: 202083 - DNA, 18 bp, Mus musculus
tccccgtgcttctgcatg

SEQ ID NO: 202084 - DNA, 22 bp, Mus musculus
ctacgtgtcagaagtcagagtg

SEQ ID NO: 202085 - DNA, 23 bp, Mus musculus
atgtatgtatgtatgtatgtgtg

SEQ ID NO: 202086 - DNA, 23 bp, Mus musculus
acttgtgacagagcagagttagg

SEQ ID NO: 202087 - DNA, 20 bp, Mus musculus
tgagtgaacacacacagcag

SEQ ID NO: 202088 - DNA, 18 bp, Mus musculus
tgcacatgtgtgtgtatg

SEQ ID NO: 202089 - DNA, 22 bp, Mus musculus
tatgcatgtgcatgtgcatgtg

SEQ ID NO: 202090 - DNA, 23 bp, Mus musculus
ttgtgtatgtgcatgtgcatgtg

SEQ ID NO: 202091 - DNA, 20 bp, Mus musculus
cagatgagtgggtggacaga

SEQ ID NO: 202092 - DNA, 19 bp, Mus musculus
attgaggcatctggggtgc

SEQ ID NO: 202093 - DNA, 23 bp, Mus musculus
ttgagacaccatctctcactgga

SEQ ID NO: 202094 - DNA, 21 bp, Mus musculus
atgccttcttcttgctctgtg

SEQ ID NO: 202095 - DNA, 23 bp, Mus musculus
atgtatgtagtagatggtgtatg

SEQ ID NO: 202096 - DNA, 18 bp, Mus musculus
tatgtatgtatgtatgta

SEQ ID NO: 202097 - DNA, 20 bp, Mus musculus
agagcaagctgtgtctctga

SEQ ID NO: 202098 - DNA, 20 bp, Mus musculus
agccagatgagagagaggac

SEQ ID NO: 202099 - DNA, 23 bp, Mus musculus
gtctggctgtgagccactgagga

SEQ ID NO: 202100 - DNA, 23 bp, Mus musculus
ctatgtcactgtctgccaggact

SEQ ID NO: 202101 - DNA, 19 bp, Mus musculus
tgtatgtatgtacatctat

SEQ ID NO: 202102 - DNA, 21 bp, Mus musculus
atccagtcttcttggctctct

SEQ ID NO: 202103 - DNA, 23 bp, Mus musculus
tctctgtctctatctgtctgtct

SEQ ID NO: 202104 - DNA, 23 bp, Mus musculus
accacatgaagaggggctggaga

SEQ ID NO: 202105 - DNA, 21 bp, Mus musculus
ctatgggtgtgaaatgggcta

SEQ ID NO: 202106 - DNA, 23 bp, Mus musculus
tgtgcatccgtctctgtgtctct

SEQ ID NO: 202107 - DNA, 18 bp, Mus musculus
gccagaggaagttgtcag

SEQ ID NO: 202108 - DNA, 20 bp, Mus musculus
tgtcttgctctgtcactctc

SEQ ID NO: 202109 - DNA, 21 bp, Mus musculus
actgactctccctctctttgg

SEQ ID NO: 202110 - DNA, 20 bp, Mus musculus
gacagaggtcactgtgcaca

SEQ ID NO: 202111 - DNA, 20 bp, Mus musculus
ggagcacatgttgggtggct

SEQ ID NO: 202112 - DNA, 19 bp, Mus musculus
atgtatgtatataagtgtg

SEQ ID NO: 202113 - DNA, 23 bp, Mus musculus
taattgctcagtgattaagttca

SEQ ID NO: 202114 - DNA, 23 bp, Mus musculus
tctgagtcagtgagtctgtctca

SEQ ID NO: 202115 - DNA, 23 bp, Mus musculus
caagtgactgagcagagagagga

SEQ ID NO: 202116 - DNA, 19 bp, Mus musculus
aaaggaagaggacctctga

SEQ ID NO: 202117 - DNA, 23 bp, Mus musculus
tgctgttgtgtgtctgtgtgcac

SEQ ID NO: 202118 - DNA, 22 bp, Mus musculus
cacatagtgagactctgtctct

SEQ ID NO: 202119 - DNA, 22 bp, Mus musculus
tatcatcatcatgagaagtgat

SEQ ID NO: 202120 - DNA, 23 bp, Mus musculus
atgagttaggttttctacctgtt

SEQ ID NO: 202121 - DNA, 22 bp, Mus musculus
ctgtgtaaatgaacacatacac

SEQ ID NO: 202122 - DNA, 19 bp, Mus musculus
tatgtgctgtgtgtgtata

SEQ ID NO: 202123 - DNA, 19 bp, Mus musculus
agacagatcagagagcggt

SEQ ID NO: 202124 - DNA, 22 bp, Mus musculus
tctgtcggtctgtccgtgtctg

SEQ ID NO: 202125 - DNA, 23 bp, Mus musculus
tactctctgctctctctgtgtgg

SEQ ID NO: 202126 - DNA, 23 bp, Mus musculus
tatgtatgtatgtatgtgtcagt

SEQ ID NO: 202127 - DNA, 23 bp, Mus musculus
tgtatgtgcatgtacatgtgtgt

SEQ ID NO: 202128 - DNA, 19 bp, Mus musculus
agaagctgacagcttctgg

SEQ ID NO: 202129 - DNA, 23 bp, Mus musculus
ggagttcaactactacagtgtct

SEQ ID NO: 202130 - DNA, 22 bp, Mus musculus
taatactgagagttagacttgt

SEQ ID NO: 202131 - DNA, 23 bp, Mus musculus
tgtctgtctgtctgtcttctgcg

SEQ ID NO: 202132 - DNA, 23 bp, Mus musculus
agacagtgagccaataggcttga

SEQ ID NO: 202133 - DNA, 20 bp, Mus musculus
gtgtatgtgtatgtgtatgg

SEQ ID NO: 202134 - DNA, 23 bp, Mus musculus
tatatgtatatgtatatgtatat

SEQ ID NO: 202135 - DNA, 23 bp, Mus musculus
caagcacagacagatttcagtgt

SEQ ID NO: 202136 - DNA, 20 bp, Mus musculus
ctaacatttaaatgctgtta

SEQ ID NO: 202137 - DNA, 21 bp, Mus musculus
tgtctctgtgggtacctgcat

SEQ ID NO: 202138 - DNA, 23 bp, Mus musculus
tttgcctgtgcatttgtcttgtt

SEQ ID NO: 202139 - DNA, 22 bp, Mus musculus
gagtcgaaagaagtctggaggc

SEQ ID NO: 202140 - DNA, 19 bp, Mus musculus
tccctgagaggacatggca

SEQ ID NO: 202141 - DNA, 22 bp, Mus musculus
cagactgaagtgaacatgtgca

SEQ ID NO: 202142 - DNA, 19 bp, Mus musculus
tgagcagcccagatgttgg

SEQ ID NO: 202143 - DNA, 19 bp, Mus musculus
taatgactgatttttttct

SEQ ID NO: 202144 - DNA, 22 bp, Mus musculus
tgaaagaggcagcccattgtga

SEQ ID NO: 202145 - DNA, 23 bp, Mus musculus
cctgcctgcctgcctgcctgcct

SEQ ID NO: 202146 - DNA, 21 bp, Mus musculus
tctgcctctcagtaactgtgt

SEQ ID NO: 202147 - DNA, 20 bp, Mus musculus
tgggtcctggcttctttggc

SEQ ID NO: 202148 - DNA, 21 bp, Mus musculus
tttttgttctagagttagcct

SEQ ID NO: 202149 - DNA, 22 bp, Mus musculus
tgggagaacagacagtgctcat

SEQ ID NO: 202150 - DNA, 21 bp, Mus musculus
acactggtgttttgcctggat

SEQ ID NO: 202151 - DNA, 18 bp, Mus musculus
tgtgagcttatcatcatg

SEQ ID NO: 202152 - DNA, 21 bp, Mus musculus
ctgagagaacacacagacctg

SEQ ID NO: 202153 - DNA, 23 bp, Mus musculus
tatgtgtatatgtatgtgtgtga

SEQ ID NO: 202154 - DNA, 22 bp, Mus musculus
tatgtgcaatttatatatgtgt

SEQ ID NO: 202155 - DNA, 21 bp, Mus musculus
ctacaggggctggagagatgg

SEQ ID NO: 202156 - DNA, 23 bp, Mus musculus
tagatgtcagtttccagagagag

SEQ ID NO: 202157 - DNA, 22 bp, Mus musculus
agaatgactttggggttggaga

SEQ ID NO: 202158 - DNA, 19 bp, Mus musculus
gtgtgtgtatgcatgagct

SEQ ID NO: 202159 - DNA, 19 bp, Mus musculus
aggcaggaggatctttagt

SEQ ID NO: 202160 - DNA, 23 bp, Mus musculus
gctcttcctctctgtgtctcagt

SEQ ID NO: 202161 - DNA, 23 bp, Mus musculus
ttcaccctggctttagtcacctt

SEQ ID NO: 202162 - DNA, 23 bp, Mus musculus
tggctctgtccctctctggctgc

SEQ ID NO: 202163 - DNA, 23 bp, Mus musculus
ctgacatcatcatccactgttca

SEQ ID NO: 202164 - DNA, 18 bp, Mus musculus
tctgtgtgagtcactctg

SEQ ID NO: 202165 - DNA, 23 bp, Mus musculus
agtccaatagttggttgtaaagt

SEQ ID NO: 202166 - DNA, 23 bp, Mus musculus
tctgtctcagtcaactgctggtt

SEQ ID NO: 202167 - DNA, 23 bp, Mus musculus
actgtgtctctgtttagtttctg

SEQ ID NO: 202168 - DNA, 22 bp, Mus musculus
atctgtccattgatgagagtgg

SEQ ID NO: 202169 - DNA, 23 bp, Mus musculus
tgacacagcctggaaatcaggtc

SEQ ID NO: 202170 - DNA, 20 bp, Mus musculus
acacagcctggatatcaggt

SEQ ID NO: 202171 - DNA, 19 bp, Mus musculus
tgccactctcagtcgctcc

SEQ ID NO: 202172 - DNA, 21 bp, Mus musculus
tgtgtgtgtgtatatatatac

SEQ ID NO: 202173 - DNA, 18 bp, Mus musculus
acaaagttaggggccact

SEQ ID NO: 202174 - DNA, 18 bp, Mus musculus
ggcaatttattgagaact

SEQ ID NO: 202175 - DNA, 21 bp, Mus musculus
ctctcacactctttctgctgt

SEQ ID NO: 202176 - DNA, 23 bp, Mus musculus
agagcactgacagctcttccaga

SEQ ID NO: 202177 - DNA, 23 bp, Mus musculus
ctgtctgactctgtctcttgagt

SEQ ID NO: 202178 - DNA, 23 bp, Mus musculus
gtgtggaaccaggtttcattgtg

SEQ ID NO: 202179 - DNA, 20 bp, Mus musculus
tctgtggctgagtctgtggg

SEQ ID NO: 202180 - DNA, 21 bp, Mus musculus
tgactagtgtctgattgtgat

SEQ ID NO: 202181 - DNA, 23 bp, Mus musculus
tgtgtcactctgaatttgtggtg

SEQ ID NO: 202182 - DNA, 23 bp, Mus musculus
agaagtactcagggagcaaagct

SEQ ID NO: 202183 - DNA, 23 bp, Mus musculus
cgctgagagaaatgagtgagctg

SEQ ID NO: 202184 - DNA, 23 bp, Mus musculus
tgtgtctcagtcactgttgtatg

SEQ ID NO: 202185 - DNA, 23 bp, Mus musculus
aggcagatctctgagagctcaag

SEQ ID NO: 202186 - DNA, 20 bp, Mus musculus
taagagcactgactgctctt

SEQ ID NO: 202187 - DNA, 23 bp, Mus musculus
tcgctcgctcgctcgctggctgc

SEQ ID NO: 202188 - DNA, 23 bp, Mus musculus
atttttgtgtatgcatgtgtatg

SEQ ID NO: 202189 - DNA, 23 bp, Mus musculus
aattgtgagacttaatgttttca

SEQ ID NO: 202190 - DNA, 23 bp, Mus musculus
tcagtgctcttgtgagcggtcat

SEQ ID NO: 202191 - DNA, 23 bp, Mus musculus
aatgactgccagctttggtgttg

SEQ ID NO: 202192 - DNA, 23 bp, Mus musculus
aatagtagtaggtagtaaactta

SEQ ID NO: 202193 - DNA, 23 bp, Mus musculus
atagatctttcttgatgttaaat

SEQ ID NO: 202194 - DNA, 23 bp, Mus musculus
tttcagactatatgttttctggt

SEQ ID NO: 202195 - DNA, 22 bp, Mus musculus
tatatgtgacaaggttattttt

SEQ ID NO: 202196 - DNA, 21 bp, Mus musculus
tccatggtggtctgataggat

SEQ ID NO: 202197 - DNA, 22 bp, Mus musculus
tgttttgtgaccaattatatgg

SEQ ID NO: 202198 - DNA, 21 bp, Mus musculus
tgtgggtctctgtcttatttc

SEQ ID NO: 202199 - DNA, 23 bp, Mus musculus
gatgtaagagcaagaagatggga

SEQ ID NO: 202200 - DNA, 19 bp, Mus musculus
tgcatatatatacacacat

SEQ ID NO: 202201 - DNA, 22 bp, Mus musculus
tttagtgtggttgagtagggtt

SEQ ID NO: 202202 - DNA, 20 bp, Mus musculus
ttaatgtggaggctggcaga

SEQ ID NO: 202203 - DNA, 23 bp, Mus musculus
ccctgccaccctctgtccctgcg

SEQ ID NO: 202204 - DNA, 22 bp, Mus musculus
atatgtgtatatgtatatatac

SEQ ID NO: 202205 - DNA, 18 bp, Mus musculus
atatatacacatattcaa

SEQ ID NO: 202206 - DNA, 19 bp, Mus musculus
agtgctccgcgtgcagcag

SEQ ID NO: 202207 - DNA, 23 bp, Mus musculus
gaagagcagtgactgctcttcca

SEQ ID NO: 202208 - DNA, 23 bp, Mus musculus
atatgtatatatatatgtgtgtg

SEQ ID NO: 202209 - DNA, 18 bp, Mus musculus
tgactgtgccccaggagc

SEQ ID NO: 202210 - DNA, 22 bp, Mus musculus
tatactttgagcataccccatg

SEQ ID NO: 202211 - DNA, 23 bp, Mus musculus
agaacttagaatttgctttgctg

SEQ ID NO: 202212 - DNA, 23 bp, Mus musculus
tatatgtatatgtatatgtgtgt

SEQ ID NO: 202213 - DNA, 21 bp, Mus musculus
ggcactctctgtctccattta

SEQ ID NO: 202214 - DNA, 23 bp, Mus musculus
aggcagtgtaattagctgattgt

SEQ ID NO: 202215 - DNA, 23 bp, Mus musculus
aggcagtgtagttagctgattgc

SEQ ID NO: 202216 - DNA, 23 bp, Mus musculus
acacagccaggtaaaaagactga

SEQ ID NO: 202217 - DNA, 20 bp, Mus musculus
tgagagggaggcctgcagca

SEQ ID NO: 202218 - DNA, 20 bp, Mus musculus
atgtggttgtaggaagcaaa

SEQ ID NO: 202219 - DNA, 23 bp, Mus musculus
gaatgtatgtataaatgtatgta

SEQ ID NO: 202220 - DNA, 20 bp, Mus musculus
caggcactgtgccagcctct

SEQ ID NO: 202221 - DNA, 21 bp, Mus musculus
tgtgtgtgtgtgtgcgtgtat

SEQ ID NO: 202222 - DNA, 22 bp, Mus musculus
acatgtgtttatgtatatgtgt

SEQ ID NO: 202223 - DNA, 23 bp, Mus musculus
gttatgtgtgtgaatgttttgcc

SEQ ID NO: 202224 - DNA, 23 bp, Mus musculus
acagagagtactgtgacagcaga

SEQ ID NO: 202225 - DNA, 21 bp, Mus musculus
gtatgtgcatgtgcctgtgca

SEQ ID NO: 202226 - DNA, 21 bp, Mus musculus
agatgtagtttgtctgtctgt

SEQ ID NO: 202227 - DNA, 23 bp, Mus musculus
actgtctcagtgacttgtttaca

SEQ ID NO: 202228 - DNA, 23 bp, Mus musculus
tctctctgactgctttaattttc

SEQ ID NO: 202229 - DNA, 23 bp, Mus musculus
gcctctgtccctccatctctgtg

SEQ ID NO: 202230 - DNA, 18 bp, Mus musculus
tacatacacacactgata

SEQ ID NO: 202231 - DNA, 23 bp, Mus musculus
aaagtagatgatgtgggccggag

SEQ ID NO: 202232 - DNA, 22 bp, Mus musculus
tgttttgtgaccaattatatgg

SEQ ID NO: 202233 - DNA, 23 bp, Mus musculus
agacagcacagactgtggaccac

SEQ ID NO: 202234 - DNA, 20 bp, Mus musculus
agacagcacagactgtgggc

SEQ ID NO: 202235 - DNA, 22 bp, Mus musculus
agacagcacagactgtgggcca

SEQ ID NO: 202236 - DNA, 23 bp, Mus musculus
tcacagtcctggaagatctgctt

SEQ ID NO: 202237 - DNA, 21 bp, Mus musculus
cactgactgtctgactgtgga

SEQ ID NO: 202238 - DNA, 19 bp, Mus musculus
aggtggagagactggacct

SEQ ID NO: 202239 - DNA, 23 bp, Mus musculus
tgactgtctctgtgcctgagaga

SEQ ID NO: 202240 - DNA, 19 bp, Mus musculus
tcgcagttatcagtggcgt

SEQ ID NO: 202241 - DNA, 23 bp, Mus musculus
actgtctgtctggttctagtgac

SEQ ID NO: 202242 - DNA, 19 bp, Mus musculus
gtgtccctctcagtgactc

SEQ ID NO: 202243 - DNA, 23 bp, Mus musculus
tgacaggattggatattgagaag

SEQ ID NO: 202244 - DNA, 22 bp, Mus musculus
tgagagttgagtgtgatgccac

SEQ ID NO: 202245 - DNA, 21 bp, Mus musculus
cacagaggtctgagtgctcac

SEQ ID NO: 202246 - DNA, 18 bp, Mus musculus
atgtgtatacatgcattg

SEQ ID NO: 202247 - DNA, 23 bp, Mus musculus
tatacatagatatgtatagttat

SEQ ID NO: 202248 - DNA, 22 bp, Mus musculus
ctgtgtgagtgtgtctgtgtat

SEQ ID NO: 202249 - DNA, 22 bp, Mus musculus
tgcctagcagacagtgagcact

SEQ ID NO: 202250 - DNA, 21 bp, Mus musculus
tccatggtggtctgataggat

SEQ ID NO: 202251 - DNA, 23 bp, Mus musculus
tgtgagtgtgtgtgtgcaagtgc

SEQ ID NO: 202252 - DNA, 19 bp, Mus musculus
tggtatgtatatatgtatg

SEQ ID NO: 202253 - DNA, 23 bp, Mus musculus
aatgtctttgctattgtacttca

SEQ ID NO: 202254 - DNA, 19 bp, Mus musculus
agagagacattggacttgg

SEQ ID NO: 202255 - DNA, 22 bp, Mus musculus
aacagtggatcttcagcagctt

SEQ ID NO: 202256 - DNA, 23 bp, Mus musculus
atttcatgatgatctgataggat

SEQ ID NO: 202257 - DNA, 21 bp, Mus musculus
tgttttgtgaccaattatgtg

SEQ ID NO: 202258 - DNA, 20 bp, Mus musculus
tggatttggacttgggtact

SEQ ID NO: 202259 - DNA, 23 bp, Mus musculus
ctctctctctctggctgcaggac

SEQ ID NO: 202260 - DNA, 21 bp, Mus musculus
ggtttagttggaagagagagg

SEQ ID NO: 202261 - DNA, 23 bp, Mus musculus
gagagggtgtgacgctgctttct

SEQ ID NO: 202262 - DNA, 23 bp, Mus musculus
atttcacagccactgttctctct

SEQ ID NO: 202263 - DNA, 18 bp, Mus musculus
ttcagctaccaattctag

SEQ ID NO: 202264 - DNA, 23 bp, Mus musculus
actcactgactgctcttccagag

SEQ ID NO: 202265 - DNA, 20 bp, Mus musculus
gtctctgtctgaccctcagt

SEQ ID NO: 202266 - DNA, 23 bp, Mus musculus
tgcgtgtgtgtatgtatatatgt

SEQ ID NO: 202267 - DNA, 23 bp, Mus musculus
ctgacacactggcagacactgtg

SEQ ID NO: 202268 - DNA, 23 bp, Mus musculus
tatctgtctgtctgtctgtctgt

SEQ ID NO: 202269 - DNA, 23 bp, Mus musculus
tctgactgagagtagaggcatag

SEQ ID NO: 202270 - DNA, 23 bp, Mus musculus
tgtgcatgttcatgtgtgtgcta

SEQ ID NO: 202271 - DNA, 23 bp, Mus musculus
ctcagagtctctgtttcttattc

SEQ ID NO: 202272 - DNA, 23 bp, Mus musculus
gcagagagccagctttgatgtga

SEQ ID NO: 202273 - DNA, 23 bp, Mus musculus
ttatcctgccttttcttcgtgtg

SEQ ID NO: 202274 - DNA, 23 bp, Mus musculus
gtgtgtgtgcatgtgcatgggta

SEQ ID NO: 202275 - DNA, 23 bp, Mus musculus
tgagtccctctgtgcctgtggta

SEQ ID NO: 202276 - DNA, 20 bp, Mus musculus
cgtgtgtgcatatgtatgtg

SEQ ID NO: 202277 - DNA, 18 bp, Mus musculus
agacagacacacccactg

SEQ ID NO: 202278 - DNA, 23 bp, Mus musculus
ctctcagagaaaggatgtctgtg

SEQ ID NO: 202279 - DNA, 23 bp, Mus musculus
tatgtgtgtatatgtatgtatat

SEQ ID NO: 202280 - DNA, 21 bp, Mus musculus
ccctgactgctcttccagtgg

SEQ ID NO: 202281 - DNA, 21 bp, Mus musculus
acaggaagtaagtttctgtct

SEQ ID NO: 202282 - DNA, 23 bp, Mus musculus
tctgtcttagtcactcttctgtt

SEQ ID NO: 202283 - DNA, 18 bp, Mus musculus
cagagacgaagtgttgcc

SEQ ID NO: 202284 - DNA, 23 bp, Mus musculus
gtggtagtctactgttttaattc

SEQ ID NO: 202285 - DNA, 23 bp, Mus musculus
gagacaggaaaagtgtgagctag

SEQ ID NO: 202286 - DNA, 23 bp, Mus musculus
ttatgtgtgtgtgtgtgtacatg

SEQ ID NO: 202287 - DNA, 21 bp, Mus musculus
atatatgtgtgtgtgtagata

SEQ ID NO: 202288 - DNA, 18 bp, Mus musculus
aggggctggagagatggt

SEQ ID NO: 202289 - DNA, 20 bp, Mus musculus
aagagcactgactgctcttc

SEQ ID NO: 202290 - DNA, 21 bp, Mus musculus
aaggtgaggtgcaggagttaa

SEQ ID NO: 202291 - DNA, 22 bp, Mus musculus
actgaagagagatggctcagtg

SEQ ID NO: 202292 - DNA, 23 bp, Mus musculus
tcacctactcaaagcctctctct

SEQ ID NO: 202293 - DNA, 22 bp, Mus musculus
actcagtccctgcctctgtgtg

SEQ ID NO: 202294 - DNA, 21 bp, Mus musculus
tatatgtatgtatatatgtgt

SEQ ID NO: 202295 - DNA, 23 bp, Mus musculus
tgtacagatgtatgtatatatgt

SEQ ID NO: 202296 - DNA, 19 bp, Mus musculus
tcagccaagactgtgtcca

SEQ ID NO: 202297 - DNA, 20 bp, Mus musculus
tgcatgtatgtatgtatgta

SEQ ID NO: 202298 - DNA, 21 bp, Mus musculus
gtatgcatgtatgtatgtatg

SEQ ID NO: 202299 - DNA, 20 bp, Mus musculus
tgtatgtgtgcatgtgtatg

SEQ ID NO: 202300 - DNA, 23 bp, Mus musculus
gtgtgtgtatgtgtgcatgtgta

SEQ ID NO: 202301 - DNA, 23 bp, Mus musculus
agtttaagagcactcgctgctcg

SEQ ID NO: 202302 - DNA, 22 bp, Mus musculus
agtggagatggtggtgaaggtc

SEQ ID NO: 202303 - DNA, 23 bp, Mus musculus
cacagtactcagtcacaatactc

SEQ ID NO: 202304 - DNA, 23 bp, Mus musculus
tctgtctgtctgtctgtctcctt

SEQ ID NO: 202305 - DNA, 23 bp, Mus musculus
taacttcatcatctcctgactgt

SEQ ID NO: 202306 - DNA, 19 bp, Mus musculus
acagaatttcttttaatag

SEQ ID NO: 202307 - DNA, 23 bp, Mus musculus
agatcgtgctgtttttggtttgt

SEQ ID NO: 202308 - DNA, 23 bp, Mus musculus
tttggaaatttatatgtacatga

SEQ ID NO: 202309 - DNA, 23 bp, Mus musculus
tctgtgagactgtgtttgttgac

SEQ ID NO: 202310 - DNA, 23 bp, Mus musculus
tcagttgtcaggtgcagcgtgag

SEQ ID NO: 202311 - DNA, 23 bp, Mus musculus
tatgtatgtatgcatgtgtgtgt

SEQ ID NO: 202312 - DNA, 23 bp, Mus musculus
agttagagactctgctttcaatt

SEQ ID NO: 202313 - DNA, 21 bp, Mus musculus
atgtatgtatgtatgtgtgag

SEQ ID NO: 202314 - DNA, 23 bp, Mus musculus
cactggctatctgtctgtcttaa

SEQ ID NO: 202315 - DNA, 18 bp, Mus musculus
gtgagagaaaggactgtg

SEQ ID NO: 202316 - DNA, 19 bp, Mus musculus
aggctgttggatgttttct

SEQ ID NO: 202317 - DNA, 23 bp, Mus musculus
ttcctgtctctctgactcccagc

SEQ ID NO: 202318 - DNA, 23 bp, Mus musculus
tatgtttgcatatgtatgtgcat

SEQ ID NO: 202319 - DNA, 23 bp, Mus musculus
gttcacatgtgtgtatgtgttca

SEQ ID NO: 202320 - DNA, 18 bp, Mus musculus
tagatactaactgtatag

SEQ ID NO: 202321 - DNA, 23 bp, Mus musculus
gtcagcatgtctgtctgtctgtg

SEQ ID NO: 202322 - DNA, 23 bp, Mus musculus
tcttctctctggaagagatgtgt

SEQ ID NO: 202323 - DNA, 23 bp, Mus musculus
tgtgtgtgtctgtcattccagag

SEQ ID NO: 202324 - DNA, 23 bp, Mus musculus
gcatgtttacatgagtgtatgac

SEQ ID NO: 202325 - DNA, 23 bp, Mus musculus
gtgtatatgcatgtggatgtgta

SEQ ID NO: 202326 - DNA, 22 bp, Mus musculus
tatggactgtggatgtaaagtg

SEQ ID NO: 202327 - DNA, 23 bp, Mus musculus
tggctgcctgtgtgcctgtaacc

SEQ ID NO: 202328 - DNA, 19 bp, Mus musculus
tgggtcagtagcctgatgg

SEQ ID NO: 202329 - DNA, 20 bp, Mus musculus
acacagtgcagagcctcctc

SEQ ID NO: 202330 - DNA, 21 bp, Mus musculus
tgagatgattctgagtcctct

SEQ ID NO: 202331 - DNA, 23 bp, Mus musculus
tgtctcactgaaatccactgtga

SEQ ID NO: 202332 - DNA, 22 bp, Mus musculus
agtggctggcagtgtggatcgc

SEQ ID NO: 202333 - DNA, 23 bp, Mus musculus
tgagacaagtcagacaggaaggg

SEQ ID NO: 202334 - DNA, 23 bp, Mus musculus
aaagtgcttgaccaagtgcaggt

SEQ ID NO: 202335 - DNA, 20 bp, Mus musculus
catgtctactgttattcatg

SEQ ID NO: 202336 - DNA, 21 bp, Mus musculus
atactgagagttttccttgat

SEQ ID NO: 202337 - DNA, 18 bp, Mus musculus
cagggtctctctctgtca

SEQ ID NO: 202338 - DNA, 21 bp, Mus musculus
gtgactcacaatctatatagc

SEQ ID NO: 202339 - DNA, 23 bp, Mus musculus
gtatatgtatgtatgtatgtgtg

SEQ ID NO: 202340 - DNA, 18 bp, Mus musculus
tatttttttcaatttctt

SEQ ID NO: 202341 - DNA, 20 bp, Mus musculus
tgcatgtatgtatgtatgta

SEQ ID NO: 202342 - DNA, 23 bp, Mus musculus
tgtatatatgtatacatgatgca

SEQ ID NO: 202343 - DNA, 22 bp, Mus musculus
tgttttgtgaccaattatatgg

SEQ ID NO: 202344 - DNA, 23 bp, Mus musculus
agtctccatctctgtctctaatt

SEQ ID NO: 202345 - DNA, 23 bp, Mus musculus
atatatagaggatttgatctgaa

SEQ ID NO: 202346 - DNA, 20 bp, Mus musculus
acactgagcattgtgagtcc

SEQ ID NO: 202347 - DNA, 18 bp, Mus musculus
acacagtgtcacttcctt

SEQ ID NO: 202348 - DNA, 23 bp, Mus musculus
tccattgttttactgtttgggtg

SEQ ID NO: 202349 - DNA, 23 bp, Mus musculus
catctgtctcagtcagttactgt

SEQ ID NO: 202350 - DNA, 22 bp, Mus musculus
tgttttgtgaccaattatatgg

SEQ ID NO: 202351 - DNA, 22 bp, Mus musculus
attacagtgaaagaattgagtg

SEQ ID NO: 202352 - DNA, 21 bp, Mus musculus
tgaatagtagttattttcatg

SEQ ID NO: 202353 - DNA, 22 bp, Mus musculus
tgttttgtgaccaattatatgg

SEQ ID NO: 202354 - DNA, 23 bp, Mus musculus
tgtctctgtctctgtctatctat

SEQ ID NO: 202355 - DNA, 21 bp, Mus musculus
tccatggtggtctgataggat

SEQ ID NO: 202356 - DNA, 20 bp, Mus musculus
atatgtagatgtatatacat

SEQ ID NO: 202357 - DNA, 23 bp, Mus musculus
tgtgtctctgtttagattctgct

SEQ ID NO: 202358 - DNA, 22 bp, Mus musculus
tgttttgtgaccaattatatgg

SEQ ID NO: 202359 - DNA, 23 bp, Mus musculus
atgagctagttataatatgtgct

SEQ ID NO: 202360 - DNA, 20 bp, Mus musculus
taaatgtgtgtgattgatat

SEQ ID NO: 202361 - DNA, 22 bp, Mus musculus
gactaactacttcatgctgaaa

SEQ ID NO: 202362 - DNA, 23 bp, Mus musculus
actagcagtgtctctgtttggtg

SEQ ID NO: 202363 - DNA, 18 bp, Mus musculus
ttctccaaaagggaaact

SEQ ID NO: 202364 - DNA, 23 bp, Mus musculus
tggcacgctcagtggctcagtgg

SEQ ID NO: 202365 - DNA, 23 bp, Mus musculus
tatgtatgtgcattttttaactg

SEQ ID NO: 202366 - DNA, 23 bp, Mus musculus
tcctcacttctcactccgtcagc

SEQ ID NO: 202367 - DNA, 21 bp, Mus musculus
ctgactggctctctccctgtg

SEQ ID NO: 202368 - DNA, 20 bp, Mus musculus
tatatgtgtatatatgatgt

SEQ ID NO: 202369 - DNA, 22 bp, Mus musculus
acaattgcaatgagtcattgat

SEQ ID NO: 202370 - DNA, 23 bp, Mus musculus
gtatctgtctgtctgcctgcctg

SEQ ID NO: 202371 - DNA, 20 bp, Mus musculus
tgagaaggaagacatggcgt

SEQ ID NO: 202372 - DNA, 23 bp, Mus musculus
cacatttcactctgtctcagtgc

SEQ ID NO: 202373 - DNA, 22 bp, Mus musculus
tcagtactagatcctcagctga

SEQ ID NO: 202374 - DNA, 23 bp, Mus musculus
agtggttattcaacagttaatgg

SEQ ID NO: 202375 - DNA, 23 bp, Mus musculus
ctgtctgtctgtctgtctgtctg

SEQ ID NO: 202376 - DNA, 22 bp, Mus musculus
tgttttgtgaccaattatatgg

SEQ ID NO: 202377 - DNA, 18 bp, Mus musculus
tcagaagttagacaccag

SEQ ID NO: 202378 - DNA, 22 bp, Mus musculus
tgttttgtgaccaattatatgg

SEQ ID NO: 202379 - DNA, 20 bp, Mus musculus
tctctctcagcaaccattga

SEQ ID NO: 202380 - DNA, 20 bp, Mus musculus
atgtgtgtgtgtgtatatat

SEQ ID NO: 202381 - DNA, 23 bp, Mus musculus
acagacagtactcactcagtgca

SEQ ID NO: 202382 - DNA, 23 bp, Mus musculus
atctgactgtctctgatactccc

SEQ ID NO: 202383 - DNA, 23 bp, Mus musculus
tgcctgcctgtctgcctgcctct

SEQ ID NO: 202384 - DNA, 23 bp, Mus musculus
gcacgtgtgtgtgtctgtgtgtt

SEQ ID NO: 202385 - DNA, 23 bp, Mus musculus
cagacagacagcagacagaaggc

SEQ ID NO: 202386 - DNA, 22 bp, Mus musculus
aatttgactgcttctggatctg

SEQ ID NO: 202387 - DNA, 23 bp, Mus musculus
acagagagagaattgcatagtga

SEQ ID NO: 202388 - DNA, 23 bp, Mus musculus
ctatgcatttctctctgtgtgtc

SEQ ID NO: 202389 - DNA, 23 bp, Mus musculus
gtgtatatgcttgtgtgtgtgtg

SEQ ID NO: 202390 - DNA, 23 bp, Mus musculus
ttttttgttttactaggtgtcag

SEQ ID NO: 202391 - DNA, 20 bp, Mus musculus
tatatgtatgtatatatgtg

SEQ ID NO: 202392 - DNA, 22 bp, Mus musculus
tgttttgtgaccaattatatgg

SEQ ID NO: 202393 - DNA, 22 bp, Mus musculus
tgttttgtgaccaattatatgg

SEQ ID NO: 202394 - DNA, 23 bp, Mus musculus
tatgcatgtatgtgtgtgtatgt

SEQ ID NO: 202395 - DNA, 23 bp, Mus musculus
aagagagaatacagagaggtcct

SEQ ID NO: 202396 - DNA, 20 bp, Mus musculus
gtgagcatccacttctctgt

SEQ ID NO: 202397 - DNA, 23 bp, Mus musculus
aaaaattacattcagattccaca

SEQ ID NO: 202398 - DNA, 22 bp, Mus musculus
tgtgtctgtttgtcaattcatc

SEQ ID NO: 202399 - DNA, 23 bp, Mus musculus
acaaggttgtttagtacatggaa

SEQ ID NO: 202400 - DNA, 23 bp, Mus musculus
tggagcatgttgctctgaatgga

SEQ ID NO: 202401 - DNA, 22 bp, Mus musculus
tatctgcatgactgtttgtata

SEQ ID NO: 202402 - DNA, 22 bp, Mus musculus
tgtgtgcatttgtgtgtgtaga

SEQ ID NO: 202403 - DNA, 20 bp, Mus musculus
atgtgcatatatatacatat

SEQ ID NO: 202404 - DNA, 22 bp, Mus musculus
tgttttgtgaccaattatatgg

SEQ ID NO: 202405 - DNA, 23 bp, Mus musculus
ttacactatatgttctgacaaag

SEQ ID NO: 202406 - DNA, 20 bp, Mus musculus
tttgtcccactgtataaggt

SEQ ID NO: 202407 - DNA, 23 bp, Mus musculus
tatgtgaatatatgtatatgtgt

SEQ ID NO: 202408 - DNA, 23 bp, Mus musculus
gtctgtgtgtctgtgtgtgatgc

SEQ ID NO: 202409 - DNA, 22 bp, Mus musculus
atagaggagagaagccactgca

SEQ ID NO: 202410 - DNA, 23 bp, Mus musculus
tccacacagaggtcttcagtaag

SEQ ID NO: 202411 - DNA, 23 bp, Mus musculus
gaacgctgactgctcttccagag

SEQ ID NO: 202412 - DNA, 22 bp, Mus musculus
gaatggatgtctctgtctctct

SEQ ID NO: 202413 - DNA, 22 bp, Mus musculus
tgctgggtcacacagtgtctgt

SEQ ID NO: 202414 - DNA, 21 bp, Mus musculus
attccaaagaagacaggtgta

SEQ ID NO: 202415 - DNA, 23 bp, Mus musculus
aaagttgtctggatctggaattg

SEQ ID NO: 202416 - DNA, 22 bp, Mus musculus
attactgtttcagctctggctt

SEQ ID NO: 202417 - DNA, 23 bp, Mus musculus
agcatataaagcatggataatgt

SEQ ID NO: 202418 - DNA, 21 bp, Mus musculus
gaactctggagaagcaggagg

SEQ ID NO: 202419 - DNA, 19 bp, Mus musculus
atgtatgtatgtatgtacg

SEQ ID NO: 202420 - DNA, 23 bp, Mus musculus
gagaagttacagagcagcacaca

SEQ ID NO: 202421 - DNA, 23 bp, Mus musculus
ctcactgctgtctctgtctctcc

SEQ ID NO: 202422 - DNA, 23 bp, Mus musculus
ctaacttcattttctactgtttt

SEQ ID NO: 202423 - DNA, 21 bp, Mus musculus
agaagaagagtagtttgatgg

SEQ ID NO: 202424 - DNA, 23 bp, Mus musculus
tatgtcagaggaaagtcataggg

SEQ ID NO: 202425 - DNA, 23 bp, Mus musculus
ttgtgtctgtctctgtatctcat

SEQ ID NO: 202426 - DNA, 21 bp, Mus musculus
gggactgtggtttgctggtgg

SEQ ID NO: 202427 - DNA, 23 bp, Mus musculus
agatagcatgtacaaatgtatat

SEQ ID NO: 202428 - DNA, 22 bp, Mus musculus
gtatgtatgtatgtatgtatgt

SEQ ID NO: 202429 - DNA, 21 bp, Mus musculus
cgctgactgctcttccagagg

SEQ ID NO: 202430 - DNA, 22 bp, Mus musculus
tatgtgtgtgatagttggcagt

SEQ ID NO: 202431 - DNA, 23 bp, Mus musculus
ctgactgactgactgactgactg

SEQ ID NO: 202432 - DNA, 22 bp, Mus musculus
agtcagtctactcttgctgctg

SEQ ID NO: 202433 - DNA, 23 bp, Mus musculus
ctgttttctgggagtccttctgg

SEQ ID NO: 202434 - DNA, 18 bp, Mus musculus
tagagagactgctcaact

SEQ ID NO: 202435 - DNA, 21 bp, Mus musculus
tgtgcatgcacttaccagcaa

SEQ ID NO: 202436 - DNA, 23 bp, Mus musculus
cagtacactgtgcacagacagcc

SEQ ID NO: 202437 - DNA, 23 bp, Mus musculus
acagaggatggagaaggtaagat

SEQ ID NO: 202438 - DNA, 20 bp, Mus musculus
aataccagcgtatccctgag

SEQ ID NO: 202439 - DNA, 23 bp, Mus musculus
gaagacagtgagcagattctgga

SEQ ID NO: 202440 - DNA, 21 bp, Mus musculus
aacacttttgtatttgttgtt

SEQ ID NO: 202441 - DNA, 23 bp, Mus musculus
gttgaatgaccctcctctctctg

SEQ ID NO: 202442 - DNA, 18 bp, Mus musculus
atttgtgtatcacgtagg

SEQ ID NO: 202443 - DNA, 22 bp, Mus musculus
agcacatgttcctgaacagaga

SEQ ID NO: 202444 - DNA, 23 bp, Mus musculus
cgtcacactcactcacaggccct

SEQ ID NO: 202445 - DNA, 23 bp, Mus musculus
atatgtgtacatgtacctatgca

SEQ ID NO: 202446 - DNA, 23 bp, Mus musculus
aaagtaatgagatagagtaaacg

SEQ ID NO: 202447 - DNA, 18 bp, Mus musculus
tagcttatgtgttttctc

SEQ ID NO: 202448 - DNA, 23 bp, Mus musculus
gtttaagagcactgactgctctt

SEQ ID NO: 202449 - DNA, 23 bp, Mus musculus
aaaggtcaactttcctgttacag

SEQ ID NO: 202450 - DNA, 23 bp, Mus musculus
tgtctgtctgtctgtctgcctgt

SEQ ID NO: 202451 - DNA, 23 bp, Mus musculus
cagtctgtttgatttggattctg

SEQ ID NO: 202452 - DNA, 23 bp, Mus musculus
gtctgtccctctgtctgtccctc

SEQ ID NO: 202453 - DNA, 23 bp, Mus musculus
gtctgtctgtctgtctctctgta

SEQ ID NO: 202454 - DNA, 23 bp, Mus musculus
ctgtcgctgagtgactactgtgc

SEQ ID NO: 202455 - DNA, 19 bp, Mus musculus
tgtatgcatgcatgtatgt

SEQ ID NO: 202456 - DNA, 18 bp, Mus musculus
tctatgtatatatgtatg

SEQ ID NO: 202457 - DNA, 20 bp, Mus musculus
taagtctctggcaggttgct

SEQ ID NO: 202458 - DNA, 23 bp, Mus musculus
tctctgcaacaggatctggagct

SEQ ID NO: 202459 - DNA, 23 bp, Mus musculus
tagtccatggtgatctgatagga

SEQ ID NO: 202460 - DNA, 22 bp, Mus musculus
tgttttgtgaccaattatatgg

SEQ ID NO: 202461 - DNA, 22 bp, Mus musculus
ctttaggttgggaaagttttct

SEQ ID NO: 202462 - DNA, 23 bp, Mus musculus
tggctcactgtctgaggctatgt

SEQ ID NO: 202463 - DNA, 23 bp, Mus musculus
actctcgttccatgtcttattca

SEQ ID NO: 202464 - DNA, 20 bp, Mus musculus
atctatgcatgtctgtgcat

SEQ ID NO: 202465 - DNA, 23 bp, Mus musculus
atacaacacacacaggtcagaag

SEQ ID NO: 202466 - DNA, 23 bp, Mus musculus
cccttgtagatggttgtgagtca

SEQ ID NO: 202467 - DNA, 23 bp, Mus musculus
attagcaagactaattctgtagt

SEQ ID NO: 202468 - DNA, 22 bp, Mus musculus
tggaaagtaatgttgtatgaag

SEQ ID NO: 202469 - DNA, 23 bp, Mus musculus
ttctctctgaatatcctgtctgt

SEQ ID NO: 202470 - DNA, 21 bp, Mus musculus
aaggagaggagttggaattgg

SEQ ID NO: 202471 - DNA, 20 bp, Mus musculus
tgtgtgtgcacacccacaca

SEQ ID NO: 202472 - DNA, 23 bp, Mus musculus
gtgtatatgtgcatgtgtatgtg

SEQ ID NO: 202473 - DNA, 19 bp, Mus musculus
gtgtgagtggtatcctggt

SEQ ID NO: 202474 - DNA, 23 bp, Mus musculus
tctgccactcagtttctctcagc

SEQ ID NO: 202475 - DNA, 19 bp, Mus musculus
ctgtacatgtgtatatatg

SEQ ID NO: 202476 - DNA, 23 bp, Mus musculus
gtgtgtgtgtatgtatatatgtg

SEQ ID NO: 202477 - DNA, 23 bp, Mus musculus
tatgtatgtatgtgtgtatgtat

SEQ ID NO: 202478 - DNA, 23 bp, Mus musculus
agaatcctgaagtacctgggatg

SEQ ID NO: 202479 - DNA, 23 bp, Mus musculus
tccctcacccagctttgatctgc

SEQ ID NO: 202480 - DNA, 21 bp, Mus musculus
gtgagtggatggccagatgga

SEQ ID NO: 202481 - DNA, 23 bp, Mus musculus
acacacacacacatgtgcgcact

SEQ ID NO: 202482 - DNA, 23 bp, Mus musculus
gaatgtatacatgtatgtatgtg

SEQ ID NO: 202483 - DNA, 23 bp, Mus musculus
tgtgtatgagtctacttgagtat

SEQ ID NO: 202484 - DNA, 21 bp, Mus musculus
atgtgaatacatgcaagtatg

SEQ ID NO: 202485 - DNA, 23 bp, Mus musculus
ctctcagtgagatctagaattca

SEQ ID NO: 202486 - DNA, 23 bp, Mus musculus
acatctgcaattcttttcagagt

SEQ ID NO: 202487 - DNA, 21 bp, Mus musculus
agacttgatttagaaaggtga

SEQ ID NO: 202488 - DNA, 21 bp, Mus musculus
tgtgtatatatgtgtgtgcat

SEQ ID NO: 202489 - DNA, 22 bp, Mus musculus
atgggacaagtacaaagcacct

SEQ ID NO: 202490 - DNA, 20 bp, Mus musculus
gtatgcatgcatgtgtgtgt

SEQ ID NO: 202491 - DNA, 23 bp, Mus musculus
ctctctctctgtgtgtgtgtgta

SEQ ID NO: 202492 - DNA, 23 bp, Mus musculus
tgtatatatgtatatatgtgtgt

SEQ ID NO: 202493 - DNA, 23 bp, Mus musculus
tacatgtgtgcatatgtgtatgt

SEQ ID NO: 202494 - DNA, 22 bp, Mus musculus
acatatatatacatgtatatgt

SEQ ID NO: 202495 - DNA, 23 bp, Mus musculus
atgtgtgtgtgcttgtgcatgtg

SEQ ID NO: 202496 - DNA, 21 bp, Mus musculus
tgtatgtataagtatgtgtat

SEQ ID NO: 202497 - DNA, 23 bp, Mus musculus
agcttatctctttgtcccgttgc

SEQ ID NO: 202498 - DNA, 23 bp, Mus musculus
caggattgaagtgagcttgctga

SEQ ID NO: 202499 - DNA, 21 bp, Mus musculus
tgtcttgagactcaaagtgtt

SEQ ID NO: 202500 - DNA, 23 bp, Mus musculus
gtatgagtcgctcggtcagtctc

SEQ ID NO: 202501 - DNA, 23 bp, Mus musculus
tttacagtggatatagtgactca

SEQ ID NO: 202502 - DNA, 23 bp, Mus musculus
gatctgtgtctcagtgtctcact

SEQ ID NO: 202503 - DNA, 21 bp, Mus musculus
tgtctttgaagggacttggaa

SEQ ID NO: 202504 - DNA, 22 bp, Mus musculus
cacagggttacatttcacaggg

SEQ ID NO: 202505 - DNA, 18 bp, Mus musculus
tggtcagagacagaggtg

SEQ ID NO: 202506 - DNA, 19 bp, Mus musculus
ctttgtatgtatatatgta

SEQ ID NO: 202507 - DNA, 23 bp, Mus musculus
gtccctaagaagacagagagcac

SEQ ID NO: 202508 - DNA, 23 bp, Mus musculus
tcctggaactcactctgaagttt

SEQ ID NO: 202509 - DNA, 19 bp, Mus musculus
ttcagagaagaaactcagc

SEQ ID NO: 202510 - DNA, 23 bp, Mus musculus
tccatatatgtgtctgttcatgt

SEQ ID NO: 202511 - DNA, 22 bp, Mus musculus
tactatgtacttatgtatgtat

SEQ ID NO: 202512 - DNA, 21 bp, Mus musculus
atcagaggattaatctgtgcc

SEQ ID NO: 202513 - DNA, 21 bp, Mus musculus
atgtgtgtgtgcatgtgcatg

SEQ ID NO: 202514 - DNA, 22 bp, Mus musculus
tatgagtgtagacagaggtcag

SEQ ID NO: 202515 - DNA, 23 bp, Mus musculus
aagagaagacagttagctgtccc

SEQ ID NO: 202516 - DNA, 23 bp, Mus musculus
tgtgtgcctgtgtgtgtgcctgt

SEQ ID NO: 202517 - DNA, 21 bp, Mus musculus
tgactgatgtgagtaacctca

SEQ ID NO: 202518 - DNA, 20 bp, Mus musculus
aagcagcataggcagctgga

SEQ ID NO: 202519 - DNA, 23 bp, Mus musculus
cccagtgttcagactacctgttc

SEQ ID NO: 202520 - DNA, 23 bp, Mus musculus
gtacagtagtctgcacattggtt

SEQ ID NO: 202521 - DNA, 23 bp, Mus musculus
tgtgtatgtatatatatatgtat

SEQ ID NO: 202522 - DNA, 22 bp, Mus musculus
tgtgtacatatgtgtgtgtata

SEQ ID NO: 202523 - DNA, 21 bp, Mus musculus
tgtgtgtatatgtgtgtgtat

SEQ ID NO: 202524 - DNA, 22 bp, Mus musculus
acacacacacgtatccatatga

SEQ ID NO: 202525 - DNA, 19 bp, Mus musculus
agagaaagaagtctgcaga

SEQ ID NO: 202526 - DNA, 21 bp, Mus musculus
tgcctcagtttccagttagtt

SEQ ID NO: 202527 - DNA, 23 bp, Mus musculus
tgtctctgtctctgtgtctgtct

SEQ ID NO: 202528 - DNA, 23 bp, Mus musculus
gcctctctctgactgagactggg

SEQ ID NO: 202529 - DNA, 23 bp, Mus musculus
tctgcctgcctgcctgcctgcct

SEQ ID NO: 202530 - DNA, 23 bp, Mus musculus
tctgactcagtgtgatttcagca

SEQ ID NO: 202531 - DNA, 21 bp, Mus musculus
tggtgagttcaggggatcgtg

SEQ ID NO: 202532 - DNA, 23 bp, Mus musculus
gcactaccacactcactgtgact

SEQ ID NO: 202533 - DNA, 19 bp, Mus musculus
tgtgggtctgtctgtgact

SEQ ID NO: 202534 - DNA, 22 bp, Mus musculus
tgactgactgactgacagccag

SEQ ID NO: 202535 - DNA, 23 bp, Mus musculus
tgtagaccacagactgttctgga

SEQ ID NO: 202536 - DNA, 20 bp, Mus musculus
ctgtggttccatgttctgct

SEQ ID NO: 202537 - DNA, 20 bp, Mus musculus
caggtgggagaagacagaga

SEQ ID NO: 202538 - DNA, 22 bp, Mus musculus
tgttttgtgaccaattatatgg

SEQ ID NO: 202539 - DNA, 22 bp, Mus musculus
tgttttgtgaccaattatatgg

SEQ ID NO: 202540 - DNA, 22 bp, Mus musculus
ttacacacacacaaaattctgt

SEQ ID NO: 202541 - DNA, 20 bp, Mus musculus
catttctgttgttatgcctc

SEQ ID NO: 202542 - DNA, 18 bp, Mus musculus
atggaaacaagcaacctc

SEQ ID NO: 202543 - DNA, 19 bp, Mus musculus
tacacacacacatacatat

SEQ ID NO: 202544 - DNA, 23 bp, Mus musculus
tataatcaactctctgtgtctct

SEQ ID NO: 202545 - DNA, 22 bp, Mus musculus
tgttttgtgaccaattatatgg

SEQ ID NO: 202546 - DNA, 20 bp, Mus musculus
tgtatatatgtatatatatg

SEQ ID NO: 202547 - DNA, 22 bp, Mus musculus
tgttttgtgaccaattatatgg

SEQ ID NO: 202548 - DNA, 19 bp, Mus musculus
atccaatagctgactgtga

SEQ ID NO: 202549 - DNA, 23 bp, Mus musculus
tgtatgtatgtatgtatgtatgt

SEQ ID NO: 202550 - DNA, 21 bp, Mus musculus
tattgcatgcatatatttata

SEQ ID NO: 202551 - DNA, 23 bp, Mus musculus
tacagtcagagaaatgtgtgtgc

SEQ ID NO: 202552 - DNA, 22 bp, Mus musculus
tgttttgtgaccaattatatgg

SEQ ID NO: 202553 - DNA, 23 bp, Mus musculus
tatatgcatgtggtatgtatgta

SEQ ID NO: 202554 - DNA, 21 bp, Mus musculus
tccatggtggtctgataggat

SEQ ID NO: 202555 - DNA, 22 bp, Mus musculus
tgttttgtgaccaattatatgg

SEQ ID NO: 202556 - DNA, 23 bp, Mus musculus
agacagaagtctgagagaattca

SEQ ID NO: 202557 - DNA, 23 bp, Mus musculus
tgaatgcatgcatgttagtgctt

SEQ ID NO: 202558 - DNA, 23 bp, Mus musculus
ttgagtcttcactgtggtacaca

SEQ ID NO: 202559 - DNA, 23 bp, Mus musculus
aactagagaagtcaggagtttgg

SEQ ID NO: 202560 - DNA, 23 bp, Mus musculus
tctttgactagtttagttttctt

SEQ ID NO: 202561 - DNA, 23 bp, Mus musculus
taaattgttctgtgtggcctttt

SEQ ID NO: 202562 - DNA, 22 bp, Mus musculus
tttgtataaatatatatgtgtg

SEQ ID NO: 202563 - DNA, 20 bp, Mus musculus
ctgagtgtgtgacatctgat

SEQ ID NO: 202564 - DNA, 23 bp, Mus musculus
tcagactcacactctgctattcc

SEQ ID NO: 202565 - DNA, 23 bp, Mus musculus
gtgagaattctatttgtaattct

SEQ ID NO: 202566 - DNA, 23 bp, Mus musculus
ctcactgacagtttgtctgtctc

SEQ ID NO: 202567 - DNA, 18 bp, Mus musculus
tagctggtaaggtgatgt

SEQ ID NO: 202568 - DNA, 20 bp, Mus musculus
tcatcagtttatgatgttgt

SEQ ID NO: 202569 - DNA, 22 bp, Mus musculus
gtatgtatgtatgtatgtatgt

SEQ ID NO: 202570 - DNA, 23 bp, Mus musculus
tccctcagtgtctcactgtgaca

SEQ ID NO: 202571 - DNA, 18 bp, Mus musculus
cacagtgtgctctgaagg

SEQ ID NO: 202572 - DNA, 20 bp, Mus musculus
agaggtccttctcctgggtg

SEQ ID NO: 202573 - DNA, 18 bp, Mus musculus
ggttggagagagagctca

SEQ ID NO: 202574 - DNA, 18 bp, Mus musculus
acttgaatcacgcacatg

SEQ ID NO: 202575 - DNA, 23 bp, Mus musculus
actcagtgcatttatctctgcat

SEQ ID NO: 202576 - DNA, 23 bp, Mus musculus
tccagtctcactctgtctctctg

SEQ ID NO: 202577 - DNA, 22 bp, Mus musculus
atgtgtatatgtatttgtgtac

SEQ ID NO: 202578 - DNA, 22 bp, Mus musculus
tttgggaaaggtagaagacagt

SEQ ID NO: 202579 - DNA, 23 bp, Mus musculus
aatgactgtctggtctgttcccc

SEQ ID NO: 202580 - DNA, 23 bp, Mus musculus
agtggacaaggagtatgcaagtg

SEQ ID NO: 202581 - DNA, 22 bp, Mus musculus
tatattgattttcaaaatgcca

SEQ ID NO: 202582 - DNA, 23 bp, Mus musculus
tcagaagctcactcagaatgctg

SEQ ID NO: 202583 - DNA, 21 bp, Mus musculus
tcactgtcagtcttagtagtc

SEQ ID NO: 202584 - DNA, 23 bp, Mus musculus
tgtgcgtgtgtgtgcacgtgcat

SEQ ID NO: 202585 - DNA, 21 bp, Mus musculus
tgcatgtgcgtgtgcatgtgc

SEQ ID NO: 202586 - DNA, 23 bp, Mus musculus
tgtgcatgtgcatatgtatgtgt

SEQ ID NO: 202587 - DNA, 18 bp, Mus musculus
tatacatacatgtgtgtg

SEQ ID NO: 202588 - DNA, 22 bp, Mus musculus
tagagaatttagctcaatggta

SEQ ID NO: 202589 - DNA, 22 bp, Mus musculus
tggctcagtggttaagagctga

SEQ ID NO: 202590 - DNA, 23 bp, Mus musculus
atcactgggaagcctgctctttt

SEQ ID NO: 202591 - DNA, 23 bp, Mus musculus
tctgtgcctcagtgcctccatat

SEQ ID NO: 202592 - DNA, 23 bp, Mus musculus
agactgaatagtgtgtggagact

SEQ ID NO: 202593 - DNA, 23 bp, Mus musculus
atgtgtgtgcatgtgcatatgtg

SEQ ID NO: 202594 - DNA, 21 bp, Mus musculus
ttcacagacactgaatctggt

SEQ ID NO: 202595 - DNA, 19 bp, Mus musculus
acagaggcacatagaatga

SEQ ID NO: 202596 - DNA, 20 bp, Mus musculus
aattggagttttgagtgtcc

SEQ ID NO: 202597 - DNA, 23 bp, Mus musculus
tatgtatatgtatatgtgtatgt

SEQ ID NO: 202598 - DNA, 18 bp, Mus musculus
tgtcactgtgattatgtc

SEQ ID NO: 202599 - DNA, 23 bp, Mus musculus
actgtccatatcaaatgctgcct

SEQ ID NO: 202600 - DNA, 23 bp, Mus musculus
cttcctgtctgtctgtcccagtg

SEQ ID NO: 202601 - DNA, 22 bp, Mus musculus
actgtgggcccattctgtgtct

SEQ ID NO: 202602 - DNA, 23 bp, Mus musculus
atgtgtatgttcatgatggagca

SEQ ID NO: 202603 - DNA, 23 bp, Mus musculus
aaaagtgcatcccaattccatgt

SEQ ID NO: 202604 - DNA, 23 bp, Mus musculus
tgtgtgattgtacatgtgtgtgt

SEQ ID NO: 202605 - DNA, 18 bp, Mus musculus
taggaggcctcagttttc

SEQ ID NO: 202606 - DNA, 22 bp, Mus musculus
tccatgttgatctgataggttg

SEQ ID NO: 202607 - DNA, 22 bp, Mus musculus
tgttttgtgaccaattatatgg

SEQ ID NO: 202608 - DNA, 23 bp, Mus musculus
ttgtccttgatgatctgatagga

SEQ ID NO: 202609 - DNA, 23 bp, Mus musculus
tgtgacagattatatgttcagtt

SEQ ID NO: 202610 - DNA, 23 bp, Mus musculus
tagtgcatggtgatctgatagga

SEQ ID NO: 202611 - DNA, 22 bp, Mus musculus
tgttttgtgacctattatgtgg

SEQ ID NO: 202612 - DNA, 21 bp, Mus musculus
aatctgtgtgctttctttcag

SEQ ID NO: 202613 - DNA, 23 bp, Mus musculus
ttacaatctagatcttatcattc

SEQ ID NO: 202614 - DNA, 23 bp, Mus musculus
ttttaggatcactaagaatagaa

SEQ ID NO: 202615 - DNA, 23 bp, Mus musculus
cttagtgcatggtgatctgatag

SEQ ID NO: 202616 - DNA, 18 bp, Mus musculus
aagatgtttgaatgctgc

SEQ ID NO: 202617 - DNA, 23 bp, Mus musculus
aatccatgatgatctgataggat

SEQ ID NO: 202618 - DNA, 23 bp, Mus musculus
tgttttgtaaccaattatattgt

SEQ ID NO: 202619 - DNA, 23 bp, Mus musculus
ttagactccgtgtctctctctct

SEQ ID NO: 202620 - DNA, 18 bp, Mus musculus
agcaggagaaactgcagg

SEQ ID NO: 202621 - DNA, 23 bp, Mus musculus
acaggtatttgtgaactgggtgc

SEQ ID NO: 202622 - DNA, 23 bp, Mus musculus
gctgacactcagtggctctgctc

SEQ ID NO: 202623 - DNA, 23 bp, Mus musculus
tctctgtctcagtctctctccat

SEQ ID NO: 202624 - DNA, 23 bp, Mus musculus
tttgtcactgtgtctcttttcca

SEQ ID NO: 202625 - DNA, 23 bp, Mus musculus
tctgtcactgaatctgtgtctcc

SEQ ID NO: 202626 - DNA, 21 bp, Mus musculus
tgtatatatgtttgtgtgtat

SEQ ID NO: 202627 - DNA, 23 bp, Mus musculus
atatatgtgcgtgcgtgtgtgca

SEQ ID NO: 202628 - DNA, 23 bp, Mus musculus
ctttgtgcatatttatacatata

SEQ ID NO: 202629 - DNA, 20 bp, Mus musculus
tccttctgtctttatctcag

SEQ ID NO: 202630 - DNA, 23 bp, Mus musculus
tgtgtctgtgtgtgtctgtgcat

SEQ ID NO: 202631 - DNA, 19 bp, Mus musculus
agcatctatctatctatct

SEQ ID NO: 202632 - DNA, 22 bp, Mus musculus
caattcacaaccatttgttatg

SEQ ID NO: 202633 - DNA, 21 bp, Mus musculus
acagagtcagcagacaccccc

SEQ ID NO: 202634 - DNA, 22 bp, Mus musculus
agagacaccagagtgtgcagtg

SEQ ID NO: 202635 - DNA, 23 bp, Mus musculus
ctgtgtctctgtttagtttctgt

SEQ ID NO: 202636 - DNA, 23 bp, Mus musculus
cagaagacagtctgctttgggga

SEQ ID NO: 202637 - DNA, 20 bp, Mus musculus
tatcccttccattgtggctt

SEQ ID NO: 202638 - DNA, 21 bp, Mus musculus
tgtgaaacctagattatgtaa

SEQ ID NO: 202639 - DNA, 20 bp, Mus musculus
ggagccactctgagtctgtg

SEQ ID NO: 202640 - DNA, 23 bp, Mus musculus
tatggcaaatgtttggtttgcat

SEQ ID NO: 202641 - DNA, 23 bp, Mus musculus
atctgtgtgtgtactcatgtgtg

SEQ ID NO: 202642 - DNA, 18 bp, Mus musculus
tcagttgtctcagtctgt

SEQ ID NO: 202643 - DNA, 22 bp, Mus musculus
tgttttgtgaccaattatatgg

SEQ ID NO: 202644 - DNA, 21 bp, Mus musculus
tctgtggtgatcagataggat

SEQ ID NO: 202645 - DNA, 22 bp, Mus musculus
tgttttgtgaccaattatatgg

SEQ ID NO: 202646 - DNA, 21 bp, Mus musculus
atcagttccaggttcagtgag

SEQ ID NO: 202647 - DNA, 21 bp, Mus musculus
tttccacgtgaatgttggctt

SEQ ID NO: 202648 - DNA, 22 bp, Mus musculus
ttagttcatggtgatctgatag

SEQ ID NO: 202649 - DNA, 23 bp, Mus musculus
aaattttcaagtagtaaaggcta

SEQ ID NO: 202650 - DNA, 23 bp, Mus musculus
agagaaaagacagtgaactgtcg

SEQ ID NO: 202651 - DNA, 20 bp, Mus musculus
tctgtgaccaattatgttgt

SEQ ID NO: 202652 - DNA, 23 bp, Mus musculus
tttatgagactactgggtgtgta

SEQ ID NO: 202653 - DNA, 23 bp, Mus musculus
attatgcttgttctttgaaatgt

SEQ ID NO: 202654 - DNA, 23 bp, Mus musculus
taagaacaaaacatggtgtataa

SEQ ID NO: 202655 - DNA, 23 bp, Mus musculus
tgtgtatgtatttgtgtaaatgt

SEQ ID NO: 202656 - DNA, 22 bp, Mus musculus
tgttttgtgaccaattatatgg

SEQ ID NO: 202657 - DNA, 22 bp, Mus musculus
tttgacacattttcttgttttt

SEQ ID NO: 202658 - DNA, 22 bp, Mus musculus
taattgtagagaagctcactta

SEQ ID NO: 202659 - DNA, 23 bp, Mus musculus
acagagacagaagagagcgggat

SEQ ID NO: 202660 - DNA, 20 bp, Mus musculus
ctgtctcactgtctgcgcgg

SEQ ID NO: 202661 - DNA, 23 bp, Mus musculus
gtatgagcaacactttgtcctct

SEQ ID NO: 202662 - DNA, 23 bp, Mus musculus
aatatttttgtatctgttgaggc

SEQ ID NO: 202663 - DNA, 21 bp, Mus musculus
tctgtggtgatctgataggat

SEQ ID NO: 202664 - DNA, 23 bp, Mus musculus
gttttgtgaccaattatatggtt

SEQ ID NO: 202665 - DNA, 23 bp, Mus musculus
atggtgaatgcttgttttgattt

SEQ ID NO: 202666 - DNA, 23 bp, Mus musculus
tctcacagacagagtctctggca

SEQ ID NO: 202667 - DNA, 23 bp, Mus musculus
tctgccacactttgtctctgaat

SEQ ID NO: 202668 - DNA, 23 bp, Mus musculus
tgtgagtgtcctgacagtggtga

SEQ ID NO: 202669 - DNA, 20 bp, Mus musculus
tcatttctgattttgttaat

SEQ ID NO: 202670 - DNA, 23 bp, Mus musculus
tcaatatttttgtatctgtggag

SEQ ID NO: 202671 - DNA, 23 bp, Mus musculus
gtgtccaataatatggtcaattt

SEQ ID NO: 202672 - DNA, 22 bp, Mus musculus
tgttttgtgaccaattatatgg

SEQ ID NO: 202673 - DNA, 23 bp, Mus musculus
tctcacactggaagagttgtgta

SEQ ID NO: 202674 - DNA, 23 bp, Mus musculus
tgtgtaccaaatgcttagagtga

SEQ ID NO: 202675 - DNA, 22 bp, Mus musculus
tgttcatgtgtgctaatgatgc

SEQ ID NO: 202676 - DNA, 23 bp, Mus musculus
cagggagtgaacagacaagctga

SEQ ID NO: 202677 - DNA, 23 bp, Mus musculus
tgctttccactatgaggaaacca

SEQ ID NO: 202678 - DNA, 23 bp, Mus musculus
tatcagagtagagagacagctct

SEQ ID NO: 202679 - DNA, 21 bp, Mus musculus
cacaccatctctctctcacaa

SEQ ID NO: 202680 - DNA, 23 bp, Mus musculus
tgagccaccctcagtctctccat

SEQ ID NO: 202681 - DNA, 23 bp, Mus musculus
ggccccagtcagtctctctcaat

SEQ ID NO: 202682 - DNA, 20 bp, Mus musculus
tggcatggggtttggatggt

SEQ ID NO: 202683 - DNA, 23 bp, Mus musculus
tctctctctgtgtatgatgcctg

SEQ ID NO: 202684 - DNA, 21 bp, Mus musculus
cattggatcatctggagctag

SEQ ID NO: 202685 - DNA, 22 bp, Mus musculus
tgttttgtgaccaattatatgg

SEQ ID NO: 202686 - DNA, 22 bp, Mus musculus
tgttttgtgaccaattatatgg

SEQ ID NO: 202687 - DNA, 23 bp, Mus musculus
aaaactgactggttttgtatgtc

SEQ ID NO: 202688 - DNA, 19 bp, Mus musculus
tgagcatgagagatctttc

SEQ ID NO: 202689 - DNA, 23 bp, Mus musculus
tctcctttgtagagtgtgagctc

SEQ ID NO: 202690 - DNA, 22 bp, Mus musculus
tgaagttctctatctgtgttag

SEQ ID NO: 202691 - DNA, 23 bp, Mus musculus
tcgtagaatgaattgggtagagt

SEQ ID NO: 202692 - DNA, 23 bp, Mus musculus
acacacactctcactttgttcac

SEQ ID NO: 202693 - DNA, 19 bp, Mus musculus
gcaagttggatgaattgtt

SEQ ID NO: 202694 - DNA, 23 bp, Mus musculus
agaattgtttacagatattgttc

SEQ ID NO: 202695 - DNA, 23 bp, Mus musculus
catggttgtctgacaggatgcat

SEQ ID NO: 202696 - DNA, 22 bp, Mus musculus
tgttttgtgaccaattatatgg

SEQ ID NO: 202697 - DNA, 19 bp, Mus musculus
atgtgtgtgtgtgtgtgtg

SEQ ID NO: 202698 - DNA, 23 bp, Mus musculus
caggagatatgtgtgtgtctgtg

SEQ ID NO: 202699 - DNA, 23 bp, Mus musculus
tgtatatatgtacatattcatat

SEQ ID NO: 202700 - DNA, 23 bp, Mus musculus
atatgtgtgtgtatgtagatatg

SEQ ID NO: 202701 - DNA, 18 bp, Mus musculus
tatatgaatgtatgcata

SEQ ID NO: 202702 - DNA, 23 bp, Mus musculus
aattatgtgtatatgtacatgtg

SEQ ID NO: 202703 - DNA, 19 bp, Mus musculus
gtttagtctgatgatagca

SEQ ID NO: 202704 - DNA, 18 bp, Mus musculus
atcactggagataacaga

SEQ ID NO: 202705 - DNA, 20 bp, Mus musculus
gtgcatgagcatatgtgtgt

SEQ ID NO: 202706 - DNA, 18 bp, Mus musculus
tggcacattcagatatga

SEQ ID NO: 202707 - DNA, 23 bp, Mus musculus
tgagtgagtgtgtgtgtgcgtgg

SEQ ID NO: 202708 - DNA, 21 bp, Mus musculus
taagtcagggttgaccatctg

SEQ ID NO: 202709 - DNA, 23 bp, Mus musculus
tcagctactgcatgtgcaagtac

SEQ ID NO: 202710 - DNA, 23 bp, Mus musculus
tatatgcatgtacattgaatagt

SEQ ID NO: 202711 - DNA, 20 bp, Mus musculus
gtgtgtgtgtgtgtgtgtgt

SEQ ID NO: 202712 - DNA, 23 bp, Mus musculus
tggatctctgtgagttcaaggcc

SEQ ID NO: 202713 - DNA, 23 bp, Mus musculus
tatgaatgtgtacatgtatttgt

SEQ ID NO: 202714 - DNA, 21 bp, Mus musculus
tatgtgtgtatgtgtatatgc

SEQ ID NO: 202715 - DNA, 23 bp, Mus musculus
gtgtgtaagtgcatgagcatgtg

SEQ ID NO: 202716 - DNA, 23 bp, Mus musculus
acattgactatggatgtgagggt

SEQ ID NO: 202717 - DNA, 21 bp, Mus musculus
caacactactgtttttgttta

SEQ ID NO: 202718 - DNA, 20 bp, Mus musculus
tctgtctggtggagcacagg

SEQ ID NO: 202719 - DNA, 23 bp, Mus musculus
aggctggcagcctcaatgcctgg

SEQ ID NO: 202720 - DNA, 23 bp, Mus musculus
atatatgtgtatatgatgtgtat

SEQ ID NO: 202721 - DNA, 21 bp, Mus musculus
tatatatatctgcatggggtt

SEQ ID NO: 202722 - DNA, 23 bp, Mus musculus
aagagtctgatgtctgaaggctg

SEQ ID NO: 202723 - DNA, 23 bp, Mus musculus
ggtgtgactgtctctgtccctgc

SEQ ID NO: 202724 - DNA, 23 bp, Mus musculus
cctattttctctctgtctctgaa

SEQ ID NO: 202725 - DNA, 23 bp, Mus musculus
tccctctgtgtctgtctggcttg

SEQ ID NO: 202726 - DNA, 19 bp, Mus musculus
tttgtacttctcaaaacta

SEQ ID NO: 202727 - DNA, 23 bp, Mus musculus
tgagcattagttctgcagatgtt

SEQ ID NO: 202728 - DNA, 23 bp, Mus musculus
tctctctcaggtttaatattgtg

SEQ ID NO: 202729 - DNA, 23 bp, Mus musculus
tgcgtctgtgtctgtctgtgtga

SEQ ID NO: 202730 - DNA, 23 bp, Mus musculus
atggatatgtgtgtgtgtgtctg

SEQ ID NO: 202731 - DNA, 22 bp, Mus musculus
acacacacacacatatagtttt

SEQ ID NO: 202732 - DNA, 18 bp, Mus musculus
tatgtatgtatgtgtgta

SEQ ID NO: 202733 - DNA, 21 bp, Mus musculus
tattatacagctggtacatat

SEQ ID NO: 202734 - DNA, 22 bp, Mus musculus
gttgcctctacatagccaggtg

SEQ ID NO: 202735 - DNA, 23 bp, Mus musculus
ctgccactctggctctgtggcac

SEQ ID NO: 202736 - DNA, 23 bp, Mus musculus
ctgtgtctctgtttagtttgtgt

SEQ ID NO: 202737 - DNA, 22 bp, Mus musculus
tgttttgtgaccaattatatgg

SEQ ID NO: 202738 - DNA, 23 bp, Mus musculus
agttctgggctgtgactctctca

SEQ ID NO: 202739 - DNA, 23 bp, Mus musculus
tcacagttaagtgtgtgctctgt

SEQ ID NO: 202740 - DNA, 19 bp, Mus musculus
agtgtctggttgatttctc

SEQ ID NO: 202741 - DNA, 21 bp, Mus musculus
tatcgtgtagagactctctga

SEQ ID NO: 202742 - DNA, 22 bp, Mus musculus
aagtgaggctcaaagtttattt

SEQ ID NO: 202743 - DNA, 23 bp, Mus musculus
ctcaatggcatttggctctgctt

SEQ ID NO: 202744 - DNA, 23 bp, Mus musculus
cacagagaagagagacagttctt

SEQ ID NO: 202745 - DNA, 19 bp, Mus musculus
ttagaggaagtcggtcact

SEQ ID NO: 202746 - DNA, 23 bp, Mus musculus
aattgtatgtatatgatatgtat

SEQ ID NO: 202747 - DNA, 23 bp, Mus musculus
gtttccatgtgtgtgtatgatgt

SEQ ID NO: 202748 - DNA, 23 bp, Mus musculus
cttccagtttgtcctggataccc

SEQ ID NO: 202749 - DNA, 22 bp, Mus musculus
taagaggcagggagagttctga

SEQ ID NO: 202750 - DNA, 22 bp, Mus musculus
tgtgtgtgtgtatatgtgtgcg

SEQ ID NO: 202751 - DNA, 21 bp, Mus musculus
atgtgtgtgagcatgtgcatg

SEQ ID NO: 202752 - DNA, 19 bp, Mus musculus
cagagaagagagagtccac

SEQ ID NO: 202753 - DNA, 23 bp, Mus musculus
aattgtcgcttcagtctctgtga

SEQ ID NO: 202754 - DNA, 23 bp, Mus musculus
tttgctcaccaatacaatgctaa

SEQ ID NO: 202755 - DNA, 22 bp, Mus musculus
tatgtgtatatatgtatatgta

SEQ ID NO: 202756 - DNA, 23 bp, Mus musculus
ttatgtatatatgattatgtata

SEQ ID NO: 202757 - DNA, 23 bp, Mus musculus
aatgagagataacagagaggcct

SEQ ID NO: 202758 - DNA, 20 bp, Mus musculus
tgtatatatgtatatatgta

SEQ ID NO: 202759 - DNA, 19 bp, Mus musculus
tatatatgtacatatacat

SEQ ID NO: 202760 - DNA, 19 bp, Mus musculus
tatgcatttatatacatat

SEQ ID NO: 202761 - DNA, 23 bp, Mus musculus
tggcacgctctctgtctcagctc

SEQ ID NO: 202762 - DNA, 22 bp, Mus musculus
atctgctgcgttatgtatactt

SEQ ID NO: 202763 - DNA, 22 bp, Mus musculus
tgttttgtgaccaattatatgg

SEQ ID NO: 202764 - DNA, 23 bp, Mus musculus
tatgagcttaagatatgtatgtg

SEQ ID NO: 202765 - DNA, 23 bp, Mus musculus
atgcatgtatatttgtatttgtg

SEQ ID NO: 202766 - DNA, 23 bp, Mus musculus
tacatgtgtatatgtatatgtgt

SEQ ID NO: 202767 - DNA, 23 bp, Mus musculus
aagtgtgtatttatgtatgcatg

SEQ ID NO: 202768 - DNA, 23 bp, Mus musculus
tgtgtatatgtatatgtatatgt

SEQ ID NO: 202769 - DNA, 22 bp, Mus musculus
atatagatagatatagaaatgt

SEQ ID NO: 202770 - DNA, 23 bp, Mus musculus
ttatgtgtgtacatgtatgtgtc

SEQ ID NO: 202771 - DNA, 23 bp, Mus musculus
tatttgtgtgcatatgtttgtat

SEQ ID NO: 202772 - DNA, 20 bp, Mus musculus
gagcacagtgagtgctcttc

SEQ ID NO: 202773 - DNA, 21 bp, Mus musculus
acacacatgtgcatgcggtgt

SEQ ID NO: 202774 - DNA, 22 bp, Mus musculus
ctctccctgcctctgtgcgtct

SEQ ID NO: 202775 - DNA, 18 bp, Mus musculus
actgcaggaattatctgc

SEQ ID NO: 202776 - DNA, 22 bp, Mus musculus
tgttttgtgaccaattatatgg

SEQ ID NO: 202777 - DNA, 23 bp, Mus musculus
ttcaagctggttctgaattggat

SEQ ID NO: 202778 - DNA, 21 bp, Mus musculus
tccatggtggtctgataggat

SEQ ID NO: 202779 - DNA, 22 bp, Mus musculus
tgttttgtgaccaattatatgg

SEQ ID NO: 202780 - DNA, 23 bp, Mus musculus
tatgcatgtatatatatgtatgt

SEQ ID NO: 202781 - DNA, 18 bp, Mus musculus
tgcagaggacctagttca

SEQ ID NO: 202782 - DNA, 23 bp, Mus musculus
ttgactctgtggatttttttgtg

SEQ ID NO: 202783 - DNA, 19 bp, Mus musculus
cacacatacgctcacatat

SEQ ID NO: 202784 - DNA, 22 bp, Mus musculus
tatatatgtatgcatatatgtg

SEQ ID NO: 202785 - DNA, 23 bp, Mus musculus
atcagtgcattgatgagtgcaca

SEQ ID NO: 202786 - DNA, 21 bp, Mus musculus
tgtgtgtgtatctgtgtccat

SEQ ID NO: 202787 - DNA, 22 bp, Mus musculus
tgttttgtgaccaattatatgg

SEQ ID NO: 202788 - DNA, 21 bp, Mus musculus
ttctctgttgatgtttttcct

SEQ ID NO: 202789 - DNA, 23 bp, Mus musculus
atatgcatgtgtctgtgcatgtg

SEQ ID NO: 202790 - DNA, 22 bp, Mus musculus
tctctcactgaaggtggagctc

SEQ ID NO: 202791 - DNA, 21 bp, Mus musculus
tctgtgcctctgtctctctgt

SEQ ID NO: 202792 - DNA, 23 bp, Mus musculus
atgttactgctttgtgtgtgtgt

SEQ ID NO: 202793 - DNA, 20 bp, Mus musculus
tatatttatgtttttcaaga

SEQ ID NO: 202794 - DNA, 23 bp, Mus musculus
tgtgtatctgtgtatgagtgtat

SEQ ID NO: 202795 - DNA, 20 bp, Mus musculus
tcagttgtgagtctgacatc

SEQ ID NO: 202796 - DNA, 23 bp, Mus musculus
ggaagtcagataagacagaggac

SEQ ID NO: 202797 - DNA, 22 bp, Mus musculus
tctgtctgtgtttatctgtgtg

SEQ ID NO: 202798 - DNA, 22 bp, Mus musculus
tctccatgctcctgaataccct

SEQ ID NO: 202799 - DNA, 23 bp, Mus musculus
atgtgtgtgtgcatgtgcatgca

SEQ ID NO: 202800 - DNA, 23 bp, Mus musculus
tatgtgtacatatgtatacatat

SEQ ID NO: 202801 - DNA, 23 bp, Mus musculus
tccctgactgcctggctgagtct

SEQ ID NO: 202802 - DNA, 22 bp, Mus musculus
tgttttgtgaccaattatatgg

SEQ ID NO: 202803 - DNA, 23 bp, Mus musculus
tgagggcatgcttgtttggctga

SEQ ID NO: 202804 - DNA, 23 bp, Mus musculus
atctgaccctctgtgtgtcttca

SEQ ID NO: 202805 - DNA, 23 bp, Mus musculus
tctgtctgtctgtgtatgtatgt

SEQ ID NO: 202806 - DNA, 21 bp, Mus musculus
cgcttaaagtacatagatcta

SEQ ID NO: 202807 - DNA, 21 bp, Mus musculus
tccatggtggtctgataggat

SEQ ID NO: 202808 - DNA, 23 bp, Mus musculus
tgtctgtctgtctgtctgtgtgg

SEQ ID NO: 202809 - DNA, 23 bp, Mus musculus
attgagcatcaacttttctatgt

SEQ ID NO: 202810 - DNA, 22 bp, Mus musculus
tgttttgtgaccaattatatgg

SEQ ID NO: 202811 - DNA, 22 bp, Mus musculus
tgttttgtgaccaattatatgg

SEQ ID NO: 202812 - DNA, 23 bp, Mus musculus
gggaagacatgggaatttgttca

SEQ ID NO: 202813 - DNA, 23 bp, Mus musculus
tgctcacagtctctcagtgttat

SEQ ID NO: 202814 - DNA, 22 bp, Mus musculus
tgttttgtgaccaattatatgg

SEQ ID NO: 202815 - DNA, 23 bp, Mus musculus
ctttggtagatggatgtatattt

SEQ ID NO: 202816 - DNA, 21 bp, Mus musculus
aagtgcacatcttccacggag

SEQ ID NO: 202817 - DNA, 23 bp, Mus musculus
ctctctgtatttctatatctatc

SEQ ID NO: 202818 - DNA, 22 bp, Mus musculus
tgttttgtgaccaattatatgg

SEQ ID NO: 202819 - DNA, 20 bp, Mus musculus
tggctaatatttacaatgtg

SEQ ID NO: 202820 - DNA, 23 bp, Mus musculus
atatgcatatatatatgtgtgtg

SEQ ID NO: 202821 - DNA, 23 bp, Mus musculus
agagatgtgactgaggaatggca

SEQ ID NO: 202822 - DNA, 21 bp, Mus musculus
ctcacttaatgtcttgctttc

SEQ ID NO: 202823 - DNA, 23 bp, Mus musculus
ttgtccatgatgaactgatagga

SEQ ID NO: 202824 - DNA, 21 bp, Mus musculus
tgttttgtgaccaattatgtg

SEQ ID NO: 202825 - DNA, 19 bp, Mus musculus
tgcatatatattgtatatg

SEQ ID NO: 202826 - DNA, 22 bp, Mus musculus
atatatgtgtgtatgtacatgt

SEQ ID NO: 202827 - DNA, 19 bp, Mus musculus
tcactcactttctcattct

SEQ ID NO: 202828 - DNA, 23 bp, Mus musculus
tccctgtgtgcctctctctctca

SEQ ID NO: 202829 - DNA, 23 bp, Mus musculus
actctgtctatgtctctctctct

SEQ ID NO: 202830 - DNA, 18 bp, Mus musculus
tgatagcatcaaaaagca

SEQ ID NO: 202831 - DNA, 19 bp, Mus musculus
agtagtagaaacagagtgg

SEQ ID NO: 202832 - DNA, 23 bp, Mus musculus
tctctgtctctgtctctctgtct

SEQ ID NO: 202833 - DNA, 20 bp, Mus musculus
atataagaggggcctctgaa

SEQ ID NO: 202834 - DNA, 23 bp, Mus musculus
tcagtgtctgcttcttcatattt

SEQ ID NO: 202835 - DNA, 23 bp, Mus musculus
gaacagggtcactgatgatagcc

SEQ ID NO: 202836 - DNA, 23 bp, Mus musculus
cagggtgtctgtgtctgtctcta

SEQ ID NO: 202837 - DNA, 23 bp, Mus musculus
aaaagactgattatcaagggtta

SEQ ID NO: 202838 - DNA, 22 bp, Mus musculus
cagtctgtatttctaactgaat

SEQ ID NO: 202839 - DNA, 20 bp, Mus musculus
atatatgtatatatgtatac

SEQ ID NO: 202840 - DNA, 20 bp, Mus musculus
gtttatccatgtcttgtgag

SEQ ID NO: 202841 - DNA, 23 bp, Mus musculus
atacctgatgatcccatgttgtg

SEQ ID NO: 202842 - DNA, 23 bp, Mus musculus
tgtctgtgtgtctgtctgtcctt

SEQ ID NO: 202843 - DNA, 23 bp, Mus musculus
tgtgcgtgcgtgcgtgcgtgcgt

SEQ ID NO: 202844 - DNA, 23 bp, Mus musculus
tctgtctgtctgtctatgtacat

SEQ ID NO: 202845 - DNA, 22 bp, Mus musculus
tgttttgtgaccaattatatgg

SEQ ID NO: 202846 - DNA, 19 bp, Mus musculus
tggatctgggagatggcta

SEQ ID NO: 202847 - DNA, 22 bp, Mus musculus
aggatacctggtctggctgtct

SEQ ID NO: 202848 - DNA, 23 bp, Mus musculus
atgctcatgtgggatgtgtgtgt

SEQ ID NO: 202849 - DNA, 21 bp, Mus musculus
tatgtgtgtgcatatgcacac

SEQ ID NO: 202850 - DNA, 23 bp, Mus musculus
aacagtgaacattctgtgcttac

SEQ ID NO: 202851 - DNA, 22 bp, Mus musculus
tcagacagtggagggagagact

SEQ ID NO: 202852 - DNA, 22 bp, Mus musculus
cttcttcccagtgtctgtcctg

SEQ ID NO: 202853 - DNA, 19 bp, Mus musculus
gagacaagatagtgtggac

SEQ ID NO: 202854 - DNA, 23 bp, Mus musculus
taagtgtgcatatgtagtgtgta

SEQ ID NO: 202855 - DNA, 20 bp, Mus musculus
tgtgtgtgtgtcagtgtctc

SEQ ID NO: 202856 - DNA, 23 bp, Mus musculus
ctgtgtagctctgtccttgaact

SEQ ID NO: 202857 - DNA, 18 bp, Mus musculus
acacagtaaacagtgagc

SEQ ID NO: 202858 - DNA, 21 bp, Mus musculus
agtcaggctggaaagatggct

SEQ ID NO: 202859 - DNA, 23 bp, Mus musculus
tgtctgtatgtgtatgtgcatct

SEQ ID NO: 202860 - DNA, 23 bp, Mus musculus
tctgtgactctgtgtgtatgatg

SEQ ID NO: 202861 - DNA, 23 bp, Mus musculus
tgtgatttgattatcatgttgtt

SEQ ID NO: 202862 - DNA, 20 bp, Mus musculus
aagatggtcacagacattgg

SEQ ID NO: 202863 - DNA, 21 bp, Mus musculus
tgagtgaggtaatccagtcac

SEQ ID NO: 202864 - DNA, 23 bp, Mus musculus
tttctgtctcactgttttttgac

SEQ ID NO: 202865 - DNA, 22 bp, Mus musculus
atggtgggtcttttagttcttt

SEQ ID NO: 202866 - DNA, 23 bp, Mus musculus
tatatgtatgttgttaggggaaa

SEQ ID NO: 202867 - DNA, 23 bp, Mus musculus
gtaattctctctatttgttgggt

SEQ ID NO: 202868 - DNA, 23 bp, Mus musculus
tatgtctctgtgtgtggctgtgt

SEQ ID NO: 202869 - DNA, 23 bp, Mus musculus
tagaaatgaaagcatgtctggag

SEQ ID NO: 202870 - DNA, 19 bp, Mus musculus
aaccagctcatttgcaaag

SEQ ID NO: 202871 - DNA, 23 bp, Mus musculus
cttcagactagagggagcagtga

SEQ ID NO: 202872 - DNA, 22 bp, Mus musculus
tgtcactgagtctcttacttgc

SEQ ID NO: 202873 - DNA, 23 bp, Mus musculus
agacgtcactcagtatcttgtgt

SEQ ID NO: 202874 - DNA, 22 bp, Mus musculus
atctcactgcaagaattcaggg

SEQ ID NO: 202875 - DNA, 23 bp, Mus musculus
catggttaggaattgttccacaa

SEQ ID NO: 202876 - DNA, 23 bp, Mus musculus
actgcagttgctgtctgaatttt

SEQ ID NO: 202877 - DNA, 18 bp, Mus musculus
tgggttgaacatgggtgt

SEQ ID NO: 202878 - DNA, 23 bp, Mus musculus
agcaggacagaattgtgtgagga

SEQ ID NO: 202879 - DNA, 23 bp, Mus musculus
tgtatgtatgcatgtatgtgcat

SEQ ID NO: 202880 - DNA, 20 bp, Mus musculus
tgtgtactcagagaccagga

SEQ ID NO: 202881 - DNA, 23 bp, Mus musculus
ccctctggttgccggtcagtctg

SEQ ID NO: 202882 - DNA, 23 bp, Mus musculus
tgcacatagtactgacagaggag

SEQ ID NO: 202883 - DNA, 23 bp, Mus musculus
tcactgtgtgtgtgtgtgtgtgt

SEQ ID NO: 202884 - DNA, 23 bp, Mus musculus
tgtctgtctgtctgtgtccaagg

SEQ ID NO: 202885 - DNA, 22 bp, Mus musculus
tgttttgtgaccaattatatgg

SEQ ID NO: 202886 - DNA, 22 bp, Mus musculus
ccagactctcagtgtctgtggc

SEQ ID NO: 202887 - DNA, 18 bp, Mus musculus
tgggactgacttgctgtg

SEQ ID NO: 202888 - DNA, 23 bp, Mus musculus
cacacaaatctgtacaatctcat

SEQ ID NO: 202889 - DNA, 23 bp, Mus musculus
tctgtattgtagatatcacatag

SEQ ID NO: 202890 - DNA, 22 bp, Mus musculus
tgattgaccttgttatttcctt

SEQ ID NO: 202891 - DNA, 23 bp, Mus musculus
acacacactcataatattgagtc

SEQ ID NO: 202892 - DNA, 23 bp, Mus musculus
gtgtgtgtgtgtgcatgtgcatg

SEQ ID NO: 202893 - DNA, 22 bp, Mus musculus
cacgtgtgtgtgtgtgtgtgtg

SEQ ID NO: 202894 - DNA, 23 bp, Mus musculus
tttgtctcttcagtctctgtgag

SEQ ID NO: 202895 - DNA, 21 bp, Mus musculus
aagactcagtataggcatctg

SEQ ID NO: 202896 - DNA, 23 bp, Mus musculus
agactctagctgtctgtgactgt

SEQ ID NO: 202897 - DNA, 18 bp, Mus musculus
ttcatgtgggtcttctaa

SEQ ID NO: 202898 - DNA, 23 bp, Mus musculus
ctggctgtctcagactcagactc

SEQ ID NO: 202899 - DNA, 22 bp, Mus musculus
gaatgctcatgagtccctgaca

SEQ ID NO: 202900 - DNA, 23 bp, Mus musculus
tggcatgtgtgatgatgatggtg

SEQ ID NO: 202901 - DNA, 22 bp, Mus musculus
catgtgtgatgatgatggtgat

SEQ ID NO: 202902 - DNA, 23 bp, Mus musculus
tgtattttgtgtggtttacatat

SEQ ID NO: 202903 - DNA, 22 bp, Mus musculus
gactacagacacacacacacac

SEQ ID NO: 202904 - DNA, 23 bp, Mus musculus
tcactggctatgtgtctcactgg

SEQ ID NO: 202905 - DNA, 23 bp, Mus musculus
atcctgtgagcatatgtactgac

SEQ ID NO: 202906 - DNA, 23 bp, Mus musculus
ttatgtgtgtgtacatgtgtgtg

SEQ ID NO: 202907 - DNA, 20 bp, Mus musculus
tgtgtgtgcatgtgcatatg

SEQ ID NO: 202908 - DNA, 22 bp, Mus musculus
cagtgagaagagactttgcata

SEQ ID NO: 202909 - DNA, 22 bp, Mus musculus
aaaactcccatgactggctcac

SEQ ID NO: 202910 - DNA, 19 bp, Mus musculus
tgtatgtgtggtgtgtggc

SEQ ID NO: 202911 - DNA, 23 bp, Mus musculus
gtgtgacactgtgtgtgtatgcc

SEQ ID NO: 202912 - DNA, 23 bp, Mus musculus
tggctattcactgtgtatgctga

SEQ ID NO: 202913 - DNA, 23 bp, Mus musculus
tatgcagtagatactgtgcactt

SEQ ID NO: 202914 - DNA, 23 bp, Mus musculus
ctcactctctctgattctccaga

SEQ ID NO: 202915 - DNA, 19 bp, Mus musculus
tgggacaggatccttactc

SEQ ID NO: 202916 - DNA, 20 bp, Mus musculus
tccttggatatgattccctt

SEQ ID NO: 202917 - DNA, 22 bp, Mus musculus
attttggatatttttaaagtgt

SEQ ID NO: 202918 - DNA, 23 bp, Mus musculus
tagtctgtacttggttttttctg

SEQ ID NO: 202919 - DNA, 20 bp, Mus musculus
gactctacatttcctccaga

SEQ ID NO: 202920 - DNA, 23 bp, Mus musculus
tgtatgtatgtatatgtatacat

SEQ ID NO: 202921 - DNA, 23 bp, Mus musculus
ttctgtgcctgtgcatgtgcatg

SEQ ID NO: 202922 - DNA, 22 bp, Mus musculus
tgactgcctcactgtgacccag

SEQ ID NO: 202923 - DNA, 23 bp, Mus musculus
agactgtctctctgtgtcctgag

SEQ ID NO: 202924 - DNA, 23 bp, Mus musculus
aatatgtatgtatacatgtgtga

SEQ ID NO: 202925 - DNA, 23 bp, Mus musculus
cactctcagtgacacactccctc

SEQ ID NO: 202926 - DNA, 23 bp, Mus musculus
agtgtgtgcatatgcatgtgtat

SEQ ID NO: 202927 - DNA, 22 bp, Mus musculus
tgcatgtatgtatgtatgtatg

SEQ ID NO: 202928 - DNA, 19 bp, Mus musculus
atgcatgtatgtatgtatg

SEQ ID NO: 202929 - DNA, 23 bp, Mus musculus
tgagagaagattgagtcaggaag

SEQ ID NO: 202930 - DNA, 22 bp, Mus musculus
tcagatgtttccataagtctgt

SEQ ID NO: 202931 - DNA, 22 bp, Mus musculus
ttatggtggtacttgaaagcat

SEQ ID NO: 202932 - DNA, 19 bp, Mus musculus
tagtgagactgacagttca

SEQ ID NO: 202933 - DNA, 23 bp, Mus musculus
gcttcatggtgagattttgttgt

SEQ ID NO: 202934 - DNA, 22 bp, Mus musculus
agtctttttctctctcctagag

SEQ ID NO: 202935 - DNA, 22 bp, Mus musculus
tgtgagacaacagagtggccag

SEQ ID NO: 202936 - DNA, 20 bp, Mus musculus
attcaattctcagcaaccac

SEQ ID NO: 202937 - DNA, 23 bp, Mus musculus
tctctgtgtgtgtatgtgtgagt

SEQ ID NO: 202938 - DNA, 20 bp, Mus musculus
catatgtatatacatagcac

SEQ ID NO: 202939 - DNA, 20 bp, Mus musculus
tatactatatatatatatgt

SEQ ID NO: 202940 - DNA, 23 bp, Mus musculus
tatgtgtgtgtgtgcatgtgcat

SEQ ID NO: 202941 - DNA, 23 bp, Mus musculus
gagagagcagagagtccagatgg

SEQ ID NO: 202942 - DNA, 23 bp, Mus musculus
aaatttcagcaaccacatggtgg

SEQ ID NO: 202943 - DNA, 23 bp, Mus musculus
ctgcctgcctgcctgcctgcctg

SEQ ID NO: 202944 - DNA, 23 bp, Mus musculus
gtgtctgcatgtgtctgtgaatc

SEQ ID NO: 202945 - DNA, 22 bp, Mus musculus
atgtgtgcatgtgtatgtggtg

SEQ ID NO: 202946 - DNA, 22 bp, Mus musculus
agggtgtatgtatgtatgtatg

SEQ ID NO: 202947 - DNA, 23 bp, Mus musculus
aagatgtcactttgtttatctga

SEQ ID NO: 202948 - DNA, 23 bp, Mus musculus
gatctctgaggtgtcatatgtca

SEQ ID NO: 202949 - DNA, 20 bp, Mus musculus
taagctcttgggctggagag

SEQ ID NO: 202950 - DNA, 23 bp, Mus musculus
taatttattcattttgtatgtgt

SEQ ID NO: 202951 - DNA, 22 bp, Mus musculus
actcacaggttaagagcactgt

SEQ ID NO: 202952 - DNA, 23 bp, Mus musculus
gtgtctgtgtgtctgtatgtcct

SEQ ID NO: 202953 - DNA, 20 bp, Mus musculus
gtgtagttgggaatgtgtgt

SEQ ID NO: 202954 - DNA, 23 bp, Mus musculus
ctctgtgtgtgtctcagtcacac

SEQ ID NO: 202955 - DNA, 23 bp, Mus musculus
tcactctgtgcctgtcagtgtgg

SEQ ID NO: 202956 - DNA, 20 bp, Mus musculus
tttcaccctgagaaagggac

SEQ ID NO: 202957 - DNA, 23 bp, Mus musculus
aggctggctatgctctctgtccc

SEQ ID NO: 202958 - DNA, 22 bp, Mus musculus
tttaatgtactttgagagtcgg

SEQ ID NO: 202959 - DNA, 23 bp, Mus musculus
tttatgttgcaaatcaaatgatt

SEQ ID NO: 202960 - DNA, 19 bp, Mus musculus
atcataatctgcaaagtct

SEQ ID NO: 202961 - DNA, 19 bp, Mus musculus
tatatgcagatataggtgt

SEQ ID NO: 202962 - DNA, 23 bp, Mus musculus
aggaaggagcttgataagacatc

SEQ ID NO: 202963 - DNA, 23 bp, Mus musculus
tcctatcagtttgttgatgtgct

SEQ ID NO: 202964 - DNA, 19 bp, Mus musculus
atactgtggattatactgt

SEQ ID NO: 202965 - DNA, 22 bp, Mus musculus
tgttttgtgaccaattatatgg

SEQ ID NO: 202966 - DNA, 21 bp, Mus musculus
ttgatcttcacataagatcag

SEQ ID NO: 202967 - DNA, 23 bp, Mus musculus
caatatttttgtacctgttgagg

SEQ ID NO: 202968 - DNA, 20 bp, Mus musculus
aatctcatggtgatgttgac

SEQ ID NO: 202969 - DNA, 23 bp, Mus musculus
gatgtgtcgctccctgattggct

SEQ ID NO: 202970 - DNA, 23 bp, Mus musculus
gtaagactgagtccaaaacagga

SEQ ID NO: 202971 - DNA, 19 bp, Mus musculus
aggggttcctgtgtgacat

SEQ ID NO: 202972 - DNA, 22 bp, Mus musculus
cacatatgcatatatgtatgtt

SEQ ID NO: 202973 - DNA, 22 bp, Mus musculus
tcagaactcctggaagaccagt

SEQ ID NO: 202974 - DNA, 22 bp, Mus musculus
tatgtatgtatgtatgtgtgtg

SEQ ID NO: 202975 - DNA, 23 bp, Mus musculus
ttgagtagagtgttgttcagctt

SEQ ID NO: 202976 - DNA, 21 bp, Mus musculus
ttactccttggtgatctgata

SEQ ID NO: 202977 - DNA, 21 bp, Mus musculus
acacagttcagagagtgctgt

SEQ ID NO: 202978 - DNA, 21 bp, Mus musculus
aagagctcatctaatctgagt

SEQ ID NO: 202979 - DNA, 23 bp, Mus musculus
aattcagattttctagaaatgag

SEQ ID NO: 202980 - DNA, 23 bp, Mus musculus
atgtatgcacgcatgtgtgtatg

SEQ ID NO: 202981 - DNA, 23 bp, Mus musculus
atatatgtctgcatatgcatgtg

SEQ ID NO: 202982 - DNA, 21 bp, Mus musculus
tatgtatgtatatatatgtgt

SEQ ID NO: 202983 - DNA, 23 bp, Mus musculus
ggtgccaaatgagagtgtgctca

SEQ ID NO: 202984 - DNA, 22 bp, Mus musculus
tgttttgtgaccaattatatgg

SEQ ID NO: 202985 - DNA, 20 bp, Mus musculus
tgactaatgattttgaacat

SEQ ID NO: 202986 - DNA, 19 bp, Mus musculus
tatatgcttattttgatgt

SEQ ID NO: 202987 - DNA, 23 bp, Mus musculus
ttctctctgactcctatggaaat

SEQ ID NO: 202988 - DNA, 23 bp, Mus musculus
agaggtaccagtctgtgtgtctc

SEQ ID NO: 202989 - DNA, 23 bp, Mus musculus
atatgtatgcatgtatatgtatg

SEQ ID NO: 202990 - DNA, 22 bp, Mus musculus
tgttttgtgaccaattatatgg

SEQ ID NO: 202991 - DNA, 22 bp, Mus musculus
tgttttgtgaccaattatatgg

SEQ ID NO: 202992 - DNA, 22 bp, Mus musculus
ttaggtcatggtggtctgatag

SEQ ID NO: 202993 - DNA, 23 bp, Mus musculus
caatatttttgtatctgttgagg

SEQ ID NO: 202994 - DNA, 23 bp, Mus musculus
agaagagtgttgttcagtttcca

SEQ ID NO: 202995 - DNA, 23 bp, Mus musculus
tttattttgttattgaagatcag

SEQ ID NO: 202996 - DNA, 23 bp, Mus musculus
actggatgactagtgaatatgtt

SEQ ID NO: 202997 - DNA, 23 bp, Mus musculus
agtgagtgtttttctctctcaat

SEQ ID NO: 202998 - DNA, 19 bp, Mus musculus
atgtgtgtgtgcatgtgca

SEQ ID NO: 202999 - DNA, 23 bp, Mus musculus
acactccttttgttatctaattg

SEQ ID NO: 203000 - DNA, 23 bp, Mus musculus
atatgtatgtatgtatgtatgtg

SEQ ID NO: 203001 - DNA, 21 bp, Mus musculus
tgatatatgtgtatatgtata

SEQ ID NO: 203002 - DNA, 23 bp, Mus musculus
cctctgtctgtctgtctgtgtga

SEQ ID NO: 203003 - DNA, 23 bp, Mus musculus
actgtcactgtcacagcatgagc

SEQ ID NO: 203004 - DNA, 23 bp, Mus musculus
ttctctctgtctctggaagagtt

SEQ ID NO: 203005 - DNA, 21 bp, Mus musculus
actatgcttcatatgtgtgtg

SEQ ID NO: 203006 - DNA, 23 bp, Mus musculus
ctttagtgcctcagttcatgggt

SEQ ID NO: 203007 - DNA, 22 bp, Mus musculus
tagagtgttgttctgcttctac

SEQ ID NO: 203008 - DNA, 23 bp, Mus musculus
tttatgtttctatacatatgtat

SEQ ID NO: 203009 - DNA, 23 bp, Mus musculus
tgtgatcctgtgattcctggatc

SEQ ID NO: 203010 - DNA, 23 bp, Mus musculus
tctcagtgtgtcagagttcttgg

SEQ ID NO: 203011 - DNA, 20 bp, Mus musculus
tactagtcccatgtaaagat

SEQ ID NO: 203012 - DNA, 23 bp, Mus musculus
tgtgtgagtctgaagttggtcct

SEQ ID NO: 203013 - DNA, 23 bp, Mus musculus
ttcctgagttcatgcagttcaga

SEQ ID NO: 203014 - DNA, 23 bp, Mus musculus
tgcttcgacagggattttgttct

SEQ ID NO: 203015 - DNA, 23 bp, Mus musculus
tggtaagagtgttatcagctgat

SEQ ID NO: 203016 - DNA, 23 bp, Mus musculus
tgtctgtgctgtgtgtctcttta

SEQ ID NO: 203017 - DNA, 21 bp, Mus musculus
tgagtgtgtagtatagttgtg

SEQ ID NO: 203018 - DNA, 22 bp, Mus musculus
gtatgtatgtatgtatgtatgt

SEQ ID NO: 203019 - DNA, 23 bp, Mus musculus
gccaggctcagtctcactctgcc

SEQ ID NO: 203020 - DNA, 23 bp, Mus musculus
gtgaaactctctgccacaggact

SEQ ID NO: 203021 - DNA, 19 bp, Mus musculus
agcatgtgtctgtaagttg

SEQ ID NO: 203022 - DNA, 22 bp, Mus musculus
tgttttgtgaccaattatatgg

SEQ ID NO: 203023 - DNA, 23 bp, Mus musculus
agctattctttgtcatttggact

SEQ ID NO: 203024 - DNA, 23 bp, Mus musculus
atctgagagatgtcagtgaggaa

SEQ ID NO: 203025 - DNA, 20 bp, Mus musculus
actgatcttttcctaatcag

SEQ ID NO: 203026 - DNA, 22 bp, Mus musculus
tgagtctatgtctggagggttt

SEQ ID NO: 203027 - DNA, 23 bp, Mus musculus
gataacagtctgataatcacgga

SEQ ID NO: 203028 - DNA, 23 bp, Mus musculus
ctgtgtcagaggactgtttccag

SEQ ID NO: 203029 - DNA, 20 bp, Mus musculus
agagtcatgattgagagcag

SEQ ID NO: 203030 - DNA, 18 bp, Mus musculus
ttttgcacgatctgtagt

SEQ ID NO: 203031 - DNA, 23 bp, Mus musculus
aagtgggcatcacagtccctgat

SEQ ID NO: 203032 - DNA, 23 bp, Mus musculus
ttgaagagagtcaggacagggac

SEQ ID NO: 203033 - DNA, 22 bp, Mus musculus
tgttttgtgaccaattatatgg

SEQ ID NO: 203034 - DNA, 22 bp, Mus musculus
atatatgtatatgtatgtgtat

SEQ ID NO: 203035 - DNA, 22 bp, Mus musculus
tgttttgtgaccaattatatgg

SEQ ID NO: 203036 - DNA, 19 bp, Mus musculus
tgtacagtctctttgtgtg

SEQ ID NO: 203037 - DNA, 23 bp, Mus musculus
tcactctcactctgaaataatcc

SEQ ID NO: 203038 - DNA, 20 bp, Mus musculus
tatttaggatgaaatgcaca

SEQ ID NO: 203039 - DNA, 23 bp, Mus musculus
tttctagggtgtagtttccttcc

SEQ ID NO: 203040 - DNA, 23 bp, Mus musculus
tcagtctcttcctattcctgtct

SEQ ID NO: 203041 - DNA, 19 bp, Mus musculus
tgtcagcgtccttgaatga

SEQ ID NO: 203042 - DNA, 23 bp, Mus musculus
aatgagtttggtactgatgtgaa

SEQ ID NO: 203043 - DNA, 20 bp, Mus musculus
acagagtctagtgttgtcag

SEQ ID NO: 203044 - DNA, 23 bp, Mus musculus
aagagaagacagactgctgtctc

SEQ ID NO: 203045 - DNA, 18 bp, Mus musculus
ctcagttttttggtgttt

SEQ ID NO: 203046 - DNA, 21 bp, Mus musculus
cactggagacactcctgactg

SEQ ID NO: 203047 - DNA, 23 bp, Mus musculus
gccactctctctgggtgtgtgcc

SEQ ID NO: 203048 - DNA, 23 bp, Mus musculus
accaattttaatttctatatatg

SEQ ID NO: 203049 - DNA, 22 bp, Mus musculus
tatgtgtatgtgcatgtgcatg

SEQ ID NO: 203050 - DNA, 23 bp, Mus musculus
tgtctgtgtctgtctgtcaatgt

SEQ ID NO: 203051 - DNA, 23 bp, Mus musculus
ttatgtctgtatatgtatgtgta

SEQ ID NO: 203052 - DNA, 22 bp, Mus musculus
ttatgtctgtatatgtatgtgt

SEQ ID NO: 203053 - DNA, 20 bp, Mus musculus
tgaaatgaattgaagatagt

SEQ ID NO: 203054 - DNA, 21 bp, Mus musculus
tctcactgtgtaaacctggct

SEQ ID NO: 203055 - DNA, 23 bp, Mus musculus
ccagtgtctgtctgtctgtctct

SEQ ID NO: 203056 - DNA, 21 bp, Mus musculus
tgtgtatgtatgtatgtatgt

SEQ ID NO: 203057 - DNA, 23 bp, Mus musculus
taatggctgtgcaagaagacact

SEQ ID NO: 203058 - DNA, 23 bp, Mus musculus
tgtcattcactgtgtggctgtca

SEQ ID NO: 203059 - DNA, 23 bp, Mus musculus
taaatgatgcctttagaacattt

SEQ ID NO: 203060 - DNA, 23 bp, Mus musculus
ctgctctcaaagactctctgtta

SEQ ID NO: 203061 - DNA, 21 bp, Mus musculus
ttatcttgctggagctggaga

SEQ ID NO: 203062 - DNA, 23 bp, Mus musculus
tctgtctgtcagactgtcaaagc

SEQ ID NO: 203063 - DNA, 19 bp, Mus musculus
atcaggccttctatcttgc

SEQ ID NO: 203064 - DNA, 23 bp, Mus musculus
tgtgtgtgtgtgtcgctccgtgt

SEQ ID NO: 203065 - DNA, 23 bp, Mus musculus
tgtggctctcatgctctctgtct

SEQ ID NO: 203066 - DNA, 23 bp, Mus musculus
aagagagtagtgagtaatgtcat

SEQ ID NO: 203067 - DNA, 23 bp, Mus musculus
acacaccgtctctctgtgacatg

SEQ ID NO: 203068 - DNA, 23 bp, Mus musculus
aaatttgtaggttggtgtgtatt

SEQ ID NO: 203069 - DNA, 21 bp, Mus musculus
atgtatgcatagtagtatgta

SEQ ID NO: 203070 - DNA, 23 bp, Mus musculus
tcagaggattagaaaatgtgtgt

SEQ ID NO: 203071 - DNA, 21 bp, Mus musculus
tgtgtgtgtggtatgcatgtg

SEQ ID NO: 203072 - DNA, 23 bp, Mus musculus
atgtatgagtgtgtatggtgtgt

SEQ ID NO: 203073 - DNA, 23 bp, Mus musculus
atgtgtgcatatatgtatgtgta

SEQ ID NO: 203074 - DNA, 23 bp, Mus musculus
catatatatgtgtgcagatatgt

SEQ ID NO: 203075 - DNA, 23 bp, Mus musculus
aagcagcaggcttctctggggct

SEQ ID NO: 203076 - DNA, 20 bp, Mus musculus
atatgtatattatttttgct

SEQ ID NO: 203077 - DNA, 23 bp, Mus musculus
catgtctgtcacaggctccctgt

SEQ ID NO: 203078 - DNA, 23 bp, Mus musculus
tacatctatatatgtatacgagt

SEQ ID NO: 203079 - DNA, 20 bp, Mus musculus
ggcagactcagtaaatggca

SEQ ID NO: 203080 - DNA, 18 bp, Mus musculus
agagctctgaggggagat

SEQ ID NO: 203081 - DNA, 23 bp, Mus musculus
ccctgtcacagtgtcattgtcct

SEQ ID NO: 203082 - DNA, 19 bp, Mus musculus
tgtaagttgaagttattca

SEQ ID NO: 203083 - DNA, 23 bp, Mus musculus
tatacagctggacagtgtcttgt

SEQ ID NO: 203084 - DNA, 19 bp, Mus musculus
atgtgtgtgtatgtatata

SEQ ID NO: 203085 - DNA, 19 bp, Mus musculus
tgcttactgacaaatgtga

SEQ ID NO: 203086 - DNA, 22 bp, Mus musculus
tgtgtttgtgtgtaagtgtatg

SEQ ID NO: 203087 - DNA, 21 bp, Mus musculus
ctcgtagttgcttgctttgtt

SEQ ID NO: 203088 - DNA, 23 bp, Mus musculus
ttcccagaacaagtagtatgcgc

SEQ ID NO: 203089 - DNA, 21 bp, Mus musculus
gtatatgtgtgcatgtgtatg

SEQ ID NO: 203090 - DNA, 20 bp, Mus musculus
tgtatgtatgcatgtgcaag

SEQ ID NO: 203091 - DNA, 21 bp, Mus musculus
tatgtgcatgcatatgtgttc

SEQ ID NO: 203092 - DNA, 22 bp, Mus musculus
atgtatgtatgcatgtgcatgt

SEQ ID NO: 203093 - DNA, 23 bp, Mus musculus
tatgtgtgtctctgtgtgtgcat

SEQ ID NO: 203094 - DNA, 21 bp, Mus musculus
atgcatgtgtgtatgtgcatg

SEQ ID NO: 203095 - DNA, 22 bp, Mus musculus
atgtatgtgtgcatgtgcatgt

SEQ ID NO: 203096 - DNA, 22 bp, Mus musculus
atgtgtacacatgtgcttgcat

SEQ ID NO: 203097 - DNA, 22 bp, Mus musculus
tgtgtgtgtgtgcatgtgcatg

SEQ ID NO: 203098 - DNA, 20 bp, Mus musculus
atgtgcatgtatatgtgtgt

SEQ ID NO: 203099 - DNA, 23 bp, Mus musculus
tccctctgtccctctgtcacgcc

SEQ ID NO: 203100 - DNA, 18 bp, Mus musculus
aaaggagataaggctggc

SEQ ID NO: 203101 - DNA, 23 bp, Mus musculus
tcactgcttgtctgtctgtctct

SEQ ID NO: 203102 - DNA, 23 bp, Mus musculus
tcagatagttggatgtttggtcc

SEQ ID NO: 203103 - DNA, 23 bp, Mus musculus
ctcactgatgagacagtggacgt

SEQ ID NO: 203104 - DNA, 23 bp, Mus musculus
gctctctggctctggctcttttc

SEQ ID NO: 203105 - DNA, 23 bp, Mus musculus
ccagtctcacactctctctgcct

SEQ ID NO: 203106 - DNA, 23 bp, Mus musculus
ttgcaggaactgttcagggaatg

SEQ ID NO: 203107 - DNA, 21 bp, Mus musculus
atgactgatgaatgtgaggtg

SEQ ID NO: 203108 - DNA, 23 bp, Mus musculus
tctgtgtgtctgtgtctgcatgc

SEQ ID NO: 203109 - DNA, 23 bp, Mus musculus
gagtccatggtggtctgatagga

SEQ ID NO: 203110 - DNA, 23 bp, Mus musculus
ttgtgaccaattatattgtcaat

SEQ ID NO: 203111 - DNA, 23 bp, Mus musculus
tctccaatatttttcattaaaaa

SEQ ID NO: 203112 - DNA, 19 bp, Mus musculus
actcactgagtcactcagg

SEQ ID NO: 203113 - DNA, 23 bp, Mus musculus
aaactctaaggtaagcatcagac

SEQ ID NO: 203114 - DNA, 19 bp, Mus musculus
atgccactagcttgcatag

SEQ ID NO: 203115 - DNA, 23 bp, Mus musculus
aggaccatgaacattgtgctctg

SEQ ID NO: 203116 - DNA, 22 bp, Mus musculus
tgactggaacctctgtgtaaat

SEQ ID NO: 203117 - DNA, 23 bp, Mus musculus
aaaaggagagactttgttgatgt

SEQ ID NO: 203118 - DNA, 20 bp, Mus musculus
agtctcagtgtatatgttca

SEQ ID NO: 203119 - DNA, 23 bp, Mus musculus
tgtctgtctgtctctctccctgt

SEQ ID NO: 203120 - DNA, 23 bp, Mus musculus
tgtgtgtgtctatctgtctgtgt

SEQ ID NO: 203121 - DNA, 23 bp, Mus musculus
gtctctgtctctgtctcgctgac

SEQ ID NO: 203122 - DNA, 23 bp, Mus musculus
ctcattctcagcttcctatttcc

SEQ ID NO: 203123 - DNA, 23 bp, Mus musculus
tatgacaggcagctttgagagtg

SEQ ID NO: 203124 - DNA, 20 bp, Mus musculus
tgagcctgtgtgtcaggcac

SEQ ID NO: 203125 - DNA, 22 bp, Mus musculus
atttccttgagagtggctttca

SEQ ID NO: 203126 - DNA, 20 bp, Mus musculus
tctgtctgtccgtctgtaac

SEQ ID NO: 203127 - DNA, 18 bp, Mus musculus
aaaggttctgagttcaaa

SEQ ID NO: 203128 - DNA, 22 bp, Mus musculus
agacactgtggcttacacctgt

SEQ ID NO: 203129 - DNA, 21 bp, Mus musculus
tgaggtaggagcatgaagagt

SEQ ID NO: 203130 - DNA, 23 bp, Mus musculus
atacatgttctttatctgttgtc

SEQ ID NO: 203131 - DNA, 22 bp, Mus musculus
ttttggacaatgaggaatatgt

SEQ ID NO: 203132 - DNA, 23 bp, Mus musculus
caggctgtctctgagtgtgggag

SEQ ID NO: 203133 - DNA, 22 bp, Mus musculus
tgttttgtgaccaattatatgg

SEQ ID NO: 203134 - DNA, 22 bp, Mus musculus
tgttttgtgaccaattatatgg

SEQ ID NO: 203135 - DNA, 23 bp, Mus musculus
tctgttttgttagttctgagtat

SEQ ID NO: 203136 - DNA, 23 bp, Mus musculus
cattctaagtagaaagcagaagc

SEQ ID NO: 203137 - DNA, 21 bp, Mus musculus
agaggtttttccctaagccac

SEQ ID NO: 203138 - DNA, 22 bp, Mus musculus
tgagaggtaagaaaatcagaga

SEQ ID NO: 203139 - DNA, 22 bp, Mus musculus
tttcacctgtttgtgttttcct

SEQ ID NO: 203140 - DNA, 23 bp, Mus musculus
aatgagactgggactgtaaacct

SEQ ID NO: 203141 - DNA, 20 bp, Mus musculus
taatgtatatgtatatgtat

SEQ ID NO: 203142 - DNA, 21 bp, Mus musculus
tacactacacatatacatcta

SEQ ID NO: 203143 - DNA, 18 bp, Mus musculus
atatacatgtatgcatat

SEQ ID NO: 203144 - DNA, 19 bp, Mus musculus
tgtgtagtgtatatgtata

SEQ ID NO: 203145 - DNA, 18 bp, Mus musculus
tagactgtgatgcatgga

SEQ ID NO: 203146 - DNA, 23 bp, Mus musculus
tctatctgtctgtctgtctgtcc

SEQ ID NO: 203147 - DNA, 23 bp, Mus musculus
agaacaatagaaaagtgttagtt

SEQ ID NO: 203148 - DNA, 22 bp, Mus musculus
tgttttgtgaccaattatatgg

SEQ ID NO: 203149 - DNA, 19 bp, Mus musculus
tcagagggttctaagctgg

SEQ ID NO: 203150 - DNA, 23 bp, Mus musculus
tagtccatggtgatctgatagga

SEQ ID NO: 203151 - DNA, 23 bp, Mus musculus
tctagctccatgtgatatgccac

SEQ ID NO: 203152 - DNA, 22 bp, Mus musculus
tgttttgtgaccaattatatgg

SEQ ID NO: 203153 - DNA, 22 bp, Mus musculus
tgttttgtgaccaattatatgg

SEQ ID NO: 203154 - DNA, 23 bp, Mus musculus
tctcagccacagtctctgccaag

SEQ ID NO: 203155 - DNA, 20 bp, Mus musculus
tgactacattctactttgtg

SEQ ID NO: 203156 - DNA, 23 bp, Mus musculus
tcaggatctgtcagtgcctctca

SEQ ID NO: 203157 - DNA, 23 bp, Mus musculus
taagtttcagcagtgattttgat

SEQ ID NO: 203158 - DNA, 22 bp, Mus musculus
tgttttgtgaccaattatatgg

SEQ ID NO: 203159 - DNA, 22 bp, Mus musculus
tgttttgtgaccaattatatgg

SEQ ID NO: 203160 - DNA, 23 bp, Mus musculus
tgtgttttctgagtgtctatatg

SEQ ID NO: 203161 - DNA, 23 bp, Mus musculus
tcagcagcatgtaaggatcacag

SEQ ID NO: 203162 - DNA, 23 bp, Mus musculus
actcagaaatctgcctgcctctg

SEQ ID NO: 203163 - DNA, 21 bp, Mus musculus
tgtagtctctggcttagtccc

SEQ ID NO: 203164 - DNA, 20 bp, Mus musculus
tcgctctgtctctgtctaca

SEQ ID NO: 203165 - DNA, 23 bp, Mus musculus
atgagcatctgcatctgtattgg

SEQ ID NO: 203166 - DNA, 23 bp, Mus musculus
tcaatatttttgtatctgttgag

SEQ ID NO: 203167 - DNA, 22 bp, Mus musculus
tgttttgtgaccaattatatgg

SEQ ID NO: 203168 - DNA, 23 bp, Mus musculus
tagtgcatggtgatctgatagga

SEQ ID NO: 203169 - DNA, 23 bp, Mus musculus
gttcatggtgctctgataggatg

SEQ ID NO: 203170 - DNA, 22 bp, Mus musculus
tgttttgtgaccaattatatgg

SEQ ID NO: 203171 - DNA, 21 bp, Mus musculus
tgcgtgtctttctgcctgtat

SEQ ID NO: 203172 - DNA, 18 bp, Mus musculus
tgcccgggtattgactgt

SEQ ID NO: 203173 - DNA, 23 bp, Mus musculus
taattgactttgcttgttgtttt

SEQ ID NO: 203174 - DNA, 20 bp, Mus musculus
tataaggcagtagatcttat

SEQ ID NO: 203175 - DNA, 23 bp, Mus musculus
tgtatatgtgtatatgtatatgt

SEQ ID NO: 203176 - DNA, 23 bp, Mus musculus
tgtgtatgtgtatgtgtatgtgt

SEQ ID NO: 203177 - DNA, 23 bp, Mus musculus
tccacactgtggttgttgttatt

SEQ ID NO: 203178 - DNA, 22 bp, Mus musculus
tgttttgtgaccaattatatgg

SEQ ID NO: 203179 - DNA, 19 bp, Mus musculus
ctatatatatgtatatgta

SEQ ID NO: 203180 - DNA, 23 bp, Mus musculus
tgtgtgagcacatgtgtgagtgt

SEQ ID NO: 203181 - DNA, 23 bp, Mus musculus
gtttcactgtttgcttatgatct

SEQ ID NO: 203182 - DNA, 23 bp, Mus musculus
agcatctgcctctgtatctgtca

SEQ ID NO: 203183 - DNA, 23 bp, Mus musculus
tagtcctttgtgacctgatagga

SEQ ID NO: 203184 - DNA, 23 bp, Mus musculus
tagtgcatggtgatctgatagga

SEQ ID NO: 203185 - DNA, 22 bp, Mus musculus
tgttttgtgacctattatgtgg

SEQ ID NO: 203186 - DNA, 22 bp, Mus musculus
gtatgtatgcttatgtaggcat

SEQ ID NO: 203187 - DNA, 23 bp, Mus musculus
ctgtgtctctgtttactttctgt

SEQ ID NO: 203188 - DNA, 23 bp, Mus musculus
aggatctgtccattgatgagagt

SEQ ID NO: 203189 - DNA, 23 bp, Mus musculus
cagactcacaggctcacagactc

SEQ ID NO: 203190 - DNA, 23 bp, Mus musculus
tgtgtagaacatactgttaggtg

SEQ ID NO: 203191 - DNA, 22 bp, Mus musculus
ttttgttctaggttgaaatgtt

SEQ ID NO: 203192 - DNA, 23 bp, Mus musculus
tgtctatgtgtatatatgatgta

SEQ ID NO: 203193 - DNA, 23 bp, Mus musculus
tagctttttcacagctgactttt

SEQ ID NO: 203194 - DNA, 23 bp, Mus musculus
tgcctcactgataatgaagggca

SEQ ID NO: 203195 - DNA, 22 bp, Mus musculus
tgttttgtgaccaattatatgg

SEQ ID NO: 203196 - DNA, 20 bp, Mus musculus
tgtctgtctggaatgaaggc

SEQ ID NO: 203197 - DNA, 22 bp, Mus musculus
tgttttgtgaccaattatatgg

SEQ ID NO: 203198 - DNA, 23 bp, Mus musculus
aggatctgtccattgatgagagt

SEQ ID NO: 203199 - DNA, 23 bp, Mus musculus
acttgatagtgcatcgtctttca

SEQ ID NO: 203200 - DNA, 19 bp, Mus musculus
atgacaggattgttctctg

SEQ ID NO: 203201 - DNA, 23 bp, Mus musculus
gagacagagagtcagagagacag

SEQ ID NO: 203202 - DNA, 22 bp, Mus musculus
tgagtaaagattcactgctgtg

SEQ ID NO: 203203 - DNA, 23 bp, Mus musculus
gctaattttggtactgtaagagt

SEQ ID NO: 203204 - DNA, 23 bp, Mus musculus
tctctgacagcaagttgttatga

SEQ ID NO: 203205 - DNA, 23 bp, Mus musculus
tccatgacctgactgtctgggag

SEQ ID NO: 203206 - DNA, 23 bp, Mus musculus
cacctgtcatactgtgtctcttt

SEQ ID NO: 203207 - DNA, 20 bp, Mus musculus
aatgaggagaggctggtgag

SEQ ID NO: 203208 - DNA, 23 bp, Mus musculus
aagagctaggttatgatggcatt

SEQ ID NO: 203209 - DNA, 22 bp, Mus musculus
aaactctgatgggtagtgtgag

SEQ ID NO: 203210 - DNA, 23 bp, Mus musculus
tgcagatgcagcgtgggtcaaag

SEQ ID NO: 203211 - DNA, 22 bp, Mus musculus
tgtcactctgtctcaactctgc

SEQ ID NO: 203212 - DNA, 23 bp, Mus musculus
ggctgcctgcctgcctgcctgtg

SEQ ID NO: 203213 - DNA, 23 bp, Mus musculus
atatgaatatgtttatatgtgta

SEQ ID NO: 203214 - DNA, 23 bp, Mus musculus
catgtgtgtgtatctatatatcc

SEQ ID NO: 203215 - DNA, 20 bp, Mus musculus
ttgcattgactcatttgtgt

SEQ ID NO: 203216 - DNA, 23 bp, Mus musculus
ttaatgtgtgtgcttgtgatgac

SEQ ID NO: 203217 - DNA, 23 bp, Mus musculus
gggtcagtctgactctgggtgtg

SEQ ID NO: 203218 - DNA, 20 bp, Mus musculus
tttgtgtgtgtatatgaata

SEQ ID NO: 203219 - DNA, 22 bp, Mus musculus
agacatgtgggtcctggcttga

SEQ ID NO: 203220 - DNA, 23 bp, Mus musculus
ttctatatttatattgtacatgt

SEQ ID NO: 203221 - DNA, 23 bp, Mus musculus
tgtgtgtgtgcatgtgtatgtgt

SEQ ID NO: 203222 - DNA, 21 bp, Mus musculus
atatgtgtatatatatatgta

SEQ ID NO: 203223 - DNA, 23 bp, Mus musculus
acacagaccagactgtgcactct

SEQ ID NO: 203224 - DNA, 23 bp, Mus musculus
tgtgtctgtgtgtctctccattt

SEQ ID NO: 203225 - DNA, 22 bp, Mus musculus
tgttttgtgaccaattatatgg

SEQ ID NO: 203226 - DNA, 22 bp, Mus musculus
tatatgtatgtgtatatgtata

SEQ ID NO: 203227 - DNA, 22 bp, Mus musculus
tgttttgtgaccaattatatgg

SEQ ID NO: 203228 - DNA, 20 bp, Mus musculus
atatatgtagaagatatatg

SEQ ID NO: 203229 - DNA, 23 bp, Mus musculus
tcatctctccagtccctctgtct

SEQ ID NO: 203230 - DNA, 22 bp, Mus musculus
tgttttgtgaccaattatatgg

SEQ ID NO: 203231 - DNA, 22 bp, Mus musculus
tgttttgtgaccaattatatgg

SEQ ID NO: 203232 - DNA, 22 bp, Mus musculus
cagacatatgtgtatgagtata

SEQ ID NO: 203233 - DNA, 23 bp, Mus musculus
ctgtgtccaggagtctctgtcat

SEQ ID NO: 203234 - DNA, 23 bp, Mus musculus
agtctcactgtgacttttgtctg

SEQ ID NO: 203235 - DNA, 21 bp, Mus musculus
tatgtatgtatgtatgtatga

SEQ ID NO: 203236 - DNA, 20 bp, Mus musculus
atacgtatatatttgtgtat

SEQ ID NO: 203237 - DNA, 23 bp, Mus musculus
tacatacaatttctcatgctaat

SEQ ID NO: 203238 - DNA, 23 bp, Mus musculus
tatgtcagtggctttcttgcttc

SEQ ID NO: 203239 - DNA, 20 bp, Mus musculus
attctcactgggacatatat

SEQ ID NO: 203240 - DNA, 20 bp, Mus musculus
tgagataagagtgtcagtac

SEQ ID NO: 203241 - DNA, 23 bp, Mus musculus
attctagtctgcatttggctctc

SEQ ID NO: 203242 - DNA, 23 bp, Mus musculus
taattctgtcatctattgacttc

SEQ ID NO: 203243 - DNA, 23 bp, Mus musculus
cctgacttgggaagttgtgtgta

SEQ ID NO: 203244 - DNA, 23 bp, Mus musculus
gggctcactctgcctctctgtgg

SEQ ID NO: 203245 - DNA, 19 bp, Mus musculus
ccattgtactgtctttctg

SEQ ID NO: 203246 - DNA, 23 bp, Mus musculus
tattagacagcagagagagcaga

SEQ ID NO: 203247 - DNA, 20 bp, Mus musculus
atggaaatacaagatgcgtt

SEQ ID NO: 203248 - DNA, 23 bp, Mus musculus
ctcactcagaggctccttgggtg

SEQ ID NO: 203249 - DNA, 19 bp, Mus musculus
tcctactggctctgcagga

SEQ ID NO: 203250 - DNA, 23 bp, Mus musculus
ttgcatactttctgatatagttt

SEQ ID NO: 203251 - DNA, 21 bp, Mus musculus
taactgactgctcttcctgtc

SEQ ID NO: 203252 - DNA, 23 bp, Mus musculus
aaaactctaaatctgaagatgaa

SEQ ID NO: 203253 - DNA, 19 bp, Mus musculus
tgtgagaggttcaggtgag

SEQ ID NO: 203254 - DNA, 22 bp, Mus musculus
tgtgtatatatgtatatgtgtg

SEQ ID NO: 203255 - DNA, 23 bp, Mus musculus
tgcaataacagtgaaaagagaag

SEQ ID NO: 203256 - DNA, 23 bp, Mus musculus
gtatgtatgtatgtatgtgtatg

SEQ ID NO: 203257 - DNA, 23 bp, Mus musculus
gtctgtaagactttcctctttct

SEQ ID NO: 203258 - DNA, 22 bp, Mus musculus
atagacagatgacagttggatg

SEQ ID NO: 203259 - DNA, 23 bp, Mus musculus
tggctctcacactctttctatgt

SEQ ID NO: 203260 - DNA, 23 bp, Mus musculus
tgtgtctgtctgtctgtctgtct

SEQ ID NO: 203261 - DNA, 23 bp, Mus musculus
tactgagtgccaacttttagtga

SEQ ID NO: 203262 - DNA, 23 bp, Mus musculus
acactgaagattgtcagcaagtg

SEQ ID NO: 203263 - DNA, 23 bp, Mus musculus
tgtgtgcctgtgtgcctgtgtgt

SEQ ID NO: 203264 - DNA, 23 bp, Mus musculus
agtaagagaagtgagttagctct

SEQ ID NO: 203265 - DNA, 22 bp, Mus musculus
tctctcggtggctcagacggtt

SEQ ID NO: 203266 - DNA, 23 bp, Mus musculus
accttgctgttgtagcctgactg

SEQ ID NO: 203267 - DNA, 23 bp, Mus musculus
ttttcatctccagctctatctga

SEQ ID NO: 203268 - DNA, 20 bp, Mus musculus
cgagcaagtcacaggcatat

SEQ ID NO: 203269 - DNA, 22 bp, Mus musculus
atctctgatgctgagggtgcat

SEQ ID NO: 203270 - DNA, 23 bp, Mus musculus
gatggatatggaatgtatataga

SEQ ID NO: 203271 - DNA, 22 bp, Mus musculus
cttggtgagcatctacctggtc

SEQ ID NO: 203272 - DNA, 18 bp, Mus musculus
tgtgtgtgcatgtgtatg

SEQ ID NO: 203273 - DNA, 23 bp, Mus musculus
tacatgagtgtcagctctctgtc

SEQ ID NO: 203274 - DNA, 21 bp, Mus musculus
tctcccagtctccctgcctca

SEQ ID NO: 203275 - DNA, 19 bp, Mus musculus
gacgcaagcttttgatccc

SEQ ID NO: 203276 - DNA, 21 bp, Mus musculus
tcagtgagctccaggtttggt

SEQ ID NO: 203277 - DNA, 23 bp, Mus musculus
acggtctcacagagtgatgtaag

SEQ ID NO: 203278 - DNA, 23 bp, Mus musculus
tgtgactgtctttctctggttgg

SEQ ID NO: 203279 - DNA, 23 bp, Mus musculus
tgactcagaggttaagagcactg

SEQ ID NO: 203280 - DNA, 21 bp, Mus musculus
ccctgtctgtctgtctgactg

SEQ ID NO: 203281 - DNA, 23 bp, Mus musculus
tctctgtgtatgtgtctgttgca

SEQ ID NO: 203282 - DNA, 23 bp, Mus musculus
gttctgactggctgagtgtcttc

SEQ ID NO: 203283 - DNA, 18 bp, Mus musculus
ttatccattcctaggact

SEQ ID NO: 203284 - DNA, 23 bp, Mus musculus
tgcttgtctcactgtctctcttg

SEQ ID NO: 203285 - DNA, 22 bp, Mus musculus
atgtgtatatatatatgtgtgt

SEQ ID NO: 203286 - DNA, 23 bp, Mus musculus
acatgtgcatgtgtatgtatata

SEQ ID NO: 203287 - DNA, 19 bp, Mus musculus
tatgtgcatagatatacac

SEQ ID NO: 203288 - DNA, 21 bp, Mus musculus
tctctctaaatctctttctgg

SEQ ID NO: 203289 - DNA, 21 bp, Mus musculus
actggatccaagactctctct

SEQ ID NO: 203290 - DNA, 20 bp, Mus musculus
gtctgaccatttctattcag

SEQ ID NO: 203291 - DNA, 19 bp, Mus musculus
atgtgtatatttatataag

SEQ ID NO: 203292 - DNA, 21 bp, Mus musculus
atttcattatgtatatatgta

SEQ ID NO: 203293 - DNA, 18 bp, Mus musculus
aaccatatgtgtatgtat

SEQ ID NO: 203294 - DNA, 18 bp, Mus musculus
tatatgtgtgtgtataca

SEQ ID NO: 203295 - DNA, 23 bp, Mus musculus
tatgtgtaaatatatatatgtgt

SEQ ID NO: 203296 - DNA, 23 bp, Mus musculus
tatgtatatgtttatgtacacac

SEQ ID NO: 203297 - DNA, 18 bp, Mus musculus
tatatgtgtgtatatgta

SEQ ID NO: 203298 - DNA, 23 bp, Mus musculus
acactgtggctgtcttcagatgc

SEQ ID NO: 203299 - DNA, 23 bp, Mus musculus
atcagtcacacgctctctcttct

SEQ ID NO: 203300 - DNA, 23 bp, Mus musculus
gggtgagaagtgacatgtttctt

SEQ ID NO: 203301 - DNA, 23 bp, Mus musculus
ctgtccctgtctctgactcagca

SEQ ID NO: 203302 - DNA, 21 bp, Mus musculus
tggctcagtctttattctctc

SEQ ID NO: 203303 - DNA, 20 bp, Mus musculus
ttgattgtagacagtgagct

SEQ ID NO: 203304 - DNA, 23 bp, Mus musculus
tctgtctgtcagagtctgctccc

SEQ ID NO: 203305 - DNA, 23 bp, Mus musculus
gtgtgccaccctgcctgcctgtg

SEQ ID NO: 203306 - DNA, 22 bp, Mus musculus
agtgctggggtgtgtatgtgtg

SEQ ID NO: 203307 - DNA, 21 bp, Mus musculus
tgagttacatgcagttttgga

SEQ ID NO: 203308 - DNA, 23 bp, Mus musculus
agtcgctccgtctgtgtcttatt

SEQ ID NO: 203309 - DNA, 22 bp, Mus musculus
tctgtccttacttacagtttgg

SEQ ID NO: 203310 - DNA, 23 bp, Mus musculus
ccttgatcagggcattgttgagt

SEQ ID NO: 203311 - DNA, 22 bp, Mus musculus
acaaccacccataatgagatct

SEQ ID NO: 203312 - DNA, 23 bp, Mus musculus
atggagctggagaaggagctgag

SEQ ID NO: 203313 - DNA, 23 bp, Mus musculus
tcactctctgaatagtgtctcac

SEQ ID NO: 203314 - DNA, 23 bp, Mus musculus
cacagagagtagtcagtgagcag

SEQ ID NO: 203315 - DNA, 23 bp, Mus musculus
agaactgagcaagttgttagact

SEQ ID NO: 203316 - DNA, 23 bp, Mus musculus
tctgtctctgtctctctctacaa

SEQ ID NO: 203317 - DNA, 21 bp, Mus musculus
taggaattgcaagatggcttc

SEQ ID NO: 203318 - DNA, 23 bp, Mus musculus
aagtgattttgtatatatgtgta

SEQ ID NO: 203319 - DNA, 19 bp, Mus musculus
ttatgcacatatgtatgta

SEQ ID NO: 203320 - DNA, 23 bp, Mus musculus
tatatagatgcatagcataactt

SEQ ID NO: 203321 - DNA, 20 bp, Mus musculus
tatgtgtgtgtatatgtata

SEQ ID NO: 203322 - DNA, 19 bp, Mus musculus
tacacacatattatatatg

SEQ ID NO: 203323 - DNA, 19 bp, Mus musculus
atacatgtgaatatgatgt

SEQ ID NO: 203324 - DNA, 23 bp, Mus musculus
gtatatatgcatatgtaggcata

SEQ ID NO: 203325 - DNA, 21 bp, Mus musculus
atatttgtacatactggtatg

SEQ ID NO: 203326 - DNA, 23 bp, Mus musculus
tgcatgtatgtatgtatgtatgt

SEQ ID NO: 203327 - DNA, 23 bp, Mus musculus
tatgtagaagctcagagagttag

SEQ ID NO: 203328 - DNA, 23 bp, Mus musculus
atctcagattctatatctatttg

SEQ ID NO: 203329 - DNA, 22 bp, Mus musculus
ggcaagaatttgaaatgttaga

SEQ ID NO: 203330 - DNA, 19 bp, Mus musculus
gagagagaatggtatctgt

SEQ ID NO: 203331 - DNA, 23 bp, Mus musculus
tagctgctctataagaaatggta

SEQ ID NO: 203332 - DNA, 23 bp, Mus musculus
cctctgtggctgagtctgtgatt

SEQ ID NO: 203333 - DNA, 22 bp, Mus musculus
tatatgcatacaaacatatgtg

SEQ ID NO: 203334 - DNA, 23 bp, Mus musculus
tgtctatgtgcatgtgcaagtgt

SEQ ID NO: 203335 - DNA, 18 bp, Mus musculus
aacttcagtggataggag

SEQ ID NO: 203336 - DNA, 23 bp, Mus musculus
ttgactgctgagagtgatctgac

SEQ ID NO: 203337 - DNA, 23 bp, Mus musculus
tgtgtacatattgatagatatag

SEQ ID NO: 203338 - DNA, 21 bp, Mus musculus
tatatgtatatatgcatatgt

SEQ ID NO: 203339 - DNA, 23 bp, Mus musculus
tgtgtgtgcatatctatgtgtat

SEQ ID NO: 203340 - DNA, 23 bp, Mus musculus
gaatctgcttaagtttgctgtaa

SEQ ID NO: 203341 - DNA, 19 bp, Mus musculus
tgagttattgcccataggg

SEQ ID NO: 203342 - DNA, 21 bp, Mus musculus
tatgtatacatattgcatttg

SEQ ID NO: 203343 - DNA, 19 bp, Mus musculus
tatgtatatatgtatgtac

SEQ ID NO: 203344 - DNA, 20 bp, Mus musculus
atatgtgtttgtgtatatgt

SEQ ID NO: 203345 - DNA, 18 bp, Mus musculus
tggcagcaggcttctttg

SEQ ID NO: 203346 - DNA, 23 bp, Mus musculus
tagtgcatggtgatctgatagga

SEQ ID NO: 203347 - DNA, 19 bp, Mus musculus
tttgtgacctattatgtgg

SEQ ID NO: 203348 - DNA, 23 bp, Mus musculus
tactatagagattttgttgacct

SEQ ID NO: 203349 - DNA, 23 bp, Mus musculus
aatgaactcaatggtattctgtg

SEQ ID NO: 203350 - DNA, 23 bp, Mus musculus
tgtgtgagcaagtgcatgtgcat

SEQ ID NO: 203351 - DNA, 20 bp, Mus musculus
gtatacacacacacacacat

SEQ ID NO: 203352 - DNA, 19 bp, Mus musculus
tatgtatatgtatacatat

SEQ ID NO: 203353 - DNA, 23 bp, Mus musculus
agctgagccagagaatgctgtga

SEQ ID NO: 203354 - DNA, 21 bp, Mus musculus
atacacacacatatatatatg

SEQ ID NO: 203355 - DNA, 23 bp, Mus musculus
aattcacattcatgcgagtaatg

SEQ ID NO: 203356 - DNA, 22 bp, Mus musculus
aagtgattcaacaaaggtgaaa

SEQ ID NO: 203357 - DNA, 23 bp, Mus musculus
tttctcacccattttcttgaaat

SEQ ID NO: 203358 - DNA, 23 bp, Mus musculus
acatacttcttcctccagtcatg

SEQ ID NO: 203359 - DNA, 23 bp, Mus musculus
ctgacttctccctgggtatggtg

SEQ ID NO: 203360 - DNA, 21 bp, Mus musculus
aaaagagaagagactgctgca

SEQ ID NO: 203361 - DNA, 23 bp, Mus musculus
agccaagtcagagacagacacag

SEQ ID NO: 203362 - DNA, 21 bp, Mus musculus
ttggtatgtgcaagtagttca

SEQ ID NO: 203363 - DNA, 23 bp, Mus musculus
tgccagtctgacagtctgagtct

SEQ ID NO: 203364 - DNA, 22 bp, Mus musculus
gagagtctcacttagtctcagg

SEQ ID NO: 203365 - DNA, 23 bp, Mus musculus
tgctcacagacttaagagaagcg

SEQ ID NO: 203366 - DNA, 21 bp, Mus musculus
ttatgagtagtgtgagtgcac

SEQ ID NO: 203367 - DNA, 23 bp, Mus musculus
tgcatgtgtgtatgtgtgtatat

SEQ ID NO: 203368 - DNA, 23 bp, Mus musculus
tatgtgtgcatatgtatatgtgt

SEQ ID NO: 203369 - DNA, 23 bp, Mus musculus
atatgtgtatgtgtatatgtgtg

SEQ ID NO: 203370 - DNA, 22 bp, Mus musculus
atacgtatgtatgcatgtgtgt

SEQ ID NO: 203371 - DNA, 22 bp, Mus musculus
tgtgcatgtttgtatatgtgcg

SEQ ID NO: 203372 - DNA, 21 bp, Mus musculus
atgtatgtgtgtatgtatatg

SEQ ID NO: 203373 - DNA, 23 bp, Mus musculus
aagctcagcatctctctgtgtgt

SEQ ID NO: 203374 - DNA, 23 bp, Mus musculus
tatgtgtgacagactgactgctg

SEQ ID NO: 203375 - DNA, 21 bp, Mus musculus
tataccatatctgttcgtatg

SEQ ID NO: 203376 - DNA, 18 bp, Mus musculus
aggtgttgaggctggaaa

SEQ ID NO: 203377 - DNA, 23 bp, Mus musculus
gtcttacactcactgtgtctcct

SEQ ID NO: 203378 - DNA, 22 bp, Mus musculus
tgtgagagagcagacacagctc

SEQ ID NO: 203379 - DNA, 23 bp, Mus musculus
tgacactgactgataatcatggc

SEQ ID NO: 203380 - DNA, 23 bp, Mus musculus
agtaacgggtttcactgagtcag

SEQ ID NO: 203381 - DNA, 23 bp, Mus musculus
tgtgcatatgtgtgtgcatatgt

SEQ ID NO: 203382 - DNA, 18 bp, Mus musculus
atgtatgcatgtgtgtgc

SEQ ID NO: 203383 - DNA, 20 bp, Mus musculus
tacacatgtgtatttgttat

SEQ ID NO: 203384 - DNA, 23 bp, Mus musculus
tgtgtctctgtttagtttctgtt

SEQ ID NO: 203385 - DNA, 23 bp, Mus musculus
tgtgtgtgtgtatgtatatgtat

SEQ ID NO: 203386 - DNA, 21 bp, Mus musculus
ctttcctcttctagcctcaat

SEQ ID NO: 203387 - DNA, 18 bp, Mus musculus
tatatatgtatgtgtgtg

SEQ ID NO: 203388 - DNA, 23 bp, Mus musculus
agtctgcctctgtgtgtctctgt

SEQ ID NO: 203389 - DNA, 21 bp, Mus musculus
tgagtgtgtgtgtctgtgtat

SEQ ID NO: 203390 - DNA, 19 bp, Mus musculus
ttcatgactaatatgattc

SEQ ID NO: 203391 - DNA, 20 bp, Mus musculus
tgtgtgtgtgcatgtgtata

SEQ ID NO: 203392 - DNA, 21 bp, Mus musculus
atagttcatatatatactgta

SEQ ID NO: 203393 - DNA, 22 bp, Mus musculus
atcagagagcagacagtgatca

SEQ ID NO: 203394 - DNA, 23 bp, Mus musculus
aatgtgcatgtatatatgtgtgt

SEQ ID NO: 203395 - DNA, 23 bp, Mus musculus
aatatgtatgtatatgtatgtgt

SEQ ID NO: 203396 - DNA, 19 bp, Mus musculus
tgtgtacatattatatgca

SEQ ID NO: 203397 - DNA, 19 bp, Mus musculus
aaatgtgcaatgggagatg

SEQ ID NO: 203398 - DNA, 23 bp, Mus musculus
tgtctgtctgtctgtctgtctgt

SEQ ID NO: 203399 - DNA, 23 bp, Mus musculus
ataatgtgtgtttttgaactggt

SEQ ID NO: 203400 - DNA, 20 bp, Mus musculus
tgaggtagaaggatcctgag

SEQ ID NO: 203401 - DNA, 23 bp, Mus musculus
aagcactgactgctcttccagag

SEQ ID NO: 203402 - DNA, 22 bp, Mus musculus
tgagtgtgttgcttgcatgtat

SEQ ID NO: 203403 - DNA, 23 bp, Mus musculus
tttggctctcactctcagtgacc

SEQ ID NO: 203404 - DNA, 23 bp, Mus musculus
acagtcagagccatggtgctagg

SEQ ID NO: 203405 - DNA, 22 bp, Mus musculus
tatatgtatgtgtgtatatgta

SEQ ID NO: 203406 - DNA, 22 bp, Mus musculus
gctctgcctctgtgtctgggtg

SEQ ID NO: 203407 - DNA, 23 bp, Mus musculus
gcagtggttgtagtatgtagtgt

SEQ ID NO: 203408 - DNA, 21 bp, Mus musculus
gtcaacatttctttgtgtctg

SEQ ID NO: 203409 - DNA, 23 bp, Mus musculus
tgtctctctgtgtgtgtctctct

SEQ ID NO: 203410 - DNA, 22 bp, Mus musculus
atgtgtgcatgcatgtgtgtgt

SEQ ID NO: 203411 - DNA, 23 bp, Mus musculus
tagtggcatctgcttgtctaggt

SEQ ID NO: 203412 - DNA, 23 bp, Mus musculus
agcactgactgctcttccagagg

SEQ ID NO: 203413 - DNA, 23 bp, Mus musculus
acatgtatgtgtgcatgtgtgtg

SEQ ID NO: 203414 - DNA, 23 bp, Mus musculus
agtttggctgggtatagtagtct

SEQ ID NO: 203415 - DNA, 18 bp, Mus musculus
accatctttccagccctg

SEQ ID NO: 203416 - DNA, 19 bp, Mus musculus
atatatgtatgcattggca

SEQ ID NO: 203417 - DNA, 22 bp, Mus musculus
tgttttgtgaccaattatatgg

SEQ ID NO: 203418 - DNA, 23 bp, Mus musculus
tattagagtgaggtttactagaa

SEQ ID NO: 203419 - DNA, 22 bp, Mus musculus
tgaaatttactagagttagtat

SEQ ID NO: 203420 - DNA, 21 bp, Mus musculus
cggtgtgtgtgtgagagtgtg

SEQ ID NO: 203421 - DNA, 20 bp, Mus musculus
atatcatctatctgtatgtc

SEQ ID NO: 203422 - DNA, 19 bp, Mus musculus
gtatgtatgtatgtatgta

SEQ ID NO: 203423 - DNA, 22 bp, Mus musculus
tgttttgtgaccaattatatgg

SEQ ID NO: 203424 - DNA, 23 bp, Mus musculus
ctctgtgtgtgattatgtctgtg

SEQ ID NO: 203425 - DNA, 22 bp, Mus musculus
tgttttgtgaccaattatatgg

SEQ ID NO: 203426 - DNA, 21 bp, Mus musculus
cagtgaaccagctctccagct

SEQ ID NO: 203427 - DNA, 21 bp, Mus musculus
gtggtactaggatctatactg

SEQ ID NO: 203428 - DNA, 23 bp, Mus musculus
cagtgcgtgtatgtgtgtgtgcg

SEQ ID NO: 203429 - DNA, 23 bp, Mus musculus
acatctgtatatgtacatgtgtg

SEQ ID NO: 203430 - DNA, 23 bp, Mus musculus
taaatgaatgctaatgttgaggt

SEQ ID NO: 203431 - DNA, 21 bp, Mus musculus
tatcagttgcaaaatgcttct

SEQ ID NO: 203432 - DNA, 23 bp, Mus musculus
tatgtatatatgtatgtatatgt

SEQ ID NO: 203433 - DNA, 23 bp, Mus musculus
tatgactagactcacatagtgct

SEQ ID NO: 203434 - DNA, 23 bp, Mus musculus
ttgtctgactctgtgatttagtc

SEQ ID NO: 203435 - DNA, 19 bp, Mus musculus
tggtcattttctaaactct

SEQ ID NO: 203436 - DNA, 23 bp, Mus musculus
tctctggaattctgaaagtatgc

SEQ ID NO: 203437 - DNA, 23 bp, Mus musculus
tgtgtgtatgtatatatgtgtgt

SEQ ID NO: 203438 - DNA, 18 bp, Mus musculus
tatatgtgcatgtgtatg

SEQ ID NO: 203439 - DNA, 21 bp, Mus musculus
tgtgtatgtatatatgtgcat

SEQ ID NO: 203440 - DNA, 23 bp, Mus musculus
tgtatgcatatttgtgtgtatgt

SEQ ID NO: 203441 - DNA, 23 bp, Mus musculus
tgtgtatatgtattcatatgtgt

SEQ ID NO: 203442 - DNA, 23 bp, Mus musculus
atatgtatatatgtatatgtatg

SEQ ID NO: 203443 - DNA, 19 bp, Mus musculus
aagcacattttcattttct

SEQ ID NO: 203444 - DNA, 23 bp, Mus musculus
gaattcacagtgaactttctgga

SEQ ID NO: 203445 - DNA, 22 bp, Mus musculus
tgttttgtgaccaattatatgg

SEQ ID NO: 203446 - DNA, 22 bp, Mus musculus
tgttttgtgaccaattatatgg

SEQ ID NO: 203447 - DNA, 21 bp, Mus musculus
gtgtgtgtgtgtgtgtgcatg

SEQ ID NO: 203448 - DNA, 19 bp, Mus musculus
acaagagtggcttacttta

SEQ ID NO: 203449 - DNA, 22 bp, Mus musculus
tgttttgtgaccaattatatgg

SEQ ID NO: 203450 - DNA, 23 bp, Mus musculus
tatatgtatgtacatgtgtgtga

SEQ ID NO: 203451 - DNA, 19 bp, Mus musculus
tatgtgcatatattataca

SEQ ID NO: 203452 - DNA, 23 bp, Mus musculus
tgtatactgcaagggtattttgg

SEQ ID NO: 203453 - DNA, 23 bp, Mus musculus
tgtatgtgtgcatgtgcatgtgg

SEQ ID NO: 203454 - DNA, 22 bp, Mus musculus
atacagtgtgtatatgtatata

SEQ ID NO: 203455 - DNA, 21 bp, Mus musculus
tctcctagttcttacctgtgt

SEQ ID NO: 203456 - DNA, 23 bp, Mus musculus
aagtaagcatttgtcatggtttg

SEQ ID NO: 203457 - DNA, 23 bp, Mus musculus
gtgagtctgtgggacttcattac

SEQ ID NO: 203458 - DNA, 21 bp, Mus musculus
ttgtgagtagaatcacagcac

SEQ ID NO: 203459 - DNA, 20 bp, Mus musculus
tctgcttttttctacttacg

SEQ ID NO: 203460 - DNA, 22 bp, Mus musculus
taactccctgccaaaaatctga

SEQ ID NO: 203461 - DNA, 23 bp, Mus musculus
tcccactgtcagtgtgtgagggt

SEQ ID NO: 203462 - DNA, 23 bp, Mus musculus
agtttgttcaggttaagtttgtt

SEQ ID NO: 203463 - DNA, 22 bp, Mus musculus
gtaggagtgagtgaacacagag

SEQ ID NO: 203464 - DNA, 19 bp, Mus musculus
actggagagatggctcagc

SEQ ID NO: 203465 - DNA, 23 bp, Mus musculus
actacagggctttgacactctct

SEQ ID NO: 203466 - DNA, 23 bp, Mus musculus
acactgtttctcacactcagaag

SEQ ID NO: 203467 - DNA, 23 bp, Mus musculus
tgagaaatcacagtgtggagctg

SEQ ID NO: 203468 - DNA, 23 bp, Mus musculus
tgtcactgaggttgtgttttgtt

SEQ ID NO: 203469 - DNA, 23 bp, Mus musculus
aagaactatccagtggctggaga

SEQ ID NO: 203470 - DNA, 23 bp, Mus musculus
ttgttctcagagagcagacagtg

SEQ ID NO: 203471 - DNA, 23 bp, Mus musculus
aggactcggtcactctgacacta

SEQ ID NO: 203472 - DNA, 20 bp, Mus musculus
agtggtcattgagtaagggg

SEQ ID NO: 203473 - DNA, 22 bp, Mus musculus
tgagggcctgtgtaactgctgg

SEQ ID NO: 203474 - DNA, 23 bp, Mus musculus
gtctctgtctgtcagcttctaga

SEQ ID NO: 203475 - DNA, 20 bp, Mus musculus
tcactggttcttagtctcct

SEQ ID NO: 203476 - DNA, 22 bp, Mus musculus
tttttccttttggagatgagtg

SEQ ID NO: 203477 - DNA, 23 bp, Mus musculus
cccaggctctcagtctcactctt

SEQ ID NO: 203478 - DNA, 20 bp, Mus musculus
acagtgaagacagtgagctg

SEQ ID NO: 203479 - DNA, 23 bp, Mus musculus
tgtgtgtatgtgtgtctgtctgt

SEQ ID NO: 203480 - DNA, 22 bp, Mus musculus
tctctgactctcctttgcctca

SEQ ID NO: 203481 - DNA, 23 bp, Mus musculus
tgtaggaggaaaatttgcggttt

SEQ ID NO: 203482 - DNA, 23 bp, Mus musculus
tggctgggtcggtcagtgtgtca

SEQ ID NO: 203483 - DNA, 20 bp, Mus musculus
agttctgcttttcatgctgg

SEQ ID NO: 203484 - DNA, 23 bp, Mus musculus
cagttctctgtgtgtgagcatcc

SEQ ID NO: 203485 - DNA, 23 bp, Mus musculus
atctgtgtctgtgtcagtcagcg

SEQ ID NO: 203486 - DNA, 23 bp, Mus musculus
tgtctgcctcagtggctgcctgg

SEQ ID NO: 203487 - DNA, 19 bp, Mus musculus
taagatcttctgcagcttg

SEQ ID NO: 203488 - DNA, 23 bp, Mus musculus
aatctgcatgtgagcctgtgtac

SEQ ID NO: 203489 - DNA, 23 bp, Mus musculus
ctgtgtctgtctggcttacatgt

SEQ ID NO: 203490 - DNA, 23 bp, Mus musculus
acttggagatctgtctctgtctg

SEQ ID NO: 203491 - DNA, 23 bp, Mus musculus
tgtgtctgtccctctctcagcac

SEQ ID NO: 203492 - DNA, 23 bp, Mus musculus
actcctggcagacagacagacag

SEQ ID NO: 203493 - DNA, 23 bp, Mus musculus
tctgcagtcagtcagtctgtctg

SEQ ID NO: 203494 - DNA, 23 bp, Mus musculus
acttgagagttgactctgaggtt

SEQ ID NO: 203495 - DNA, 19 bp, Mus musculus
tcttctttagggtctcatc

SEQ ID NO: 203496 - DNA, 23 bp, Mus musculus
gtgtctcactctcagcctggctc

SEQ ID NO: 203497 - DNA, 18 bp, Mus musculus
cggagctggaggaggtga

SEQ ID NO: 203498 - DNA, 20 bp, Mus musculus
aagagcactgactgctcttc

SEQ ID NO: 203499 - DNA, 18 bp, Mus musculus
aacttctggagctggaga

SEQ ID NO: 203500 - DNA, 19 bp, Mus musculus
aaagcactgactgctcttc

SEQ ID NO: 203501 - DNA, 23 bp, Mus musculus
tgttcactcaattgtcacagcag

SEQ ID NO: 203502 - DNA, 23 bp, Mus musculus
aaggtgagtagtgaaattgttga

SEQ ID NO: 203503 - DNA, 23 bp, Mus musculus
tgagagtgttgtatgaatgtctt

SEQ ID NO: 203504 - DNA, 23 bp, Mus musculus
tctggagtcagtttctttttggc

SEQ ID NO: 203505 - DNA, 23 bp, Mus musculus
ttatctcagcaacagaaatgaaa

SEQ ID NO: 203506 - DNA, 22 bp, Mus musculus
tgttttgtgaccaattatatgg

SEQ ID NO: 203507 - DNA, 23 bp, Mus musculus
tgtctcactgtctcactgtctgc

SEQ ID NO: 203508 - DNA, 23 bp, Mus musculus
tgagtctctctcaaagcctcagt

SEQ ID NO: 203509 - DNA, 23 bp, Mus musculus
tgtggtggtctctgtctctgagt

SEQ ID NO: 203510 - DNA, 21 bp, Mus musculus
tgtgctacattgtgagagtga

SEQ ID NO: 203511 - DNA, 23 bp, Mus musculus
aggagctggagagatggcttggt

SEQ ID NO: 203512 - DNA, 23 bp, Mus musculus
caacagtctgtgtctctgtggca

SEQ ID NO: 203513 - DNA, 23 bp, Mus musculus
acccactgtggttttgactctgg

SEQ ID NO: 203514 - DNA, 23 bp, Mus musculus
gtctgtctgtctgtcagtctgtc

SEQ ID NO: 203515 - DNA, 23 bp, Mus musculus
catgtgtgtgtgtgtctgcgagt

SEQ ID NO: 203516 - DNA, 21 bp, Mus musculus
tcactggggaaacatgaagag

SEQ ID NO: 203517 - DNA, 21 bp, Mus musculus
aagagcactgactgctcttcc

SEQ ID NO: 203518 - DNA, 23 bp, Mus musculus
gctgtcactcactcagtttggcc

SEQ ID NO: 203519 - DNA, 21 bp, Mus musculus
tgtgctgtatgtgcactcaat

SEQ ID NO: 203520 - DNA, 20 bp, Mus musculus
tgtgtgtgtctgcctgcctg

SEQ ID NO: 203521 - DNA, 22 bp, Mus musculus
tcctgagttcaaatcctgacag

SEQ ID NO: 203522 - DNA, 19 bp, Mus musculus
tccctgcctgtttgttcag

SEQ ID NO: 203523 - DNA, 23 bp, Mus musculus
cagcctgggtggctccctgagac

SEQ ID NO: 203524 - DNA, 23 bp, Mus musculus
tttgtctgtgtctctctggttcc

SEQ ID NO: 203525 - DNA, 23 bp, Mus musculus
tccctctctgtgtcaggctgtgg

SEQ ID NO: 203526 - DNA, 22 bp, Mus musculus
tgctgtccctggctgaggtggg

SEQ ID NO: 203527 - DNA, 18 bp, Mus musculus
actggagagatggctcag

SEQ ID NO: 203528 - DNA, 22 bp, Mus musculus
tgtcagaggcattttgttaaat

SEQ ID NO: 203529 - DNA, 23 bp, Mus musculus
cctgtgactcagacactgtcatc

SEQ ID NO: 203530 - DNA, 22 bp, Mus musculus
tgcctccctctcagtggctctc

SEQ ID NO: 203531 - DNA, 23 bp, Mus musculus
ttgtgagtcactgagtgcctcgg

SEQ ID NO: 203532 - DNA, 23 bp, Mus musculus
tgagagccactgtgtctggctca

SEQ ID NO: 203533 - DNA, 21 bp, Mus musculus
tgtcttggtcatggtgtctgt

SEQ ID NO: 203534 - DNA, 23 bp, Mus musculus
tagtgcatggtgatctgatagga

SEQ ID NO: 203535 - DNA, 22 bp, Mus musculus
tgttttgtgacctattatgtgg

SEQ ID NO: 203536 - DNA, 23 bp, Mus musculus
tgtctctgactgtgacttgtccc

SEQ ID NO: 203537 - DNA, 20 bp, Mus musculus
actctgtatgcatgtgtatg

SEQ ID NO: 203538 - DNA, 23 bp, Mus musculus
acatgtgtgtatatgtatacatg

SEQ ID NO: 203539 - DNA, 23 bp, Mus musculus
aaaggacttgatgagctggagag

SEQ ID NO: 203540 - DNA, 22 bp, Mus musculus
tctctcactgagggtgatcttt

SEQ ID NO: 203541 - DNA, 23 bp, Mus musculus
tctctgggtctctcattctcact

SEQ ID NO: 203542 - DNA, 23 bp, Mus musculus
ctgtctgtctgtctgtctgtctg

SEQ ID NO: 203543 - DNA, 23 bp, Mus musculus
tgtcctgcctcacactccgtctc

SEQ ID NO: 203544 - DNA, 22 bp, Mus musculus
tgatcatgcccaactcctctca

SEQ ID NO: 203545 - DNA, 19 bp, Mus musculus
ggttaagacagaatagcct

SEQ ID NO: 203546 - DNA, 23 bp, Mus musculus
ctgtccctgtcttcagatgcacc

SEQ ID NO: 203547 - DNA, 23 bp, Mus musculus
gcccctctctgactgacacccac

SEQ ID NO: 203548 - DNA, 23 bp, Mus musculus
gtctctctgtcactctggttatc

SEQ ID NO: 203549 - DNA, 19 bp, Mus musculus
ttagtgccacactctgggc

SEQ ID NO: 203550 - DNA, 23 bp, Mus musculus
tgtgtatgtatatgtgtatgtat

SEQ ID NO: 203551 - DNA, 22 bp, Mus musculus
tgttttgtgaccaattatatgg

SEQ ID NO: 203552 - DNA, 23 bp, Mus musculus
tagtgtttagagattgtgtagtg

SEQ ID NO: 203553 - DNA, 22 bp, Mus musculus
atgagatgtgttttagaagtag

SEQ ID NO: 203554 - DNA, 20 bp, Mus musculus
aagtatgcacatgtgtgtgg

SEQ ID NO: 203555 - DNA, 19 bp, Mus musculus
acacacacagtcatacacg

SEQ ID NO: 203556 - DNA, 23 bp, Mus musculus
cagacagagctttgaataactga

SEQ ID NO: 203557 - DNA, 21 bp, Mus musculus
tgtatctgtgtgtgtgtatat

SEQ ID NO: 203558 - DNA, 20 bp, Mus musculus
tgtgggtgggtgtgtacctg

SEQ ID NO: 203559 - DNA, 23 bp, Mus musculus
tctgtgtctctgctaccacattc

SEQ ID NO: 203560 - DNA, 23 bp, Mus musculus
actagacagtttcttcttcatgc

SEQ ID NO: 203561 - DNA, 23 bp, Mus musculus
aggcattttgttatcatgctaga

SEQ ID NO: 203562 - DNA, 23 bp, Mus musculus
atgtcagtggggataggctttga

SEQ ID NO: 203563 - DNA, 23 bp, Mus musculus
agccagactcagtggctcactct

SEQ ID NO: 203564 - DNA, 21 bp, Mus musculus
atgtttgtgtgcatgtgcatg

SEQ ID NO: 203565 - DNA, 23 bp, Mus musculus
gcaggctctcacacagactcatg

SEQ ID NO: 203566 - DNA, 23 bp, Mus musculus
atcaatgagtccttgtcctgtgg

SEQ ID NO: 203567 - DNA, 23 bp, Mus musculus
atgtgtatatgtttatatgtgtg

SEQ ID NO: 203568 - DNA, 23 bp, Mus musculus
tgtgtgtatgtgtgtatgcatgt

SEQ ID NO: 203569 - DNA, 22 bp, Mus musculus
tgtttgacaggagtcagtgaag

SEQ ID NO: 203570 - DNA, 23 bp, Mus musculus
tgtcttgctgtctgtctccttca

SEQ ID NO: 203571 - DNA, 23 bp, Mus musculus
tctgtctgtgtgtgagagacaac

SEQ ID NO: 203572 - DNA, 18 bp, Mus musculus
tgcctgtgtgtctatata

SEQ ID NO: 203573 - DNA, 23 bp, Mus musculus
tataggtgtctatgcatatgtgt

SEQ ID NO: 203574 - DNA, 22 bp, Mus musculus
ctgtctgtctgtctgtctgtac

SEQ ID NO: 203575 - DNA, 18 bp, Mus musculus
agactgcatgaccagtgg

SEQ ID NO: 203576 - DNA, 23 bp, Mus musculus
actgtggtagtagttttctcttg

SEQ ID NO: 203577 - DNA, 20 bp, Mus musculus
agagtggtgagtgtggagag

SEQ ID NO: 203578 - DNA, 18 bp, Mus musculus
agacttctagatttcatt

SEQ ID NO: 203579 - DNA, 23 bp, Mus musculus
agtctcccagtctaactcagtgc

SEQ ID NO: 203580 - DNA, 23 bp, Mus musculus
aagatgtgtgattttgtagtttc

SEQ ID NO: 203581 - DNA, 23 bp, Mus musculus
ctcttttgtgttgtagcacttgt

SEQ ID NO: 203582 - DNA, 22 bp, Mus musculus
ttgggagcactttgagctctca

SEQ ID NO: 203583 - DNA, 23 bp, Mus musculus
agctttgggagcactgtctctct

SEQ ID NO: 203584 - DNA, 23 bp, Mus musculus
agccctgactgctcttccagagg

SEQ ID NO: 203585 - DNA, 23 bp, Mus musculus
tgtctgtgagtctgtccctccct

SEQ ID NO: 203586 - DNA, 18 bp, Mus musculus
tttctggtcttcccagtc

SEQ ID NO: 203587 - DNA, 22 bp, Mus musculus
attgactagaatatggaatctc

SEQ ID NO: 203588 - DNA, 23 bp, Mus musculus
aactaatccctgactgtgaaggt

SEQ ID NO: 203589 - DNA, 19 bp, Mus musculus
acacacacacatatacacg

SEQ ID NO: 203590 - DNA, 22 bp, Mus musculus
tgcatgcatgtatgtatgtacg

SEQ ID NO: 203591 - DNA, 23 bp, Mus musculus
cagtcaggtgttcctccagatga

SEQ ID NO: 203592 - DNA, 23 bp, Mus musculus
aggaaccctgatcttgaactctt

SEQ ID NO: 203593 - DNA, 21 bp, Mus musculus
tggagagtagagagggtgcag

SEQ ID NO: 203594 - DNA, 20 bp, Mus musculus
tgctatgtatagaacttaga

SEQ ID NO: 203595 - DNA, 23 bp, Mus musculus
aaacatggttgaggctgtgatag

SEQ ID NO: 203596 - DNA, 23 bp, Mus musculus
gtgtgtgtgtgtgtgcgtgcatg

SEQ ID NO: 203597 - DNA, 21 bp, Mus musculus
atgtatgtatgtatatgtgta

SEQ ID NO: 203598 - DNA, 23 bp, Mus musculus
tcagtggcagagtgcttgcctag

SEQ ID NO: 203599 - DNA, 20 bp, Mus musculus
gttcactctcactgacagac

SEQ ID NO: 203600 - DNA, 23 bp, Mus musculus
atatatatgtggaaccatttttg

SEQ ID NO: 203601 - DNA, 23 bp, Mus musculus
actgcaatgtagtatggtggttg

SEQ ID NO: 203602 - DNA, 22 bp, Mus musculus
aatgtttgtgatgagatggctc

SEQ ID NO: 203603 - DNA, 23 bp, Mus musculus
tctgtgtgtgtgtgtgtacatgc

SEQ ID NO: 203604 - DNA, 23 bp, Mus musculus
tctgcctgtgaacgtgtgcaggg

SEQ ID NO: 203605 - DNA, 23 bp, Mus musculus
tgagtgccttcacagtctctctg

SEQ ID NO: 203606 - DNA, 22 bp, Mus musculus
tatgtccctttgtcatcagacc

SEQ ID NO: 203607 - DNA, 22 bp, Mus musculus
agagtctgatgagagacaggcc

SEQ ID NO: 203608 - DNA, 22 bp, Mus musculus
tgttttgtgaccaattatatgg

SEQ ID NO: 203609 - DNA, 23 bp, Mus musculus
gagagaagaaggtgaggagttga

SEQ ID NO: 203610 - DNA, 22 bp, Mus musculus
tgttttgtgaccaattatatgg

SEQ ID NO: 203611 - DNA, 23 bp, Mus musculus
ttagagacgtgtgattttgctgt

SEQ ID NO: 203612 - DNA, 22 bp, Mus musculus
aagagtagtcagagaggtcaag

SEQ ID NO: 203613 - DNA, 21 bp, Mus musculus
tatgtgtgtgtgtgtgtctgt

SEQ ID NO: 203614 - DNA, 23 bp, Mus musculus
agtaagaccatctgcatctggag

SEQ ID NO: 203615 - DNA, 23 bp, Mus musculus
tgtgactgtcattggggtgtgtg

SEQ ID NO: 203616 - DNA, 18 bp, Mus musculus
aatgtggttaagcatgtg

SEQ ID NO: 203617 - DNA, 22 bp, Mus musculus
tgtgtgtatgtgtatgtatata

SEQ ID NO: 203618 - DNA, 23 bp, Mus musculus
tgtttgagccaggtaaagcatgg

SEQ ID NO: 203619 - DNA, 23 bp, Mus musculus
cttctgtatggttatctatctat

SEQ ID NO: 203620 - DNA, 23 bp, Mus musculus
tcactctctgtgtaaagtctggc

SEQ ID NO: 203621 - DNA, 19 bp, Mus musculus
tctgtgtctctctgtacat

SEQ ID NO: 203622 - DNA, 21 bp, Mus musculus
ctgaggattgatctcaggtca

SEQ ID NO: 203623 - DNA, 21 bp, Mus musculus
actgactgggagagttcaggc

SEQ ID NO: 203624 - DNA, 23 bp, Mus musculus
ttctctgtgtggttttcattctt

SEQ ID NO: 203625 - DNA, 23 bp, Mus musculus
tacaaataggttgttaatgtaaa

SEQ ID NO: 203626 - DNA, 22 bp, Mus musculus
tgttttgtgacctattatatgg

SEQ ID NO: 203627 - DNA, 22 bp, Mus musculus
tgttttgtgaccaattatatgg

SEQ ID NO: 203628 - DNA, 23 bp, Mus musculus
atatgtgtatgtatgtatatatg

SEQ ID NO: 203629 - DNA, 23 bp, Mus musculus
tgtgtctgtggttaaagtttctc

SEQ ID NO: 203630 - DNA, 23 bp, Mus musculus
agagatgtgactgtggtatggca

SEQ ID NO: 203631 - DNA, 18 bp, Mus musculus
atatgtatagatatgtat

SEQ ID NO: 203632 - DNA, 23 bp, Mus musculus
tatactagcctttgtgtgtgaat

SEQ ID NO: 203633 - DNA, 21 bp, Mus musculus
tttaacagtgaggaaatatat

SEQ ID NO: 203634 - DNA, 19 bp, Mus musculus
ttggcatttgtatatgaag

SEQ ID NO: 203635 - DNA, 23 bp, Mus musculus
ataagactatatatatatgtgtg

SEQ ID NO: 203636 - DNA, 22 bp, Mus musculus
aatgtgtgtctgtctgtgtctg

SEQ ID NO: 203637 - DNA, 23 bp, Mus musculus
tctttgttcttgactatggatgt

SEQ ID NO: 203638 - DNA, 23 bp, Mus musculus
gatgtgtataaattatatgtaaa

SEQ ID NO: 203639 - DNA, 20 bp, Mus musculus
gaagttccagccatatgatg

SEQ ID NO: 203640 - DNA, 20 bp, Mus musculus
atccaagttgttggaccaga

SEQ ID NO: 203641 - DNA, 22 bp, Mus musculus
tgagtatgtatgtatgtatgta

SEQ ID NO: 203642 - DNA, 23 bp, Mus musculus
gatcacatgtgtttttgtactgg

SEQ ID NO: 203643 - DNA, 21 bp, Mus musculus
tgtgaatttgtgaatttcatc

SEQ ID NO: 203644 - DNA, 23 bp, Mus musculus
agacaagaacctgaaagctacat

SEQ ID NO: 203645 - DNA, 23 bp, Mus musculus
tcacagaagtttgtctccacttt

SEQ ID NO: 203646 - DNA, 23 bp, Mus musculus
agagcctttctgtgtctgtctct

SEQ ID NO: 203647 - DNA, 22 bp, Mus musculus
atatatgtatatgtatatgtgt

SEQ ID NO: 203648 - DNA, 23 bp, Mus musculus
tgtgtgtgtgtgtatatgcatat

SEQ ID NO: 203649 - DNA, 23 bp, Mus musculus
tgtgtgtatgcttgatgtttgtc

SEQ ID NO: 203650 - DNA, 22 bp, Mus musculus
aggaatgacagcttaggttgtt

SEQ ID NO: 203651 - DNA, 19 bp, Mus musculus
gtatgtatgtatgtatgta

SEQ ID NO: 203652 - DNA, 23 bp, Mus musculus
atatgtacatgtagataccagaa

SEQ ID NO: 203653 - DNA, 23 bp, Mus musculus
agagatgacagtcaactgaattt

SEQ ID NO: 203654 - DNA, 19 bp, Mus musculus
tctctgcctgacacatctc

SEQ ID NO: 203655 - DNA, 22 bp, Mus musculus
tgaaaatctctcactcttcctt

SEQ ID NO: 203656 - DNA, 23 bp, Mus musculus
agtcaggagagagaggccactca

SEQ ID NO: 203657 - DNA, 22 bp, Mus musculus
tgttttgtgaccaattatatgg

SEQ ID NO: 203658 - DNA, 22 bp, Mus musculus
tgttttgtgaccaattatatgg

SEQ ID NO: 203659 - DNA, 22 bp, Mus musculus
tgttttgtgaccaattatatgg

SEQ ID NO: 203660 - DNA, 22 bp, Mus musculus
atcacacgcagcttacattaca

SEQ ID NO: 203661 - DNA, 20 bp, Mus musculus
cgctcagtatatgttctcat

SEQ ID NO: 203662 - DNA, 20 bp, Mus musculus
tgtgtatgtatgtatatgta

SEQ ID NO: 203663 - DNA, 23 bp, Mus musculus
tcactgcctcactgtcaggatgt

SEQ ID NO: 203664 - DNA, 23 bp, Mus musculus
ttctgggacttgttttggcagag

SEQ ID NO: 203665 - DNA, 23 bp, Mus musculus
atgtcactagagtctctctcaca

SEQ ID NO: 203666 - DNA, 19 bp, Mus musculus
tgtgtctgtgtgtatgttc

SEQ ID NO: 203667 - DNA, 21 bp, Mus musculus
tctgtgtatatatatgtgtgt

SEQ ID NO: 203668 - DNA, 23 bp, Mus musculus
tctttttcagagtactgtgatag

SEQ ID NO: 203669 - DNA, 23 bp, Mus musculus
ctcacctcactgtctctctgcat

SEQ ID NO: 203670 - DNA, 23 bp, Mus musculus
tcagtgagtgcataccatgtgtg

SEQ ID NO: 203671 - DNA, 23 bp, Mus musculus
ttctagttctattcatttgccta

SEQ ID NO: 203672 - DNA, 23 bp, Mus musculus
cggtctgtctgtctctgcctcct

SEQ ID NO: 203673 - DNA, 22 bp, Mus musculus
atgtatgtatagatgtatgtat

SEQ ID NO: 203674 - DNA, 18 bp, Mus musculus
atagatagatttatagat

SEQ ID NO: 203675 - DNA, 18 bp, Mus musculus
ctcctttgggtcctctta

SEQ ID NO: 203676 - DNA, 23 bp, Mus musculus
aagatgtctgtgtggactctggg

SEQ ID NO: 203677 - DNA, 23 bp, Mus musculus
tttaaatgagctccactgtgacc

SEQ ID NO: 203678 - DNA, 21 bp, Mus musculus
agtgaggtagtagcttgttca

SEQ ID NO: 203679 - DNA, 21 bp, Mus musculus
tcagttctgttattcatgaag

SEQ ID NO: 203680 - DNA, 22 bp, Mus musculus
atgtatgtatatatgtatgcac

SEQ ID NO: 203681 - DNA, 23 bp, Mus musculus
tacatgtgtgtatatgtacatat

SEQ ID NO: 203682 - DNA, 20 bp, Mus musculus
tgactcctcatttagttgtc

SEQ ID NO: 203683 - DNA, 18 bp, Mus musculus
cagaggtattgagttcaa

SEQ ID NO: 203684 - DNA, 18 bp, Mus musculus
attgtccattgaatagag

SEQ ID NO: 203685 - DNA, 23 bp, Mus musculus
tctcagtctctgcctctcaggga

SEQ ID NO: 203686 - DNA, 23 bp, Mus musculus
ttgagattaagaatcctgttatg

SEQ ID NO: 203687 - DNA, 23 bp, Mus musculus
tcttttgtgcatgtgtgtatata

SEQ ID NO: 203688 - DNA, 23 bp, Mus musculus
tatatgtatgaatgtatatttgt

SEQ ID NO: 203689 - DNA, 23 bp, Mus musculus
agagctttcaggatgtttacata

SEQ ID NO: 203690 - DNA, 23 bp, Mus musculus
tactgtgtcactctggcagtctc

SEQ ID NO: 203691 - DNA, 21 bp, Mus musculus
tgcaggtcagaaaaacagagc

SEQ ID NO: 203692 - DNA, 21 bp, Mus musculus
tgtatatgtatggctatgtat

SEQ ID NO: 203693 - DNA, 22 bp, Mus musculus
tatgtctatgtatatatgtgcg

SEQ ID NO: 203694 - DNA, 23 bp, Mus musculus
atgtgtatatatgtatatgtttg

SEQ ID NO: 203695 - DNA, 22 bp, Mus musculus
tatgtgtgtgtgtatgtgcatg

SEQ ID NO: 203696 - DNA, 22 bp, Mus musculus
tgatgtcagaagatacagatga

SEQ ID NO: 203697 - DNA, 23 bp, Mus musculus
ttaaggctgtgtagatgagtgtt

SEQ ID NO: 203698 - DNA, 22 bp, Mus musculus
cagtcttaggccatggtggtct

SEQ ID NO: 203699 - DNA, 23 bp, Mus musculus
aatatttatgtatctgttgaggc

SEQ ID NO: 203700 - DNA, 21 bp, Mus musculus
atagaagtggtgcctgtgata

SEQ ID NO: 203701 - DNA, 21 bp, Mus musculus
ttctgaggaacctccagactg

SEQ ID NO: 203702 - DNA, 23 bp, Mus musculus
gtatgtatgtatgtaagtgtgtg

SEQ ID NO: 203703 - DNA, 21 bp, Mus musculus
tatgtatatatgtaaatatgt

SEQ ID NO: 203704 - DNA, 22 bp, Mus musculus
tatgtgtttgcatgttcacacc

SEQ ID NO: 203705 - DNA, 23 bp, Mus musculus
cattatcatcatcatcatggcag

SEQ ID NO: 203706 - DNA, 23 bp, Mus musculus
aatggtgctgaagaaggagctga

SEQ ID NO: 203707 - DNA, 22 bp, Mus musculus
ggacacagtgactgttataagc

SEQ ID NO: 203708 - DNA, 20 bp, Mus musculus
atatgtatatatacatatgt

SEQ ID NO: 203709 - DNA, 19 bp, Mus musculus
aatgtgcttatatatatgt

SEQ ID NO: 203710 - DNA, 22 bp, Mus musculus
tcactctgtgtgtttaagttta

SEQ ID NO: 203711 - DNA, 23 bp, Mus musculus
ctgacagatgaatgagaggtggt

SEQ ID NO: 203712 - DNA, 23 bp, Mus musculus
ctgtgtgtgtgcatgtgcatgtg

SEQ ID NO: 203713 - DNA, 21 bp, Mus musculus
taagagtgccaaagactggcc

SEQ ID NO: 203714 - DNA, 22 bp, Mus musculus
aatctgccgggtactcttctct

SEQ ID NO: 203715 - DNA, 21 bp, Mus musculus
tatgtgtatatatatgtgtgt

SEQ ID NO: 203716 - DNA, 22 bp, Mus musculus
tatagtatgtatatctatatat

SEQ ID NO: 203717 - DNA, 18 bp, Mus musculus
tatgcatatatatacaaa

SEQ ID NO: 203718 - DNA, 23 bp, Mus musculus
ttgtcttctagaagtttcagcat

SEQ ID NO: 203719 - DNA, 21 bp, Mus musculus
atgcatatatgtatatatgtg

SEQ ID NO: 203720 - DNA, 22 bp, Mus musculus
tctgtgaattgtgttttggttt

SEQ ID NO: 203721 - DNA, 23 bp, Mus musculus
atcagtgagtgcataccatgtgt

SEQ ID NO: 203722 - DNA, 18 bp, Mus musculus
tgcagaaccaggaggagg

SEQ ID NO: 203723 - DNA, 23 bp, Mus musculus
tgtctgcctgcctgcctgtctgt

SEQ ID NO: 203724 - DNA, 22 bp, Mus musculus
tgttttgtgaccaattatatgg

SEQ ID NO: 203725 - DNA, 22 bp, Mus musculus
tgttttgtgaccaattatatgg

SEQ ID NO: 203726 - DNA, 19 bp, Mus musculus
taaatgcatgtttatatgt

SEQ ID NO: 203727 - DNA, 22 bp, Mus musculus
tcgcagagagcaagcagaggag

SEQ ID NO: 203728 - DNA, 23 bp, Mus musculus
cctctctgtgtgtctgtctgtct

SEQ ID NO: 203729 - DNA, 21 bp, Mus musculus
tctcagttaccacaagattgg

SEQ ID NO: 203730 - DNA, 23 bp, Mus musculus
ttaagagcactgactgctcttcc

SEQ ID NO: 203731 - DNA, 23 bp, Mus musculus
ttgcctccatatattttcatgta

SEQ ID NO: 203732 - DNA, 23 bp, Mus musculus
ataaaggactagaatttggtctg

SEQ ID NO: 203733 - DNA, 23 bp, Mus musculus
tcagacacaaaacagagagtgca

SEQ ID NO: 203734 - DNA, 21 bp, Mus musculus
atatatcttggtggtgatttg

SEQ ID NO: 203735 - DNA, 20 bp, Mus musculus
ctttgcatagatgtatgtac

SEQ ID NO: 203736 - DNA, 23 bp, Mus musculus
ctctgtgtctatctctctctcat

SEQ ID NO: 203737 - DNA, 19 bp, Mus musculus
tgtcttcattgctctctga

SEQ ID NO: 203738 - DNA, 21 bp, Mus musculus
ttgataggattgaagactgta

SEQ ID NO: 203739 - DNA, 23 bp, Mus musculus
tatgcatatatatatgtgtgtgt

SEQ ID NO: 203740 - DNA, 23 bp, Mus musculus
tatgtgtgtttctgtgtgtgaat

SEQ ID NO: 203741 - DNA, 20 bp, Mus musculus
tatttgcatgtatacatgtg

SEQ ID NO: 203742 - DNA, 22 bp, Mus musculus
tgttttgtgaccaattatatgg

SEQ ID NO: 203743 - DNA, 18 bp, Mus musculus
atggtgatcagataggat

SEQ ID NO: 203744 - DNA, 23 bp, Mus musculus
tatccgttgattcctgttttgtg

SEQ ID NO: 203745 - DNA, 23 bp, Mus musculus
tttgaggaaggtgaggaatcctt

SEQ ID NO: 203746 - DNA, 22 bp, Mus musculus
tgttttgtgaccaattatatgg

SEQ ID NO: 203747 - DNA, 19 bp, Mus musculus
tacatatatatgtatatgt

SEQ ID NO: 203748 - DNA, 23 bp, Mus musculus
tatttctgtgaggaattgaattg

SEQ ID NO: 203749 - DNA, 23 bp, Mus musculus
tagtgcatggtgatctgatagga

SEQ ID NO: 203750 - DNA, 22 bp, Mus musculus
tgttttgtgacctattatgtgg

SEQ ID NO: 203751 - DNA, 21 bp, Mus musculus
tatgtgtaaatatatagagta

SEQ ID NO: 203752 - DNA, 23 bp, Mus musculus
tgtgtgtatgtctgtgtgtgtgt

SEQ ID NO: 203753 - DNA, 22 bp, Mus musculus
tttcttgacaaaacaaatgtgt

SEQ ID NO: 203754 - DNA, 23 bp, Mus musculus
atttgttatagaagtttgcccaa

SEQ ID NO: 203755 - DNA, 23 bp, Mus musculus
ttcattttgtagttctgtagatg

SEQ ID NO: 203756 - DNA, 21 bp, Mus musculus
atatgtatgtatatatgtgtg

SEQ ID NO: 203757 - DNA, 22 bp, Mus musculus
gtgtacttggttgtgtgtgagc

SEQ ID NO: 203758 - DNA, 23 bp, Mus musculus
gctgagagtgggatattgaagtc

SEQ ID NO: 203759 - DNA, 22 bp, Mus musculus
tgttttgtgaccaattatatgg

SEQ ID NO: 203760 - DNA, 22 bp, Mus musculus
tgttttgtgaccaattatatgg

SEQ ID NO: 203761 - DNA, 23 bp, Mus musculus
tataggtgcatatgtatatatgt

SEQ ID NO: 203762 - DNA, 23 bp, Mus musculus
atgtgtatgtgtgtatatgtaga

SEQ ID NO: 203763 - DNA, 23 bp, Mus musculus
atagttcatatacttacttgtat

SEQ ID NO: 203764 - DNA, 19 bp, Mus musculus
tgcttgtatgtgtgttagg

SEQ ID NO: 203765 - DNA, 20 bp, Mus musculus
tttgacactatttgaaatga

SEQ ID NO: 203766 - DNA, 23 bp, Mus musculus
ctgtccattggtgagagtgggat

SEQ ID NO: 203767 - DNA, 22 bp, Mus musculus
tgtatgcatgtatgtatgtatg

SEQ ID NO: 203768 - DNA, 23 bp, Mus musculus
tataggtaggatatggaaagtga

SEQ ID NO: 203769 - DNA, 21 bp, Mus musculus
atgtgtatagatatgcatata

SEQ ID NO: 203770 - DNA, 22 bp, Mus musculus
tactgcttttaatattctgtct

SEQ ID NO: 203771 - DNA, 23 bp, Mus musculus
atatacatgtttggtgtacgtac

SEQ ID NO: 203772 - DNA, 20 bp, Mus musculus
tgttttgtgacctattatgt

SEQ ID NO: 203773 - DNA, 23 bp, Mus musculus
cagtgtgtgtgtctctctccttc

SEQ ID NO: 203774 - DNA, 19 bp, Mus musculus
tcaggggctggagagatgg

SEQ ID NO: 203775 - DNA, 23 bp, Mus musculus
tgcacagtcacacagtctgtata

SEQ ID NO: 203776 - DNA, 23 bp, Mus musculus
tacactatatgtatacatgcagt

SEQ ID NO: 203777 - DNA, 23 bp, Mus musculus
atttgaagtcctaaaagcgtcac

SEQ ID NO: 203778 - DNA, 23 bp, Mus musculus
tctcccagactcactgtccaaac

SEQ ID NO: 203779 - DNA, 23 bp, Mus musculus
taaaagcattttctgaatggaca

SEQ ID NO: 203780 - DNA, 23 bp, Mus musculus
taacatgtcacacaatgaaaata

SEQ ID NO: 203781 - DNA, 23 bp, Mus musculus
tgacacatgagagtcactagaca

SEQ ID NO: 203782 - DNA, 22 bp, Mus musculus
tgttttgtgaccaattatatgg

SEQ ID NO: 203783 - DNA, 22 bp, Mus musculus
tgtgacagaggctgttgtctcc

SEQ ID NO: 203784 - DNA, 23 bp, Mus musculus
cataacctgctcctgtcactgtg

SEQ ID NO: 203785 - DNA, 23 bp, Mus musculus
ttttagagtctagaagaggatac

SEQ ID NO: 203786 - DNA, 23 bp, Mus musculus
gtatgtatgaatgcatgtgtgtg

SEQ ID NO: 203787 - DNA, 23 bp, Mus musculus
tctctccgtgtgtgtgtgtgtgt

SEQ ID NO: 203788 - DNA, 23 bp, Mus musculus
aagtcagaagagtgtctggacat

SEQ ID NO: 203789 - DNA, 22 bp, Mus musculus
tgttttgtgaccaattatatgg

SEQ ID NO: 203790 - DNA, 23 bp, Mus musculus
atggtgtaatgtttgcaatttta

SEQ ID NO: 203791 - DNA, 23 bp, Mus musculus
ataaacgtgtactagctggttaa

SEQ ID NO: 203792 - DNA, 22 bp, Mus musculus
tgttttgtgaccaattatatgg

SEQ ID NO: 203793 - DNA, 22 bp, Mus musculus
cttagtccatggtgatctgata

SEQ ID NO: 203794 - DNA, 23 bp, Mus musculus
tgcatgcatgtatatatatgtgt

SEQ ID NO: 203795 - DNA, 23 bp, Mus musculus
tgtgtgtatctgtgtgtgtctgt

SEQ ID NO: 203796 - DNA, 19 bp, Mus musculus
tcaaaactcactttagtca

SEQ ID NO: 203797 - DNA, 23 bp, Mus musculus
acacatatgtgtgtgtatacaca

SEQ ID NO: 203798 - DNA, 22 bp, Mus musculus
tgttttgtgaccaattatatgg

SEQ ID NO: 203799 - DNA, 19 bp, Mus musculus
tctgcatgtgtgtatatgt

SEQ ID NO: 203800 - DNA, 22 bp, Mus musculus
tatatgtatatatatatgtgtg

SEQ ID NO: 203801 - DNA, 19 bp, Mus musculus
aaaggtactgagttcaaat

SEQ ID NO: 203802 - DNA, 18 bp, Mus musculus
tcagtggttaagagcact

SEQ ID NO: 203803 - DNA, 23 bp, Mus musculus
tgactcagagtacatgtttgtat

SEQ ID NO: 203804 - DNA, 22 bp, Mus musculus
tttataggaccataactgttgt

SEQ ID NO: 203805 - DNA, 23 bp, Mus musculus
atgtgtatgtgtatgtatatgca

SEQ ID NO: 203806 - DNA, 23 bp, Mus musculus
tatgcatatatatgcctgtgtat

SEQ ID NO: 203807 - DNA, 20 bp, Mus musculus
acatgtgtgtgcatatgtat

SEQ ID NO: 203808 - DNA, 22 bp, Mus musculus
tactggaactcactctcactct

SEQ ID NO: 203809 - DNA, 23 bp, Mus musculus
atatacatgtatatgtacatatg

SEQ ID NO: 203810 - DNA, 23 bp, Mus musculus
ttgaagacacagctttgggaagg

SEQ ID NO: 203811 - DNA, 20 bp, Mus musculus
tgctgactgctcttccagag

SEQ ID NO: 203812 - DNA, 20 bp, Mus musculus
ctctgtggctctctcgtgtc

SEQ ID NO: 203813 - DNA, 19 bp, Mus musculus
gacttgaactcacagagat

SEQ ID NO: 203814 - DNA, 18 bp, Mus musculus
aagctggactaaatgtat

SEQ ID NO: 203815 - DNA, 21 bp, Mus musculus
agtgtaggtgcatgcatagta

SEQ ID NO: 203816 - DNA, 23 bp, Mus musculus
acacataatctataggtacttat

SEQ ID NO: 203817 - DNA, 23 bp, Mus musculus
tgcttgactattaggaatactca

SEQ ID NO: 203818 - DNA, 23 bp, Mus musculus
tacatatgtgtgtgtattttacg

SEQ ID NO: 203819 - DNA, 19 bp, Mus musculus
tcacatgaatatatttaca

SEQ ID NO: 203820 - DNA, 20 bp, Mus musculus
ttgtatatgtctatgtatgt

SEQ ID NO: 203821 - DNA, 21 bp, Mus musculus
tatgtgatgtttatgatatgt

SEQ ID NO: 203822 - DNA, 18 bp, Mus musculus
tatccatgcatgtatgtg

SEQ ID NO: 203823 - DNA, 22 bp, Mus musculus
tgttttgtgaccaattatatgg

SEQ ID NO: 203824 - DNA, 23 bp, Mus musculus
ccgtgtgtatacatgtatatgta

SEQ ID NO: 203825 - DNA, 18 bp, Mus musculus
tgtctagttatgggtctc

SEQ ID NO: 203826 - DNA, 22 bp, Mus musculus
agtggataagtgttgtaaacaa

SEQ ID NO: 203827 - DNA, 23 bp, Mus musculus
ctctgactcagactctgtttcct

SEQ ID NO: 203828 - DNA, 23 bp, Mus musculus
atgtgactatttttatatctgag

SEQ ID NO: 203829 - DNA, 20 bp, Mus musculus
cacagcaaaggagaatgcag

SEQ ID NO: 203830 - DNA, 23 bp, Mus musculus
acacctgcctctctgagtgactg

SEQ ID NO: 203831 - DNA, 18 bp, Mus musculus
tgactcagtggttgggag

SEQ ID NO: 203832 - DNA, 19 bp, Mus musculus
ttgaggatgtatactatag

SEQ ID NO: 203833 - DNA, 23 bp, Mus musculus
attcatcctcattttcttgaaaa

SEQ ID NO: 203834 - DNA, 22 bp, Mus musculus
tgtctccccatttttattcaca

SEQ ID NO: 203835 - DNA, 21 bp, Mus musculus
atgtatgtatgcatgtatgta

SEQ ID NO: 203836 - DNA, 23 bp, Mus musculus
tgcatgcatgtatgtatgtgtgc

SEQ ID NO: 203837 - DNA, 21 bp, Mus musculus
tcacatttttctagttttgct

SEQ ID NO: 203838 - DNA, 23 bp, Mus musculus
tgtatgtatgtatgtatatgtgt

SEQ ID NO: 203839 - DNA, 23 bp, Mus musculus
ttaagagcactgactgctcctcc

SEQ ID NO: 203840 - DNA, 18 bp, Mus musculus
tgtgtactatatgtgtac

SEQ ID NO: 203841 - DNA, 22 bp, Mus musculus
ttaagagcactgagtgctcctt

SEQ ID NO: 203842 - DNA, 23 bp, Mus musculus
gagtgctgactgctcttccagag

SEQ ID NO: 203843 - DNA, 23 bp, Mus musculus
agaggtcctgagttcaattccag

SEQ ID NO: 203844 - DNA, 22 bp, Mus musculus
atgagtgagaaagctttgccag

SEQ ID NO: 203845 - DNA, 21 bp, Mus musculus
tctctctctctcttgcctggc

SEQ ID NO: 203846 - DNA, 19 bp, Mus musculus
gattatttacatatgtatg

SEQ ID NO: 203847 - DNA, 21 bp, Mus musculus
atatgtgtgaatgaatatatg

SEQ ID NO: 203848 - DNA, 22 bp, Mus musculus
atatgtgattatttacatatgt

SEQ ID NO: 203849 - DNA, 23 bp, Mus musculus
tgtgtgaatgaatatatgtgtgt

SEQ ID NO: 203850 - DNA, 23 bp, Mus musculus
tgcatatgcacatacacatatac

SEQ ID NO: 203851 - DNA, 23 bp, Mus musculus
tgtgtgtatatttatatgtgtgt

SEQ ID NO: 203852 - DNA, 18 bp, Mus musculus
agcactgaagccattcgg

SEQ ID NO: 203853 - DNA, 23 bp, Mus musculus
cagtcagtgagtctctgcacttt

SEQ ID NO: 203854 - DNA, 23 bp, Mus musculus
agagtcctgagactggagagaga

SEQ ID NO: 203855 - DNA, 18 bp, Mus musculus
tatatctcccaaatacat

SEQ ID NO: 203856 - DNA, 23 bp, Mus musculus
atggtggtctgataggatacatg

SEQ ID NO: 203857 - DNA, 22 bp, Mus musculus
ttatagactaatgcgtatctgt

SEQ ID NO: 203858 - DNA, 20 bp, Mus musculus
tggtggtctgataggattca

SEQ ID NO: 203859 - DNA, 22 bp, Mus musculus
tgttttgtgaccaattatatgg

SEQ ID NO: 203860 - DNA, 23 bp, Mus musculus
atatgtgtgtagtatagttcata

SEQ ID NO: 203861 - DNA, 23 bp, Mus musculus
atgagagatgatagtgagtacat

SEQ ID NO: 203862 - DNA, 22 bp, Mus musculus
attactgtgtctggcattattc

SEQ ID NO: 203863 - DNA, 22 bp, Mus musculus
aagccatctgcatttactgaag

SEQ ID NO: 203864 - DNA, 23 bp, Mus musculus
acacacacattatgtatatgtat

SEQ ID NO: 203865 - DNA, 23 bp, Mus musculus
tgagaggctctgtcagtgcctga

SEQ ID NO: 203866 - DNA, 19 bp, Mus musculus
atatgtatgtatgtatatg

SEQ ID NO: 203867 - DNA, 20 bp, Mus musculus
atatatatatatggtgggtg

SEQ ID NO: 203868 - DNA, 23 bp, Mus musculus
acgatgatactgaatctgttctt

SEQ ID NO: 203869 - DNA, 23 bp, Mus musculus
gacagacagacaggcaggcaggg

SEQ ID NO: 203870 - DNA, 21 bp, Mus musculus
tacctctgatgtatggtgtct

SEQ ID NO: 203871 - DNA, 22 bp, Mus musculus
tccaacacatctgacaattcaa

SEQ ID NO: 203872 - DNA, 23 bp, Mus musculus
aggatcatatcatatcatatcat

SEQ ID NO: 203873 - DNA, 22 bp, Mus musculus
tttagtccatggtgatctgata

SEQ ID NO: 203874 - DNA, 21 bp, Mus musculus
tatgtatgtatgaatgtatga

SEQ ID NO: 203875 - DNA, 23 bp, Mus musculus
tatgtgtatgtttatatatgtgt

SEQ ID NO: 203876 - DNA, 21 bp, Mus musculus
tcagtggaagtatttatgtct

SEQ ID NO: 203877 - DNA, 22 bp, Mus musculus
tgttttgtgaccaattatatgg

SEQ ID NO: 203878 - DNA, 23 bp, Mus musculus
taggaaagtgaagatgctcctct

SEQ ID NO: 203879 - DNA, 22 bp, Mus musculus
tatgtacatgtacatatataca

SEQ ID NO: 203880 - DNA, 23 bp, Mus musculus
atatgtgcatgtatatgtatatg

SEQ ID NO: 203881 - DNA, 23 bp, Mus musculus
ctctctgtgtctctgtccctctg

SEQ ID NO: 203882 - DNA, 18 bp, Mus musculus
tagagagatggtttagtg

SEQ ID NO: 203883 - DNA, 19 bp, Mus musculus
atgctgaggttaaaggtgt

SEQ ID NO: 203884 - DNA, 23 bp, Mus musculus
ctgagtcagtctgaagtctgcag

SEQ ID NO: 203885 - DNA, 22 bp, Mus musculus
agcctctgtctctctggcatcc

SEQ ID NO: 203886 - DNA, 23 bp, Mus musculus
gcattgctgaagatggagctaag

SEQ ID NO: 203887 - DNA, 22 bp, Mus musculus
tgtctgtgtgtttatctggtct

SEQ ID NO: 203888 - DNA, 23 bp, Mus musculus
tagagtcacagaactgatgggtc

SEQ ID NO: 203889 - DNA, 23 bp, Mus musculus
atgaattgaatcaggttagcttt

SEQ ID NO: 203890 - DNA, 20 bp, Mus musculus
tacagatatatattgtatgt

SEQ ID NO: 203891 - DNA, 21 bp, Mus musculus
tatctatctctatctatatag

SEQ ID NO: 203892 - DNA, 23 bp, Mus musculus
gtggttaagaacacagactgctc

SEQ ID NO: 203893 - DNA, 23 bp, Mus musculus
tatgtgtgtgcatatgtatgtgt

SEQ ID NO: 203894 - DNA, 19 bp, Mus musculus
cttgatttctctctctctc

SEQ ID NO: 203895 - DNA, 23 bp, Mus musculus
cacaagtctttatgttcatgtgc

SEQ ID NO: 203896 - DNA, 23 bp, Mus musculus
gtatgtgtgcatatgtatatata

SEQ ID NO: 203897 - DNA, 21 bp, Mus musculus
taagagttgccttgatcatgg

SEQ ID NO: 203898 - DNA, 23 bp, Mus musculus
tatccctgtgttctactggctca

SEQ ID NO: 203899 - DNA, 23 bp, Mus musculus
tgtgtgcatgtgtgtgtgcgtgt

SEQ ID NO: 203900 - DNA, 21 bp, Mus musculus
tgtacacaagtgtgtgagcac

SEQ ID NO: 203901 - DNA, 23 bp, Mus musculus
gctgtacacaagtgtgtgagcac

SEQ ID NO: 203902 - DNA, 23 bp, Mus musculus
gctgtacacaagtgtgtgagcac

SEQ ID NO: 203903 - DNA, 23 bp, Mus musculus
gctgtacacaagtgtgtgagcac

SEQ ID NO: 203904 - DNA, 20 bp, Mus musculus
tacacaagtgtgtgagcaca

SEQ ID NO: 203905 - DNA, 23 bp, Mus musculus
ctgcacacaagtgtgtgagcaca

SEQ ID NO: 203906 - DNA, 23 bp, Mus musculus
cacacaggtgtgtgagcacacag

SEQ ID NO: 203907 - DNA, 23 bp, Mus musculus
gaggatgttgtgcacaaatgtgt

SEQ ID NO: 203908 - DNA, 23 bp, Mus musculus
ctgactgctcttccagaggtcct

SEQ ID NO: 203909 - DNA, 21 bp, Mus musculus
tctgtctctgactgtggcttg

SEQ ID NO: 203910 - DNA, 19 bp, Mus musculus
agcttcctctgtaaagtgt

SEQ ID NO: 203911 - DNA, 23 bp, Mus musculus
cagatcagtgtgataatcataag

SEQ ID NO: 203912 - DNA, 23 bp, Mus musculus
tctttggttttcatgctgtaagt

SEQ ID NO: 203913 - DNA, 23 bp, Mus musculus
tgactctgtcactgaaagactta

SEQ ID NO: 203914 - DNA, 23 bp, Mus musculus
aggatgggtggatgtacctgctt

SEQ ID NO: 203915 - DNA, 23 bp, Mus musculus
ttctgcatcttgtggagtaagga

SEQ ID NO: 203916 - DNA, 23 bp, Mus musculus
ctcagtgcctggctcccagtgag

SEQ ID NO: 203917 - DNA, 23 bp, Mus musculus
gaacacagagcagacacagcgca

SEQ ID NO: 203918 - DNA, 23 bp, Mus musculus
aatgtgttgatttttctggatgt

SEQ ID NO: 203919 - DNA, 21 bp, Mus musculus
ctctgactgtatcacattgtg

SEQ ID NO: 203920 - DNA, 23 bp, Mus musculus
acagcttcttggtcactgtctct

SEQ ID NO: 203921 - DNA, 22 bp, Mus musculus
ctggttgacaaactggttagtg

SEQ ID NO: 203922 - DNA, 23 bp, Mus musculus
aagtggtgtttatcctatgagtc

SEQ ID NO: 203923 - DNA, 23 bp, Mus musculus
gcagttcctgattggctggcata

SEQ ID NO: 203924 - DNA, 19 bp, Mus musculus
tctttggtctttcaggaag

SEQ ID NO: 203925 - DNA, 21 bp, Mus musculus
tatgtatatgtatatgtgtgt

SEQ ID NO: 203926 - DNA, 21 bp, Mus musculus
atgtatgtttatatatgtata

SEQ ID NO: 203927 - DNA, 19 bp, Mus musculus
atgggtatatgtatgtgta

SEQ ID NO: 203928 - DNA, 18 bp, Mus musculus
tatgcatatatgtgtgta

SEQ ID NO: 203929 - DNA, 23 bp, Mus musculus
ttaagggcactacatcatgtgac

SEQ ID NO: 203930 - DNA, 20 bp, Mus musculus
tcaggactgtgtctttgggg

SEQ ID NO: 203931 - DNA, 22 bp, Mus musculus
tataatgtactttgagtgcatg

SEQ ID NO: 203932 - DNA, 22 bp, Mus musculus
agtgtggaagtagaatctgaac

SEQ ID NO: 203933 - DNA, 23 bp, Mus musculus
atctgtgatctcttagagtctga

SEQ ID NO: 203934 - DNA, 22 bp, Mus musculus
tgacatattgctgtcttcttaa

SEQ ID NO: 203935 - DNA, 23 bp, Mus musculus
aggcagactgacagaacagagcc

SEQ ID NO: 203936 - DNA, 23 bp, Mus musculus
gcattgctctgtcaggatgtacg

SEQ ID NO: 203937 - DNA, 23 bp, Mus musculus
tttctcagctttgctaaggttac

SEQ ID NO: 203938 - DNA, 23 bp, Mus musculus
agtggtacatgcttgtaatctta

SEQ ID NO: 203939 - DNA, 21 bp, Mus musculus
tactagatggacatttggtgt

SEQ ID NO: 203940 - DNA, 23 bp, Mus musculus
agtgtgagcacagagaggagaca

SEQ ID NO: 203941 - DNA, 23 bp, Mus musculus
tctttctcagtgtctttagagag

SEQ ID NO: 203942 - DNA, 21 bp, Mus musculus
tgtgcatgtgcatgtgtgtgt

SEQ ID NO: 203943 - DNA, 21 bp, Mus musculus
tgtacgtgtgcatgtgcatgt

SEQ ID NO: 203944 - DNA, 23 bp, Mus musculus
tgtgtcttggttatggtttctat

SEQ ID NO: 203945 - DNA, 23 bp, Mus musculus
aagactagatagtttgcacagag

SEQ ID NO: 203946 - DNA, 23 bp, Mus musculus
aagctggcaagtgactagctgaa

SEQ ID NO: 203947 - DNA, 19 bp, Mus musculus
agagatgctaagtcctgag

SEQ ID NO: 203948 - DNA, 18 bp, Mus musculus
atgtgtatatgtgttcat

SEQ ID NO: 203949 - DNA, 19 bp, Mus musculus
tgtgtatgtgtatatgcat

SEQ ID NO: 203950 - DNA, 23 bp, Mus musculus
atatgtgtgcatgtgtatgtctg

SEQ ID NO: 203951 - DNA, 23 bp, Mus musculus
gtatgtatgtatgtatgtatgtg

SEQ ID NO: 203952 - DNA, 23 bp, Mus musculus
tggtagtaggttctaatgtttgc

SEQ ID NO: 203953 - DNA, 19 bp, Mus musculus
tggtatgtaatgtgcaatg

SEQ ID NO: 203954 - DNA, 21 bp, Mus musculus
ataatgtataatatgtaatgt

SEQ ID NO: 203955 - DNA, 21 bp, Mus musculus
atgtgtatatatatgtgtgtg

SEQ ID NO: 203956 - DNA, 23 bp, Mus musculus
cacacacacatatatgtgtgtat

SEQ ID NO: 203957 - DNA, 21 bp, Mus musculus
tctgcttcactgagtgacatc

SEQ ID NO: 203958 - DNA, 22 bp, Mus musculus
tcaaggagggttagaatggtgt

SEQ ID NO: 203959 - DNA, 19 bp, Mus musculus
atatgctgtttactttgga

SEQ ID NO: 203960 - DNA, 23 bp, Mus musculus
atatgtgtgtgtatgtatatatg

SEQ ID NO: 203961 - DNA, 21 bp, Mus musculus
aactttgatgaagggctggag

SEQ ID NO: 203962 - DNA, 21 bp, Mus musculus
tgtggatgaatgacagacaga

SEQ ID NO: 203963 - DNA, 23 bp, Mus musculus
tgatcaccttgttcaggtcctac

SEQ ID NO: 203964 - DNA, 19 bp, Mus musculus
atagcactgactgctcttc

SEQ ID NO: 203965 - DNA, 18 bp, Mus musculus
ctacaggggctggagaga

SEQ ID NO: 203966 - DNA, 23 bp, Mus musculus
tgtgtgtgactttttgtacaagt

SEQ ID NO: 203967 - DNA, 20 bp, Mus musculus
tggctcagtggttaggagca

SEQ ID NO: 203968 - DNA, 18 bp, Mus musculus
agacagtgcagttatgac

SEQ ID NO: 203969 - DNA, 19 bp, Mus musculus
tgagaccatttctcttgcc

SEQ ID NO: 203970 - DNA, 20 bp, Mus musculus
ttatatgtaggtatgcatac

SEQ ID NO: 203971 - DNA, 22 bp, Mus musculus
tgttttgtgaccaattatatgg

SEQ ID NO: 203972 - DNA, 23 bp, Mus musculus
tttcacacacatatatatgtata

SEQ ID NO: 203973 - DNA, 19 bp, Mus musculus
agctctctctgtctgccct

SEQ ID NO: 203974 - DNA, 20 bp, Mus musculus
tgagtcgatggacatagaaa

SEQ ID NO: 203975 - DNA, 19 bp, Mus musculus
tgcatgtatgcatgtttgt

SEQ ID NO: 203976 - DNA, 23 bp, Mus musculus
catgtgtgtgtttgtgtatatgc

SEQ ID NO: 203977 - DNA, 21 bp, Mus musculus
agggtggagaggaacaggctg

SEQ ID NO: 203978 - DNA, 23 bp, Mus musculus
tgcatgtatgtatatatgtatgt

SEQ ID NO: 203979 - DNA, 23 bp, Mus musculus
tgtttgtgtgtgtgcatgtgcat

SEQ ID NO: 203980 - DNA, 23 bp, Mus musculus
gtcagttcactgtctctgtgctt

SEQ ID NO: 203981 - DNA, 23 bp, Mus musculus
tgtgattggagtcgctgtctgtc

SEQ ID NO: 203982 - DNA, 23 bp, Mus musculus
tgtgtgtgtgtgcatgtgcatgt

SEQ ID NO: 203983 - DNA, 23 bp, Mus musculus
gtatgtacatgtgcttgtgtatg

SEQ ID NO: 203984 - DNA, 19 bp, Mus musculus
ggctcagtggttaggagca

SEQ ID NO: 203985 - DNA, 23 bp, Mus musculus
tgtgtgcctgtgtgcctgcatgt

SEQ ID NO: 203986 - DNA, 23 bp, Mus musculus
gcacatgctcacacacacacata

SEQ ID NO: 203987 - DNA, 23 bp, Mus musculus
tgcctgcctgcctgcctgcctgc

SEQ ID NO: 203988 - DNA, 18 bp, Mus musculus
gcacttcattcacttcac

SEQ ID NO: 203989 - DNA, 23 bp, Mus musculus
aagtttgaggtctgtcgctctgt

SEQ ID NO: 203990 - DNA, 22 bp, Mus musculus
agaggtgtgtgcatttgtgtgt

SEQ ID NO: 203991 - DNA, 23 bp, Mus musculus
tggattctcacactgtctgtgcc

SEQ ID NO: 203992 - DNA, 18 bp, Mus musculus
acacacacacacatgtat

SEQ ID NO: 203993 - DNA, 23 bp, Mus musculus
agagatgatgatgatgatgatgg

SEQ ID NO: 203994 - DNA, 22 bp, Mus musculus
tgttttgtgaccaattatatgg

SEQ ID NO: 203995 - DNA, 23 bp, Mus musculus
tgtgcatgaagtcaggtgttatg

SEQ ID NO: 203996 - DNA, 19 bp, Mus musculus
tcacatctatttttgtttg

SEQ ID NO: 203997 - DNA, 23 bp, Mus musculus
cactgtccctcacactgtccctc

SEQ ID NO: 203998 - DNA, 23 bp, Mus musculus
agacacactgattctctcacact

SEQ ID NO: 203999 - DNA, 23 bp, Mus musculus
tctcagtgtctctgctactctga

SEQ ID NO: 204000 - DNA, 20 bp, Mus musculus
tctcagaggctgaaagctat

SEQ ID NO: 204001 - DNA, 20 bp, Mus musculus
tctgccagggtctgctgagt

SEQ ID NO: 204002 - DNA, 23 bp, Mus musculus
ggttgtggttgtagcttggttgt

SEQ ID NO: 204003 - DNA, 23 bp, Mus musculus
attgagaaccaatgactatgctt

SEQ ID NO: 204004 - DNA, 23 bp, Mus musculus
tctctggctctgtctctgccagc

SEQ ID NO: 204005 - DNA, 21 bp, Mus musculus
gtatgtatgtatgtatgtatg

SEQ ID NO: 204006 - DNA, 22 bp, Mus musculus
tgttttgtgaccaattatatgg

SEQ ID NO: 204007 - DNA, 22 bp, Mus musculus
atcagctattgattggtaactc

SEQ ID NO: 204008 - DNA, 23 bp, Mus musculus
atatgtgtgtctgtatgtgtgac

SEQ ID NO: 204009 - DNA, 21 bp, Mus musculus
atcagtgtttttcaacctgta

SEQ ID NO: 204010 - DNA, 23 bp, Mus musculus
ttactgtgaggttgactagtgat

SEQ ID NO: 204011 - DNA, 21 bp, Mus musculus
catgtgtagtgaatttctaca

SEQ ID NO: 204012 - DNA, 23 bp, Mus musculus
acaagttatgcacatttatctga

SEQ ID NO: 204013 - DNA, 22 bp, Mus musculus
tgtatgtgtggggtatatatat

SEQ ID NO: 204014 - DNA, 23 bp, Mus musculus
tgtaagaggatgaaggatgtgtg

SEQ ID NO: 204015 - DNA, 18 bp, Mus musculus
catagcatatatacatgt

SEQ ID NO: 204016 - DNA, 20 bp, Mus musculus
tatgcagaaaaagctgttca

SEQ ID NO: 204017 - DNA, 21 bp, Mus musculus
tgtgcatgtatgtattagtat

SEQ ID NO: 204018 - DNA, 23 bp, Mus musculus
tgtgtacatgtatgcatatgtgt

SEQ ID NO: 204019 - DNA, 22 bp, Mus musculus
tgttttgtgaccaattatatgg

SEQ ID NO: 204020 - DNA, 23 bp, Mus musculus
ctcccacagtgacttccctctgt

SEQ ID NO: 204021 - DNA, 18 bp, Mus musculus
gacagtgttagagaacag

SEQ ID NO: 204022 - DNA, 23 bp, Mus musculus
taggttctgtcttcctgtgcata

SEQ ID NO: 204023 - DNA, 20 bp, Mus musculus
ttctggctggttttgtgtca

SEQ ID NO: 204024 - DNA, 23 bp, Mus musculus
tatgtgtatatatgcatatgtgt

SEQ ID NO: 204025 - DNA, 22 bp, Mus musculus
tatgtatgtatgtatatgtgtg

SEQ ID NO: 204026 - DNA, 18 bp, Mus musculus
tatgtgtgcatgtgcttg

SEQ ID NO: 204027 - DNA, 19 bp, Mus musculus
gtgcatatgtgtgcctatg

SEQ ID NO: 204028 - DNA, 22 bp, Mus musculus
atgtatgcatgcatgtatgtgt

SEQ ID NO: 204029 - DNA, 22 bp, Mus musculus
tgcatgtatagtatgcacattg

SEQ ID NO: 204030 - DNA, 22 bp, Mus musculus
atatgtgtgtatatgaatatta

SEQ ID NO: 204031 - DNA, 22 bp, Mus musculus
ttcaagtaatccaggataggct

SEQ ID NO: 204032 - DNA, 23 bp, Mus musculus
tgattacttgtttctggaggcag

SEQ ID NO: 204033 - DNA, 19 bp, Mus musculus
ctccgtggttaagagcact

SEQ ID NO: 204034 - DNA, 23 bp, Mus musculus
taactgtctgagtctctgtctct

SEQ ID NO: 204035 - DNA, 19 bp, Mus musculus
tgtgtgtgtctgtcagtcc

SEQ ID NO: 204036 - DNA, 23 bp, Mus musculus
actgtggctatcctggagctcat

SEQ ID NO: 204037 - DNA, 23 bp, Mus musculus
gttctgactgcctgtgtgcctcc

SEQ ID NO: 204038 - DNA, 20 bp, Mus musculus
acttgatatgtagaaatgtc

SEQ ID NO: 204039 - DNA, 23 bp, Mus musculus
tatactgcgtgcatttctggtgt

SEQ ID NO: 204040 - DNA, 23 bp, Mus musculus
ctgtgtctgtctgtgcttcacac

SEQ ID NO: 204041 - DNA, 23 bp, Mus musculus
tacagtgcttgagtaaggccaga

SEQ ID NO: 204042 - DNA, 23 bp, Mus musculus
ttgtctgtctgtctcgcactcct

SEQ ID NO: 204043 - DNA, 23 bp, Mus musculus
gtgatgaaagtgtaacatgttta

SEQ ID NO: 204044 - DNA, 23 bp, Mus musculus
tgtctcttactctgtatcccatg

SEQ ID NO: 204045 - DNA, 22 bp, Mus musculus
ctgtgagtttctgtgactcagg

SEQ ID NO: 204046 - DNA, 21 bp, Mus musculus
taggagtacttgctcattcca

SEQ ID NO: 204047 - DNA, 23 bp, Mus musculus
tccctctctggctgactcagcag

SEQ ID NO: 204048 - DNA, 23 bp, Mus musculus
cagagctctgagtctgtcactga

SEQ ID NO: 204049 - DNA, 21 bp, Mus musculus
agagctacctgtctgtctgtc

SEQ ID NO: 204050 - DNA, 21 bp, Mus musculus
ttaactgaggctgtggatctc

SEQ ID NO: 204051 - DNA, 23 bp, Mus musculus
tgtctgtctctgtctctctgttg

SEQ ID NO: 204052 - DNA, 23 bp, Mus musculus
tgtctgtctgtcacatttgtgcc

SEQ ID NO: 204053 - DNA, 20 bp, Mus musculus
gggtctctcactggctgacc

SEQ ID NO: 204054 - DNA, 22 bp, Mus musculus
tctgtgcctgtgtcagcctctg

SEQ ID NO: 204055 - DNA, 23 bp, Mus musculus
cctcttgtgagagagacagagac

SEQ ID NO: 204056 - DNA, 22 bp, Mus musculus
actctggctctggctctccttc

SEQ ID NO: 204057 - DNA, 22 bp, Mus musculus
tgttttgtgaccaattatatgg

SEQ ID NO: 204058 - DNA, 22 bp, Mus musculus
ttttgtgtaattcaatatatgt

SEQ ID NO: 204059 - DNA, 20 bp, Mus musculus
tgcaattgaaacgtgtgtca

SEQ ID NO: 204060 - DNA, 23 bp, Mus musculus
aatccatgatggtctgataggat

SEQ ID NO: 204061 - DNA, 23 bp, Mus musculus
ttttgtgaccaattatatggtca

SEQ ID NO: 204062 - DNA, 21 bp, Mus musculus
tgttttgtgaccaattatatg

SEQ ID NO: 204063 - DNA, 21 bp, Mus musculus
agtgctacagcctgtgatagg

SEQ ID NO: 204064 - DNA, 23 bp, Mus musculus
acattcatcatcaaggctagctg

SEQ ID NO: 204065 - DNA, 20 bp, Mus musculus
actggtttgaatggagatgt

SEQ ID NO: 204066 - DNA, 23 bp, Mus musculus
tgtatatgatgtatatgtatatg

SEQ ID NO: 204067 - DNA, 19 bp, Mus musculus
agaatgagttgggtagagt

SEQ ID NO: 204068 - DNA, 23 bp, Mus musculus
agagttttgcttcttctgagagg

SEQ ID NO: 204069 - DNA, 19 bp, Mus musculus
ctctgtagtacaggctgag

SEQ ID NO: 204070 - DNA, 23 bp, Mus musculus
tttggcagggcatcatcagtagg

SEQ ID NO: 204071 - DNA, 19 bp, Mus musculus
agttaaaggttgcttagta

SEQ ID NO: 204072 - DNA, 23 bp, Mus musculus
atgagtccttcttagttgactct

SEQ ID NO: 204073 - DNA, 21 bp, Mus musculus
ttggcaatgttactctttgga

SEQ ID NO: 204074 - DNA, 23 bp, Mus musculus
aagtggttgtcttttgttttaga

SEQ ID NO: 204075 - DNA, 23 bp, Mus musculus
tgtgtcactgggaatgggctttg

SEQ ID NO: 204076 - DNA, 19 bp, Mus musculus
atcctgcctgcatgtgagc

SEQ ID NO: 204077 - DNA, 23 bp, Mus musculus
gtgtatatatgtatatctatgtg

SEQ ID NO: 204078 - DNA, 18 bp, Mus musculus
tatacatacatatgcata

SEQ ID NO: 204079 - DNA, 23 bp, Mus musculus
tgaatacttgtagagctgatgag

SEQ ID NO: 204080 - DNA, 23 bp, Mus musculus
tgtctgactctgagtctccgtgt

SEQ ID NO: 204081 - DNA, 18 bp, Mus musculus
acaggtgagagtgtggac

SEQ ID NO: 204082 - DNA, 22 bp, Mus musculus
catttgtctatatgtttatatg

SEQ ID NO: 204083 - DNA, 22 bp, Mus musculus
tcttacatacatttcatttgaa

SEQ ID NO: 204084 - DNA, 23 bp, Mus musculus
cagacagacagataatgctgggg

SEQ ID NO: 204085 - DNA, 22 bp, Mus musculus
ttggaccagttcatgtatgctg

SEQ ID NO: 204086 - DNA, 23 bp, Mus musculus
tgagaggctctgtcagtgcctca

SEQ ID NO: 204087 - DNA, 22 bp, Mus musculus
tgtgtgtatatgtatgtgtata

SEQ ID NO: 204088 - DNA, 22 bp, Mus musculus
cgtgtgtgtatgtgtattcatg

SEQ ID NO: 204089 - DNA, 23 bp, Mus musculus
atgaatgtgtgtatatgtatgtg

SEQ ID NO: 204090 - DNA, 23 bp, Mus musculus
tcggtctctgtttaagatatggc

SEQ ID NO: 204091 - DNA, 19 bp, Mus musculus
atgatgtttgtgtgcatgt

SEQ ID NO: 204092 - DNA, 23 bp, Mus musculus
ctgtctgtctgtctgtctgtcta

SEQ ID NO: 204093 - DNA, 23 bp, Mus musculus
tctgcctctgtctctgtctctct

SEQ ID NO: 204094 - DNA, 21 bp, Mus musculus
actgcaggctcactgaggctg

SEQ ID NO: 204095 - DNA, 23 bp, Mus musculus
agcagacagatctcagtgagctg

SEQ ID NO: 204096 - DNA, 23 bp, Mus musculus
gtggttctctgtctcactcagta

SEQ ID NO: 204097 - DNA, 23 bp, Mus musculus
tctctttaaccctctgaatacct

SEQ ID NO: 204098 - DNA, 19 bp, Mus musculus
gggagctggagaaatggct

SEQ ID NO: 204099 - DNA, 21 bp, Mus musculus
aagagcactgactgctcttcc

SEQ ID NO: 204100 - DNA, 23 bp, Mus musculus
ctagatggttctattgttctgtc

SEQ ID NO: 204101 - DNA, 23 bp, Mus musculus
gtgtgtgtctgtttgtcattcat

SEQ ID NO: 204102 - DNA, 20 bp, Mus musculus
tgagggatgagactgagctg

SEQ ID NO: 204103 - DNA, 23 bp, Mus musculus
tgcctccctctgtctgtctgtct

SEQ ID NO: 204104 - DNA, 21 bp, Mus musculus
ctgtttgggtgtctgggactg

SEQ ID NO: 204105 - DNA, 23 bp, Mus musculus
agtcactggctctgtctgccctt

SEQ ID NO: 204106 - DNA, 22 bp, Mus musculus
gtcactcactctctctgccagc

SEQ ID NO: 204107 - DNA, 23 bp, Mus musculus
caaggtctgtctgtctgtctgtc

SEQ ID NO: 204108 - DNA, 23 bp, Mus musculus
tctgagagtggtgagagtcgagt

SEQ ID NO: 204109 - DNA, 22 bp, Mus musculus
atatgcatgtacatgtatgcat

SEQ ID NO: 204110 - DNA, 21 bp, Mus musculus
atgtatgtgtgcaagtgtatg

SEQ ID NO: 204111 - DNA, 23 bp, Mus musculus
atgtgtgtatatatgtatgtata

SEQ ID NO: 204112 - DNA, 23 bp, Mus musculus
gtttggagttgaagaactggtga

SEQ ID NO: 204113 - DNA, 23 bp, Mus musculus
tgcatgtttgtatgcatgtgtgt

SEQ ID NO: 204114 - DNA, 20 bp, Mus musculus
tgtgtttgtctatgtgtgtg

SEQ ID NO: 204115 - DNA, 18 bp, Mus musculus
atatatgatgtatatgta

SEQ ID NO: 204116 - DNA, 20 bp, Mus musculus
tatatgcatatgtatatgaa

SEQ ID NO: 204117 - DNA, 22 bp, Mus musculus
gtgtatatatatgatgtatatg

SEQ ID NO: 204118 - DNA, 23 bp, Mus musculus
ccaacactaatgaatttgaagat

SEQ ID NO: 204119 - DNA, 20 bp, Mus musculus
atgacccagagcatttgaga

SEQ ID NO: 204120 - DNA, 23 bp, Mus musculus
ctctaacagcacctccaactgga

SEQ ID NO: 204121 - DNA, 23 bp, Mus musculus
gagagttctacttctccatctga

SEQ ID NO: 204122 - DNA, 23 bp, Mus musculus
cactctctcactgttacacatct

SEQ ID NO: 204123 - DNA, 23 bp, Mus musculus
actttctgaagtgagttaggaca

SEQ ID NO: 204124 - DNA, 23 bp, Mus musculus
agaagtcactatttcaacggaga

SEQ ID NO: 204125 - DNA, 23 bp, Mus musculus
tatgtatgcatgtgtatgtgtgt

SEQ ID NO: 204126 - DNA, 18 bp, Mus musculus
cgtatgtatgcatgaatg

SEQ ID NO: 204127 - DNA, 23 bp, Mus musculus
tgtatatatgtatgtatgtgtgt

SEQ ID NO: 204128 - DNA, 18 bp, Mus musculus
tctgtgcatatatttatg

SEQ ID NO: 204129 - DNA, 18 bp, Mus musculus
tgtatgtatgtatatatg

SEQ ID NO: 204130 - DNA, 23 bp, Mus musculus
tgtctgtatatgtgtgtacatgc

SEQ ID NO: 204131 - DNA, 22 bp, Mus musculus
tatgagcatgtgtattgtatat

SEQ ID NO: 204132 - DNA, 23 bp, Mus musculus
tatgtgtgcatatgtgtatgtgt

SEQ ID NO: 204133 - DNA, 23 bp, Mus musculus
tttatatatgtttacaatactgt

SEQ ID NO: 204134 - DNA, 21 bp, Mus musculus
atgtatgtgtgcatgtgtgtg

SEQ ID NO: 204135 - DNA, 22 bp, Mus musculus
tgttttgtgaccaattatatgg

SEQ ID NO: 204136 - DNA, 21 bp, Mus musculus
agctcggaggaagtgtagtga

SEQ ID NO: 204137 - DNA, 19 bp, Mus musculus
acatttgtcatgttgtgca

SEQ ID NO: 204138 - DNA, 23 bp, Mus musculus
tatatgtgtgtatatatgtgtgt

SEQ ID NO: 204139 - DNA, 23 bp, Mus musculus
tatgtgtgtatatgtatatgtat

SEQ ID NO: 204140 - DNA, 18 bp, Mus musculus
tcagtgtgtgtgtgtctg

SEQ ID NO: 204141 - DNA, 23 bp, Mus musculus
tgtctgtctgtctgtctgtctag

SEQ ID NO: 204142 - DNA, 21 bp, Mus musculus
tatgtgaatatattcatatgt

SEQ ID NO: 204143 - DNA, 22 bp, Mus musculus
tattgtgcatatattcatatgt

SEQ ID NO: 204144 - DNA, 20 bp, Mus musculus
attactgtttttgtttatct

SEQ ID NO: 204145 - DNA, 21 bp, Mus musculus
ggtggttactagtggtatgca

SEQ ID NO: 204146 - DNA, 21 bp, Mus musculus
tgtaagttcatcttgatgtac

SEQ ID NO: 204147 - DNA, 23 bp, Mus musculus
cactggctctctcactggctcac

SEQ ID NO: 204148 - DNA, 23 bp, Mus musculus
taatccatggtgatctgatagga

SEQ ID NO: 204149 - DNA, 21 bp, Mus musculus
ttcatgtttcagtaaccacat

SEQ ID NO: 204150 - DNA, 20 bp, Mus musculus
tgagaggagtgttctgtggc

SEQ ID NO: 204151 - DNA, 23 bp, Mus musculus
tttgctgtattttcaggtctcta

SEQ ID NO: 204152 - DNA, 20 bp, Mus musculus
cagtgttgttttgcaagact

SEQ ID NO: 204153 - DNA, 22 bp, Mus musculus
gtatatatgtatgtatgcatat

SEQ ID NO: 204154 - DNA, 22 bp, Mus musculus
tccatggtgatctgataggatg

SEQ ID NO: 204155 - DNA, 23 bp, Mus musculus
tgtgtgtttatggatctgtgtct

SEQ ID NO: 204156 - DNA, 22 bp, Mus musculus
tgttttgtgaccaattatatgg

SEQ ID NO: 204157 - DNA, 23 bp, Mus musculus
ttctatgtgtcactgtctaagtg

SEQ ID NO: 204158 - DNA, 23 bp, Mus musculus
tgtgcatatatgtgtatatgtat

SEQ ID NO: 204159 - DNA, 23 bp, Mus musculus
tttctgcatgtcaattactgttg

SEQ ID NO: 204160 - DNA, 23 bp, Mus musculus
gtgggtgggtgcgtgcgtgcctg

SEQ ID NO: 204161 - DNA, 21 bp, Mus musculus
ctcctttcgttgtgagtggtt

SEQ ID NO: 204162 - DNA, 23 bp, Mus musculus
ctgaggtagtagtttgtgctgtt

SEQ ID NO: 204163 - DNA, 18 bp, Mus musculus
aactgcgcaagctactgc

SEQ ID NO: 204164 - DNA, 23 bp, Mus musculus
acagagagtgttttgtcggaatg

SEQ ID NO: 204165 - DNA, 23 bp, Mus musculus
gttcactgaccctctgtctgtgg

SEQ ID NO: 204166 - DNA, 23 bp, Mus musculus
gcaagagtacagagagtggacat

SEQ ID NO: 204167 - DNA, 23 bp, Mus musculus
agtaattgatctgtctgtctgtc

SEQ ID NO: 204168 - DNA, 23 bp, Mus musculus
acctgcagtgattaattacactg

SEQ ID NO: 204169 - DNA, 22 bp, Mus musculus
tgttttgtgaccaattatatgg

SEQ ID NO: 204170 - DNA, 23 bp, Mus musculus
gtatgtgtgcatgtgtgtgtgtg

SEQ ID NO: 204171 - DNA, 18 bp, Mus musculus
tctggattgtcactgtct

SEQ ID NO: 204172 - DNA, 21 bp, Mus musculus
gtatatatatgtgtgtgtaca

SEQ ID NO: 204173 - DNA, 20 bp, Mus musculus
aagagcactgactgctcttc

SEQ ID NO: 204174 - DNA, 23 bp, Mus musculus
aaagtactttctcatattgtgtg

SEQ ID NO: 204175 - DNA, 23 bp, Mus musculus
tgtcacactgagtctctggaacc

SEQ ID NO: 204176 - DNA, 22 bp, Mus musculus
aaatatgtgtgtatatgtacac

SEQ ID NO: 204177 - DNA, 23 bp, Mus musculus
tcactcactgggtctctttctcc

SEQ ID NO: 204178 - DNA, 23 bp, Mus musculus
gatgtgtgtcttagaactcgagc

SEQ ID NO: 204179 - DNA, 22 bp, Mus musculus
tgttttgtgaccaattatatgg

SEQ ID NO: 204180 - DNA, 23 bp, Mus musculus
ccctgcctgagtgcctgtctggg

SEQ ID NO: 204181 - DNA, 18 bp, Mus musculus
tgggcttcctgacagact

SEQ ID NO: 204182 - DNA, 22 bp, Mus musculus
tatgtcagtctgtttctgtgtg

SEQ ID NO: 204183 - DNA, 23 bp, Mus musculus
tggagaggttcaaggttctgttg

SEQ ID NO: 204184 - DNA, 23 bp, Mus musculus
tacactcaggctgagggtgtgtg

SEQ ID NO: 204185 - DNA, 20 bp, Mus musculus
atacactcaggtgagggtgt

SEQ ID NO: 204186 - DNA, 20 bp, Mus musculus
tgagagggtacactcgggct

SEQ ID NO: 204187 - DNA, 23 bp, Mus musculus
ctgagagggtacactcgggctga

SEQ ID NO: 204188 - DNA, 23 bp, Mus musculus
gttacactcaggctgagggtgtg

SEQ ID NO: 204189 - DNA, 22 bp, Mus musculus
agagggtacactcaggctgagg

SEQ ID NO: 204190 - DNA, 23 bp, Mus musculus
tgagagggtacactcaggctgag

SEQ ID NO: 204191 - DNA, 22 bp, Mus musculus
tgagagggtacactcgggctga

SEQ ID NO: 204192 - DNA, 23 bp, Mus musculus
ctgagagggtacactcgggctga

SEQ ID NO: 204193 - DNA, 22 bp, Mus musculus
tgagagggtacactcaggctga

SEQ ID NO: 204194 - DNA, 23 bp, Mus musculus
agttgacttgtgttgggtgagca

SEQ ID NO: 204195 - DNA, 19 bp, Mus musculus
tgacacactgtctctgtgg

SEQ ID NO: 204196 - DNA, 23 bp, Mus musculus
agctgtcgatctgaaaggctttc

SEQ ID NO: 204197 - DNA, 18 bp, Mus musculus
agagagccgagagaggtg

SEQ ID NO: 204198 - DNA, 19 bp, Mus musculus
ttatgttctatctttcctc

SEQ ID NO: 204199 - DNA, 23 bp, Mus musculus
gccttctgagtgaggagactgtg

SEQ ID NO: 204200 - DNA, 21 bp, Mus musculus
attgagtgcttgtttgatctt

SEQ ID NO: 204201 - DNA, 21 bp, Mus musculus
agtcttgatatttcaaaggtc

SEQ ID NO: 204202 - DNA, 21 bp, Mus musculus
tatgtgtatatgtatatgtgt

SEQ ID NO: 204203 - DNA, 23 bp, Mus musculus
gtgtgtgcatatatatacataca

SEQ ID NO: 204204 - DNA, 22 bp, Mus musculus
tgcctgcctgcctgcctgctgc

SEQ ID NO: 204205 - DNA, 23 bp, Mus musculus
gcgtctgtctgtctgtctgtctg

SEQ ID NO: 204206 - DNA, 23 bp, Mus musculus
tagacaacaattcatgaaaatgg

SEQ ID NO: 204207 - DNA, 23 bp, Mus musculus
taagaacaggttggccttgcact

SEQ ID NO: 204208 - DNA, 22 bp, Mus musculus
tgcatgtatatatgtgtgtatg

SEQ ID NO: 204209 - DNA, 23 bp, Mus musculus
atgaatgtatgcatgtgtatgta

SEQ ID NO: 204210 - DNA, 23 bp, Mus musculus
gtgtgtatatatgtgtctgtgtg

SEQ ID NO: 204211 - DNA, 21 bp, Mus musculus
actctccctctgtgactgtga

SEQ ID NO: 204212 - DNA, 23 bp, Mus musculus
tgtcactcactgggtgtcaggaa

SEQ ID NO: 204213 - DNA, 18 bp, Mus musculus
tcctgtgttctctctcgg

SEQ ID NO: 204214 - DNA, 19 bp, Mus musculus
tctcatcttcatggactgc

SEQ ID NO: 204215 - DNA, 20 bp, Mus musculus
atatgcatgtgtatatgcat

SEQ ID NO: 204216 - DNA, 23 bp, Mus musculus
tgagcagatagtaaagatgaatg

SEQ ID NO: 204217 - DNA, 19 bp, Mus musculus
atgattgagaggttcagtt

SEQ ID NO: 204218 - DNA, 23 bp, Mus musculus
ttaagctacataagctatggttt

SEQ ID NO: 204219 - DNA, 21 bp, Mus musculus
acagtctcactgattgaactg

SEQ ID NO: 204220 - DNA, 23 bp, Mus musculus
atgtatatgtatatgtgtatgta

SEQ ID NO: 204221 - DNA, 23 bp, Mus musculus
tcacttgtctcactcactctcag

SEQ ID NO: 204222 - DNA, 19 bp, Mus musculus
atgatctttagggttgcag

SEQ ID NO: 204223 - DNA, 23 bp, Mus musculus
aggcactgactgctcttccagag

SEQ ID NO: 204224 - DNA, 19 bp, Mus musculus
ttgagccatctctccagct

SEQ ID NO: 204225 - DNA, 22 bp, Mus musculus
tgtgtatatatgtatatgtgta

SEQ ID NO: 204226 - DNA, 23 bp, Mus musculus
gtgtatgtgtatatgtatatgtg

SEQ ID NO: 204227 - DNA, 18 bp, Mus musculus
tgactgactgactaaatg

SEQ ID NO: 204228 - DNA, 23 bp, Mus musculus
aagagccctgactgctcttccag

SEQ ID NO: 204229 - DNA, 22 bp, Mus musculus
tccatgtggttgctggttgaat

SEQ ID NO: 204230 - DNA, 23 bp, Mus musculus
tctgtctgtctgtctcacagcct

SEQ ID NO: 204231 - DNA, 20 bp, Mus musculus
tacacacacacatatatgcc

SEQ ID NO: 204232 - DNA, 22 bp, Mus musculus
atatgtgtgtatgtatatgtat

SEQ ID NO: 204233 - DNA, 23 bp, Mus musculus
tgccatgtgagtgtggacacttc

SEQ ID NO: 204234 - DNA, 22 bp, Mus musculus
tgttttgtgaccaattatatgg

SEQ ID NO: 204235 - DNA, 21 bp, Mus musculus
aatactatatatgtatatgtg

SEQ ID NO: 204236 - DNA, 23 bp, Mus musculus
tctgtttttctagctgtttgagt

SEQ ID NO: 204237 - DNA, 23 bp, Mus musculus
gtatatgtacatgtacatgtaca

SEQ ID NO: 204238 - DNA, 23 bp, Mus musculus
atatgtatatgtatatgtatatg

SEQ ID NO: 204239 - DNA, 23 bp, Mus musculus
tagtccatggtgatctgatagga

SEQ ID NO: 204240 - DNA, 23 bp, Mus musculus
acacagtggctgtgctaggcttt

SEQ ID NO: 204241 - DNA, 21 bp, Mus musculus
actgtcttcaaattgcactct

SEQ ID NO: 204242 - DNA, 23 bp, Mus musculus
atagtatgtgtgcatatatatgt

SEQ ID NO: 204243 - DNA, 23 bp, Mus musculus
ctcatcaggaacagtttggaata

SEQ ID NO: 204244 - DNA, 23 bp, Mus musculus
acatacatatgtgtatgtatatg

SEQ ID NO: 204245 - DNA, 23 bp, Mus musculus
ccatgactgaagagagtctgatc

SEQ ID NO: 204246 - DNA, 19 bp, Mus musculus
tctcagagaacagccatgc

SEQ ID NO: 204247 - DNA, 21 bp, Mus musculus
ctttcatgtatttatctatag

SEQ ID NO: 204248 - DNA, 23 bp, Mus musculus
gactctgtgtgtgtgtgtgcgtg

SEQ ID NO: 204249 - DNA, 20 bp, Mus musculus
tgtgcatgcacacacacatg

SEQ ID NO: 204250 - DNA, 20 bp, Mus musculus
tggtgcagagattctggaga

SEQ ID NO: 204251 - DNA, 23 bp, Mus musculus
acagacagacagagaggagtaga

SEQ ID NO: 204252 - DNA, 22 bp, Mus musculus
aattagactgcctttgttctag

SEQ ID NO: 204253 - DNA, 23 bp, Mus musculus
gtttctgtcagtccgtgacatct

SEQ ID NO: 204254 - DNA, 23 bp, Mus musculus
ggaatgaatactcggtgctggag

SEQ ID NO: 204255 - DNA, 23 bp, Mus musculus
cagtgtatatatatatgagtgtg

SEQ ID NO: 204256 - DNA, 21 bp, Mus musculus
agaggtagtgatttactctgc

SEQ ID NO: 204257 - DNA, 22 bp, Mus musculus
aacaagtggataaagctctgtg

SEQ ID NO: 204258 - DNA, 23 bp, Mus musculus
ttttctgctgacttgtgtctctg

SEQ ID NO: 204259 - DNA, 23 bp, Mus musculus
tgtgtgcatgtatgtatttatgt

SEQ ID NO: 204260 - DNA, 21 bp, Mus musculus
tctctctgactgtggctctag

SEQ ID NO: 204261 - DNA, 23 bp, Mus musculus
tgtgtgtacatgcatgtgtctgt

SEQ ID NO: 204262 - DNA, 23 bp, Mus musculus
atgtatatgtatgtatatatgta

SEQ ID NO: 204263 - DNA, 19 bp, Mus musculus
tgtgatgaagtagcctcat

SEQ ID NO: 204264 - DNA, 21 bp, Mus musculus
aattgcacttatccctgccta

SEQ ID NO: 204265 - DNA, 21 bp, Mus musculus
tgagtcacactgtgtgttggg

SEQ ID NO: 204266 - DNA, 21 bp, Mus musculus
ctcagagactcacagcctctc

SEQ ID NO: 204267 - DNA, 23 bp, Mus musculus
cactgtgttgagactcgctcatt

SEQ ID NO: 204268 - DNA, 19 bp, Mus musculus
tccagagagtacgtgtttg

SEQ ID NO: 204269 - DNA, 23 bp, Mus musculus
tcacacaggaatccaagcacatt

SEQ ID NO: 204270 - DNA, 22 bp, Mus musculus
agcctctgtcttattctctgtg

SEQ ID NO: 204271 - DNA, 19 bp, Mus musculus
tgcatatgtgcatgtgtgt

SEQ ID NO: 204272 - DNA, 20 bp, Mus musculus
atgtatgtgtatatgtatat

SEQ ID NO: 204273 - DNA, 23 bp, Mus musculus
cacagagcacacacagcagttca

SEQ ID NO: 204274 - DNA, 23 bp, Mus musculus
tgaggcacactgtctgtcactat

SEQ ID NO: 204275 - DNA, 23 bp, Mus musculus
tggataactttatgaagaaagga

SEQ ID NO: 204276 - DNA, 23 bp, Mus musculus
gtgagtgagtgagtgagtgtgtg

SEQ ID NO: 204277 - DNA, 23 bp, Mus musculus
atgtatgtatgtatgtatatttg

SEQ ID NO: 204278 - DNA, 22 bp, Mus musculus
tgttttgtgaccaattatatgg

SEQ ID NO: 204279 - DNA, 20 bp, Mus musculus
tctgtggatgatactgtttg

SEQ ID NO: 204280 - DNA, 23 bp, Mus musculus
tcagacagtcagtcagtcagtga

SEQ ID NO: 204281 - DNA, 23 bp, Mus musculus
attcccagcaattcaattcccac

SEQ ID NO: 204282 - DNA, 22 bp, Mus musculus
ttgacctggttgtaagtcttgt

SEQ ID NO: 204283 - DNA, 23 bp, Mus musculus
actctgactcactcaatggagac

SEQ ID NO: 204284 - DNA, 21 bp, Mus musculus
ttttggcaccaagtgagacgg

SEQ ID NO: 204285 - DNA, 20 bp, Mus musculus
tgtacatgtacatagtttaa

SEQ ID NO: 204286 - DNA, 20 bp, Mus musculus
tatatatatgatgtatatgt

SEQ ID NO: 204287 - DNA, 23 bp, Mus musculus
tgtatgtgtgtgtgtatgcatgt

SEQ ID NO: 204288 - DNA, 22 bp, Mus musculus
atctgtgtctctgtcttcctag

SEQ ID NO: 204289 - DNA, 22 bp, Mus musculus
tgttttgtgaccaattatatgg

SEQ ID NO: 204290 - DNA, 19 bp, Mus musculus
actgcttgctttaggtggg

SEQ ID NO: 204291 - DNA, 22 bp, Mus musculus
accaacagcatctgcatctgat

SEQ ID NO: 204292 - DNA, 23 bp, Mus musculus
tgggtggctgtctgtttgcctgt

SEQ ID NO: 204293 - DNA, 19 bp, Mus musculus
gaggacagtcattatagac

SEQ ID NO: 204294 - DNA, 19 bp, Mus musculus
caatatttatctatctcta

SEQ ID NO: 204295 - DNA, 20 bp, Mus musculus
tacatcagaggtaaagtgga

SEQ ID NO: 204296 - DNA, 23 bp, Mus musculus
tccctgcctgcctgtctgtctgt

SEQ ID NO: 204297 - DNA, 21 bp, Mus musculus
tccatggtggtctgataggat

SEQ ID NO: 204298 - DNA, 22 bp, Mus musculus
tgttttgtgaccaattatatgg

SEQ ID NO: 204299 - DNA, 20 bp, Mus musculus
ttgcctcatcaaggcttaat

SEQ ID NO: 204300 - DNA, 20 bp, Mus musculus
tctgagaagagacagaaaga

SEQ ID NO: 204301 - DNA, 23 bp, Mus musculus
ctgtgtgtctctgtgtatgtgca

SEQ ID NO: 204302 - DNA, 23 bp, Mus musculus
ggctgcctcagtctctgtgagtt

SEQ ID NO: 204303 - DNA, 21 bp, Mus musculus
ggttgtggttcatggttggtt

SEQ ID NO: 204304 - DNA, 22 bp, Mus musculus
ctgcctactgtgtctgctgatg

SEQ ID NO: 204305 - DNA, 23 bp, Mus musculus
aacacacacacatatatgtgtgt

SEQ ID NO: 204306 - DNA, 22 bp, Mus musculus
tgttttgtgaccaattatatgg

SEQ ID NO: 204307 - DNA, 20 bp, Mus musculus
atatatgtatttgtgtatgt

SEQ ID NO: 204308 - DNA, 23 bp, Mus musculus
ccacagcgagactcagtgttcac

SEQ ID NO: 204309 - DNA, 21 bp, Mus musculus
gtgtgtgtgtatcatgtgtat

SEQ ID NO: 204310 - DNA, 23 bp, Mus musculus
atgtatgtgtgcatgtatgtgtg

SEQ ID NO: 204311 - DNA, 23 bp, Mus musculus
atgtgtatatatgtatatgtgtg

SEQ ID NO: 204312 - DNA, 23 bp, Mus musculus
tgtgtgtatatatgtatgtatat

SEQ ID NO: 204313 - DNA, 18 bp, Mus musculus
agagtgtttgctgctcgt

SEQ ID NO: 204314 - DNA, 19 bp, Mus musculus
cagtgggtcactcactgtc

SEQ ID NO: 204315 - DNA, 23 bp, Mus musculus
tgtgtgtgtgtgtgcatgcattt

SEQ ID NO: 204316 - DNA, 21 bp, Mus musculus
tttgttgaaggtcactttcct

SEQ ID NO: 204317 - DNA, 20 bp, Mus musculus
tgactgtgattaggtacaga

SEQ ID NO: 204318 - DNA, 21 bp, Mus musculus
tctgtggctcacacagatcat

SEQ ID NO: 204319 - DNA, 19 bp, Mus musculus
ataagaatatcaaaacatg

SEQ ID NO: 204320 - DNA, 23 bp, Mus musculus
aaactgagaacagagtgtgtcca

SEQ ID NO: 204321 - DNA, 22 bp, Mus musculus
tgttttgtgaccaattatatgg

SEQ ID NO: 204322 - DNA, 22 bp, Mus musculus
aatatatgtatattacataatg

SEQ ID NO: 204323 - DNA, 23 bp, Mus musculus
atatatgtatatataattgtgag

SEQ ID NO: 204324 - DNA, 22 bp, Mus musculus
tgttttgtgaccaattatatgg

SEQ ID NO: 204325 - DNA, 21 bp, Mus musculus
atgtatacacacacacacaca

SEQ ID NO: 204326 - DNA, 23 bp, Mus musculus
agagcttacagatgagaatggat

SEQ ID NO: 204327 - DNA, 23 bp, Mus musculus
tatatgtgtatgtatatgtatgt

SEQ ID NO: 204328 - DNA, 21 bp, Mus musculus
tatatacacatatacatatac

SEQ ID NO: 204329 - DNA, 19 bp, Mus musculus
tgtatgtatgtatgtatgt

SEQ ID NO: 204330 - DNA, 22 bp, Mus musculus
tgtgtgtgtgtgtacatacata

SEQ ID NO: 204331 - DNA, 23 bp, Mus musculus
ctgagcagtgagtcagcagacag

SEQ ID NO: 204332 - DNA, 18 bp, Mus musculus
acacacacagatatatat

SEQ ID NO: 204333 - DNA, 23 bp, Mus musculus
tgacagcgaatagtgaagtttat

SEQ ID NO: 204334 - DNA, 23 bp, Mus musculus
aatgattttctttatttggattg

SEQ ID NO: 204335 - DNA, 23 bp, Mus musculus
tctcatgctctgtctcactgtgg

SEQ ID NO: 204336 - DNA, 23 bp, Mus musculus
atttagtgcatttgttgttctga

SEQ ID NO: 204337 - DNA, 18 bp, Mus musculus
tgactgaagaatctgagc

SEQ ID NO: 204338 - DNA, 23 bp, Mus musculus
tgtctgcctctcacactcactct

SEQ ID NO: 204339 - DNA, 23 bp, Mus musculus
tgcctgcctgcctgcctgcctgt

SEQ ID NO: 204340 - DNA, 19 bp, Mus musculus
gtatgtatgtatatatgta

SEQ ID NO: 204341 - DNA, 23 bp, Mus musculus
tagtgcatggtgatctgatagga

SEQ ID NO: 204342 - DNA, 23 bp, Mus musculus
tatgacctattatatggtcaatt

SEQ ID NO: 204343 - DNA, 23 bp, Mus musculus
tgcctgtctgtgtgtctatctgc

SEQ ID NO: 204344 - DNA, 23 bp, Mus musculus
ttttagttcttgtggtggcgagt

SEQ ID NO: 204345 - DNA, 20 bp, Mus musculus
tatgaggaattctaagtact

SEQ ID NO: 204346 - DNA, 22 bp, Mus musculus
tgttttgtgaccaattatatgg

SEQ ID NO: 204347 - DNA, 21 bp, Mus musculus
aaagtaggaaatcatttccac

SEQ ID NO: 204348 - DNA, 23 bp, Mus musculus
taagggattccatgtattcatgt

SEQ ID NO: 204349 - DNA, 23 bp, Mus musculus
aaatttctgtacttttcatggat

SEQ ID NO: 204350 - DNA, 22 bp, Mus musculus
atatatatatatgcatatgtgt

SEQ ID NO: 204351 - DNA, 20 bp, Mus musculus
atgtatctatgtatgtatca

SEQ ID NO: 204352 - DNA, 23 bp, Mus musculus
tggatgtatgtatgtatgtatgt

SEQ ID NO: 204353 - DNA, 23 bp, Mus musculus
gtatgtatgcatgtatgtatgta

SEQ ID NO: 204354 - DNA, 20 bp, Mus musculus
agtgtgtgtatattcatgtg

SEQ ID NO: 204355 - DNA, 23 bp, Mus musculus
tatatgtgcatatcattgtgaag

SEQ ID NO: 204356 - DNA, 23 bp, Mus musculus
tagacactgtgacttctagatga

SEQ ID NO: 204357 - DNA, 22 bp, Mus musculus
tgttttgtgaccaattatatgg

SEQ ID NO: 204358 - DNA, 20 bp, Mus musculus
tgagactagtgtaggggttg

SEQ ID NO: 204359 - DNA, 23 bp, Mus musculus
aagacagaagagtgaaagcttta

SEQ ID NO: 204360 - DNA, 23 bp, Mus musculus
tgtcagaggctacttgaccctgc

SEQ ID NO: 204361 - DNA, 21 bp, Mus musculus
agggagagaccacttgtgaca

SEQ ID NO: 204362 - DNA, 23 bp, Mus musculus
aggcaatacatgtgattttgtat

SEQ ID NO: 204363 - DNA, 23 bp, Mus musculus
acatatgttatatgtatgtccat

SEQ ID NO: 204364 - DNA, 20 bp, Mus musculus
tatatggcatgcatatgtat

SEQ ID NO: 204365 - DNA, 23 bp, Mus musculus
agttctttgtggatccagtttgt

SEQ ID NO: 204366 - DNA, 22 bp, Mus musculus
ttgtttgactctaggctagacc

SEQ ID NO: 204367 - DNA, 22 bp, Mus musculus
ttaatagcttactctggagata

SEQ ID NO: 204368 - DNA, 19 bp, Mus musculus
tgcatacatgtatatatgt

SEQ ID NO: 204369 - DNA, 18 bp, Mus musculus
atatgtatatatgtatac

SEQ ID NO: 204370 - DNA, 23 bp, Mus musculus
tatatacaatgtatatatgtgtg

SEQ ID NO: 204371 - DNA, 23 bp, Mus musculus
agtggctgagaaaggcatagcaa

SEQ ID NO: 204372 - DNA, 20 bp, Mus musculus
acaggggctgtactgatcct

SEQ ID NO: 204373 - DNA, 23 bp, Mus musculus
tctgtctctgtctcagtaccatg

SEQ ID NO: 204374 - DNA, 23 bp, Mus musculus
ctctgtggtacagcttgaggtca

SEQ ID NO: 204375 - DNA, 22 bp, Mus musculus
tgttttgtgaccaattatatgg

SEQ ID NO: 204376 - DNA, 23 bp, Mus musculus
tgagacaagtgagagaagattgt

SEQ ID NO: 204377 - DNA, 20 bp, Mus musculus
ttcagcttcttaggatctgt

SEQ ID NO: 204378 - DNA, 22 bp, Mus musculus
tgtatagatatatatgtgtaca

SEQ ID NO: 204379 - DNA, 22 bp, Mus musculus
tgtatatatatgtgtgtgtgta

SEQ ID NO: 204380 - DNA, 22 bp, Mus musculus
tgttttgtgaccaattatatgg

SEQ ID NO: 204381 - DNA, 21 bp, Mus musculus
ttactcagggtttctattcat

SEQ ID NO: 204382 - DNA, 23 bp, Mus musculus
tgactgaagagtttgtgcaaatg

SEQ ID NO: 204383 - DNA, 20 bp, Mus musculus
agagagaggttaggtgagaa

SEQ ID NO: 204384 - DNA, 23 bp, Mus musculus
attagagtaattgttttagtgtg

SEQ ID NO: 204385 - DNA, 23 bp, Mus musculus
tgtttctgtctctgtctcttgtg

SEQ ID NO: 204386 - DNA, 23 bp, Mus musculus
tgaaatgtatagaagaaaagaca

SEQ ID NO: 204387 - DNA, 23 bp, Mus musculus
gtactatgtagtgtttggctctt

SEQ ID NO: 204388 - DNA, 23 bp, Mus musculus
tatactaatcatgtgcaacattt

SEQ ID NO: 204389 - DNA, 21 bp, Mus musculus
atatgcatatatgtatatgtg

SEQ ID NO: 204390 - DNA, 21 bp, Mus musculus
tgtgtgtatatgtatgtgtgt

SEQ ID NO: 204391 - DNA, 18 bp, Mus musculus
tgcatgtatgtatttatg

SEQ ID NO: 204392 - DNA, 23 bp, Mus musculus
gtgtgtgtatatgtatatgtatg

SEQ ID NO: 204393 - DNA, 22 bp, Mus musculus
tatgtgcatatatataaagtca

SEQ ID NO: 204394 - DNA, 22 bp, Mus musculus
tgttttgtgaccaattatatgg

SEQ ID NO: 204395 - DNA, 23 bp, Mus musculus
tttcacagtgttgttaggatgtt

SEQ ID NO: 204396 - DNA, 23 bp, Mus musculus
tgtgtgccacagtagagtgagta

SEQ ID NO: 204397 - DNA, 21 bp, Mus musculus
tatgtgtatatgtgtatatga

SEQ ID NO: 204398 - DNA, 18 bp, Mus musculus
ggtagctgtgagcatcca

SEQ ID NO: 204399 - DNA, 22 bp, Mus musculus
aacacacagaactatcctactt

SEQ ID NO: 204400 - DNA, 23 bp, Mus musculus
aggatagtaatgaaatgtaatgt

SEQ ID NO: 204401 - DNA, 19 bp, Mus musculus
ttttgagagcattccttat

SEQ ID NO: 204402 - DNA, 23 bp, Mus musculus
ttaagtgaaattcatactgctga

SEQ ID NO: 204403 - DNA, 22 bp, Mus musculus
tcttccacaggcactcatcaca

SEQ ID NO: 204404 - DNA, 23 bp, Mus musculus
catgtaggtttgtatgtatatct

SEQ ID NO: 204405 - DNA, 22 bp, Mus musculus
tctgagaagagagtgatgagac

SEQ ID NO: 204406 - DNA, 22 bp, Mus musculus
gatattctctgtactatgctgg

SEQ ID NO: 204407 - DNA, 23 bp, Mus musculus
attaattgtgggttacttatgat

SEQ ID NO: 204408 - DNA, 23 bp, Mus musculus
ctttaggttgtttgtgaaggtct

SEQ ID NO: 204409 - DNA, 23 bp, Mus musculus
actgtctgctcttccagaggtcc

SEQ ID NO: 204410 - DNA, 23 bp, Mus musculus
tataaggtacttatacatatcat

SEQ ID NO: 204411 - DNA, 20 bp, Mus musculus
agacagaggccactcttttt

SEQ ID NO: 204412 - DNA, 23 bp, Mus musculus
tgactcttggctctgttttacac

SEQ ID NO: 204413 - DNA, 23 bp, Mus musculus
tctatgtacacatgtatgtatat

SEQ ID NO: 204414 - DNA, 23 bp, Mus musculus
tgactggtgatactgtggactgg

SEQ ID NO: 204415 - DNA, 23 bp, Mus musculus
gtgtgtgtatgtatatgtatatg

SEQ ID NO: 204416 - DNA, 23 bp, Mus musculus
tctctctcacacacacattatcc

SEQ ID NO: 204417 - DNA, 23 bp, Mus musculus
tcctctgaatttgtgtgtgtgcg

SEQ ID NO: 204418 - DNA, 21 bp, Mus musculus
tactagaagaacaggagcaga

SEQ ID NO: 204419 - DNA, 23 bp, Mus musculus
tctgtcaccctctctatgtctgg

SEQ ID NO: 204420 - DNA, 23 bp, Mus musculus
agagtctctctctctctctgagg

SEQ ID NO: 204421 - DNA, 21 bp, Mus musculus
tgcctgtgctggggctggtga

SEQ ID NO: 204422 - DNA, 23 bp, Mus musculus
agatagatagccatacatgtgtg

SEQ ID NO: 204423 - DNA, 23 bp, Mus musculus
tatatgtgtgtatgtatatgtgt

SEQ ID NO: 204424 - DNA, 22 bp, Mus musculus
atgtgtgtgtgtgtgtatacac

SEQ ID NO: 204425 - DNA, 21 bp, Mus musculus
atggctatgtttgatgacgga

SEQ ID NO: 204426 - DNA, 23 bp, Mus musculus
tgcccactccatgacttcagtcc

SEQ ID NO: 204427 - DNA, 18 bp, Mus musculus
ctccttcttcagcaccat

SEQ ID NO: 204428 - DNA, 23 bp, Mus musculus
tggctctttctctgattcatgtt

SEQ ID NO: 204429 - DNA, 18 bp, Mus musculus
tatgtttttatgtatctg

SEQ ID NO: 204430 - DNA, 23 bp, Mus musculus
tagtgcatggtgatctgatagga

SEQ ID NO: 204431 - DNA, 22 bp, Mus musculus
atatgtgtgtgtatgtatatac

SEQ ID NO: 204432 - DNA, 23 bp, Mus musculus
tgtgtgtatatatacatatgtgt

SEQ ID NO: 204433 - DNA, 22 bp, Mus musculus
tgttttgtgaccaattatatgg

SEQ ID NO: 204434 - DNA, 22 bp, Mus musculus
tgttttgtgaccaattatatgg

SEQ ID NO: 204435 - DNA, 22 bp, Mus musculus
tgttttgtgaccaattatatgg

SEQ ID NO: 204436 - DNA, 23 bp, Mus musculus
gtcatcttatagctagcttactg

SEQ ID NO: 204437 - DNA, 18 bp, Mus musculus
tttgcattaaatggagga

SEQ ID NO: 204438 - DNA, 20 bp, Mus musculus
atgtgtgtgtgtacatacac

SEQ ID NO: 204439 - DNA, 23 bp, Mus musculus
ttctgtctgtgcatatgcatgtg

SEQ ID NO: 204440 - DNA, 19 bp, Mus musculus
ggttaggtagactagctta

SEQ ID NO: 204441 - DNA, 19 bp, Mus musculus
agagcactgactgctcttc

SEQ ID NO: 204442 - DNA, 19 bp, Mus musculus
tctctcactatttcactct

SEQ ID NO: 204443 - DNA, 22 bp, Mus musculus
tgactggctggatctgaggtag

SEQ ID NO: 204444 - DNA, 21 bp, Mus musculus
tatgcatgtatgtttgtatgt

SEQ ID NO: 204445 - DNA, 23 bp, Mus musculus
actgactctgtgtgttttcctgc

SEQ ID NO: 204446 - DNA, 22 bp, Mus musculus
atacacacacacacacatatat

SEQ ID NO: 204447 - DNA, 23 bp, Mus musculus
gtatgtatgtgtatatgtgtatg

SEQ ID NO: 204448 - DNA, 23 bp, Mus musculus
tctttaggttggagaagttttct

SEQ ID NO: 204449 - DNA, 20 bp, Mus musculus
tgtgggtcacaatcttgaat

SEQ ID NO: 204450 - DNA, 23 bp, Mus musculus
gtagtcagtgctgattctgtctg

SEQ ID NO: 204451 - DNA, 23 bp, Mus musculus
gttaccaagatgatgttactgct

SEQ ID NO: 204452 - DNA, 23 bp, Mus musculus
tgtatgtatatatatatgtgtgt

SEQ ID NO: 204453 - DNA, 22 bp, Mus musculus
taagacatattggtgctggaga

SEQ ID NO: 204454 - DNA, 18 bp, Mus musculus
atgtgtatgtatgtatat

SEQ ID NO: 204455 - DNA, 20 bp, Mus musculus
agcacaggcagaaaagacag

SEQ ID NO: 204456 - DNA, 21 bp, Mus musculus
tgtgcatatatatgtgtgtgt

SEQ ID NO: 204457 - DNA, 22 bp, Mus musculus
atgtatgtatttgtatatgtgt

SEQ ID NO: 204458 - DNA, 23 bp, Mus musculus
tgtgtgtgcatatgtatgtatat

SEQ ID NO: 204459 - DNA, 23 bp, Mus musculus
atgtgtgcatatgtattgtatgt

SEQ ID NO: 204460 - DNA, 23 bp, Mus musculus
gagtgatgacggatgagacgggg

SEQ ID NO: 204461 - DNA, 23 bp, Mus musculus
acacagttacacactcacacact

SEQ ID NO: 204462 - DNA, 22 bp, Mus musculus
tatatctatatctaaatgtgtg

SEQ ID NO: 204463 - DNA, 23 bp, Mus musculus
tgcacacattttgtatatgtgtg

SEQ ID NO: 204464 - DNA, 23 bp, Mus musculus
gtgatttctggttcttgattctt

SEQ ID NO: 204465 - DNA, 23 bp, Mus musculus
agtgtatgtgcatgtatgtgtgt

SEQ ID NO: 204466 - DNA, 23 bp, Mus musculus
atatgtatgtatgtatgtatctg

SEQ ID NO: 204467 - DNA, 22 bp, Mus musculus
tgtgtgtatatatatgtgtgtg

SEQ ID NO: 204468 - DNA, 23 bp, Mus musculus
tccctctttcagtctctgtaggc

SEQ ID NO: 204469 - DNA, 23 bp, Mus musculus
gtcagtgtctgtacagtggcaca

SEQ ID NO: 204470 - DNA, 23 bp, Mus musculus
agatcactgactgctcttccaga

SEQ ID NO: 204471 - DNA, 23 bp, Mus musculus
gacactgactgctcttccagagg

SEQ ID NO: 204472 - DNA, 23 bp, Mus musculus
actgtctgtcagcttatcatcct

SEQ ID NO: 204473 - DNA, 22 bp, Mus musculus
aatgtcgcttatttttggtttg

SEQ ID NO: 204474 - DNA, 22 bp, Mus musculus
tgctgagtccttatgatgcgca

SEQ ID NO: 204475 - DNA, 18 bp, Mus musculus
tgcaacatgtatacacat

SEQ ID NO: 204476 - DNA, 22 bp, Mus musculus
tgtgtgtctgtatgtgtttgtg

SEQ ID NO: 204477 - DNA, 22 bp, Mus musculus
tgtatgtatatatgtatgtgtg

SEQ ID NO: 204478 - DNA, 23 bp, Mus musculus
aagcaaatgatgcactaatagct

SEQ ID NO: 204479 - DNA, 22 bp, Mus musculus
gagtgtctctgtgagggcctgg

SEQ ID NO: 204480 - DNA, 21 bp, Mus musculus
gcccctgggcctatcctagaa

SEQ ID NO: 204481 - DNA, 23 bp, Mus musculus
aagacagcttttttagttgtttg

SEQ ID NO: 204482 - DNA, 23 bp, Mus musculus
agtgtatgaatgtatatgtgtat

SEQ ID NO: 204483 - DNA, 23 bp, Mus musculus
atatgcatatatgtatatatgtg

SEQ ID NO: 204484 - DNA, 22 bp, Mus musculus
tatatggatatatacatgtaca

SEQ ID NO: 204485 - DNA, 20 bp, Mus musculus
catttgaagagaagtatgtt

SEQ ID NO: 204486 - DNA, 22 bp, Mus musculus
aaaatgcttgctttacttttct

SEQ ID NO: 204487 - DNA, 20 bp, Mus musculus
agagtaaaggctgtggggtt

SEQ ID NO: 204488 - DNA, 23 bp, Mus musculus
agcctgtcctttcactctctgtc

SEQ ID NO: 204489 - DNA, 23 bp, Mus musculus
atgaattgtaatgtagatatccg

SEQ ID NO: 204490 - DNA, 23 bp, Mus musculus
cagctgacacactgactccctgt

SEQ ID NO: 204491 - DNA, 23 bp, Mus musculus
tgcctgcctgcctgcctgtctgc

SEQ ID NO: 204492 - DNA, 22 bp, Mus musculus
tacatgagtgggtgcctgggtg

SEQ ID NO: 204493 - DNA, 23 bp, Mus musculus
gtctgtctgtgtctcaaccatgt

SEQ ID NO: 204494 - DNA, 18 bp, Mus musculus
tgtatatacgtatatgtg

SEQ ID NO: 204495 - DNA, 23 bp, Mus musculus
attgtcagtcaatctctgtgtcc

SEQ ID NO: 204496 - DNA, 23 bp, Mus musculus
tttaacgtagaaaacctttgcca

SEQ ID NO: 204497 - DNA, 23 bp, Mus musculus
tggtgcaaggttctatagggtta

SEQ ID NO: 204498 - DNA, 23 bp, Mus musculus
ttcaagtactatcttgaatagat

SEQ ID NO: 204499 - DNA, 23 bp, Mus musculus
acactgacagatgtgataaggga

SEQ ID NO: 204500 - DNA, 23 bp, Mus musculus
ccagtcacagtctgtcattgtgg

SEQ ID NO: 204501 - DNA, 23 bp, Mus musculus
atgagcatctccatgtccatgtg

SEQ ID NO: 204502 - DNA, 23 bp, Mus musculus
aacaacaggaccaggagctgtct

SEQ ID NO: 204503 - DNA, 23 bp, Mus musculus
taggttatacatgataaaggaac

SEQ ID NO: 204504 - DNA, 21 bp, Mus musculus
aggagggagatatagttgtgt

SEQ ID NO: 204505 - DNA, 19 bp, Mus musculus
tatgtacatgtatatacat

SEQ ID NO: 204506 - DNA, 23 bp, Mus musculus
ctgtcgctcactgtctgtcttca

SEQ ID NO: 204507 - DNA, 23 bp, Mus musculus
tatggctttttattcctatgtga

SEQ ID NO: 204508 - DNA, 23 bp, Mus musculus
agatgagtgagcacagagaccac

SEQ ID NO: 204509 - DNA, 22 bp, Mus musculus
aaactgagctcaggcagggaca

SEQ ID NO: 204510 - DNA, 21 bp, Mus musculus
tgtgtgtgcatgtgcatatgc

SEQ ID NO: 204511 - DNA, 21 bp, Mus musculus
tatatgtatgctttcaaagct

SEQ ID NO: 204512 - DNA, 22 bp, Mus musculus
tgttttgtgaccaattatatgg

SEQ ID NO: 204513 - DNA, 23 bp, Mus musculus
atatgaatatgtatatgtgtgtg

SEQ ID NO: 204514 - DNA, 22 bp, Mus musculus
acacacacacacaaattgaaga

SEQ ID NO: 204515 - DNA, 23 bp, Mus musculus
gtgacagtgcagaatgtggtcgg

SEQ ID NO: 204516 - DNA, 23 bp, Mus musculus
ttagtcagtgtttctgttcctgc

SEQ ID NO: 204517 - DNA, 22 bp, Mus musculus
ctgagagctgtctgtccaccta

SEQ ID NO: 204518 - DNA, 20 bp, Mus musculus
tgtatatatgtatgtatgta

SEQ ID NO: 204519 - DNA, 23 bp, Mus musculus
atgcgtgtgcatgtgtgtgtgtg

SEQ ID NO: 204520 - DNA, 23 bp, Mus musculus
gtgggatgtgagggacagaaagg

SEQ ID NO: 204521 - DNA, 23 bp, Mus musculus
tgactccagttgactcactcact

SEQ ID NO: 204522 - DNA, 18 bp, Mus musculus
tgtgtacgagcatgtgtg

SEQ ID NO: 204523 - DNA, 23 bp, Mus musculus
tgtgtagatgtatgcatatatgt

SEQ ID NO: 204524 - DNA, 19 bp, Mus musculus
tagtggaaatttatttgat

SEQ ID NO: 204525 - DNA, 19 bp, Mus musculus
aataaaggaggtggtggct

SEQ ID NO: 204526 - DNA, 20 bp, Mus musculus
acagagaagtttgtgaggag

SEQ ID NO: 204527 - DNA, 19 bp, Mus musculus
aaaggatattttctagacc

SEQ ID NO: 204528 - DNA, 23 bp, Mus musculus
ttttacctgtcctagacaatgtc

SEQ ID NO: 204529 - DNA, 23 bp, Mus musculus
ctcagtgttaagaccatagattt

SEQ ID NO: 204530 - DNA, 23 bp, Mus musculus
aatctcactaggagttttttact

SEQ ID NO: 204531 - DNA, 22 bp, Mus musculus
tctcagactttcactctctgaa

SEQ ID NO: 204532 - DNA, 23 bp, Mus musculus
agatagatgattgagtggaggaa

SEQ ID NO: 204533 - DNA, 21 bp, Mus musculus
cagtgtgaatgtggtcatccc

SEQ ID NO: 204534 - DNA, 23 bp, Mus musculus
tgagagaagtctgtgtcctgatg

SEQ ID NO: 204535 - DNA, 23 bp, Mus musculus
gtgtgtgtgagtgtatgcagtaa

SEQ ID NO: 204536 - DNA, 22 bp, Mus musculus
tatatgtataagtatgtgtgtg

SEQ ID NO: 204537 - DNA, 19 bp, Mus musculus
tagtccagagtcacctgca

SEQ ID NO: 204538 - DNA, 23 bp, Mus musculus
agtgagtcagtttctgtattggg

SEQ ID NO: 204539 - DNA, 23 bp, Mus musculus
tggtacacacacataatgcagac

SEQ ID NO: 204540 - DNA, 23 bp, Mus musculus
ctctgagtatctgtgtgtgtttt

SEQ ID NO: 204541 - DNA, 23 bp, Mus musculus
tcaacagagagtaagtaaacaca

SEQ ID NO: 204542 - DNA, 23 bp, Mus musculus
agttctttgtgtatggatgaagt

SEQ ID NO: 204543 - DNA, 23 bp, Mus musculus
aatctagtggttttgtttacaag

SEQ ID NO: 204544 - DNA, 23 bp, Mus musculus
gcctcagtcagtctctggctcat

SEQ ID NO: 204545 - DNA, 19 bp, Mus musculus
cagaatcaatacccacagt

SEQ ID NO: 204546 - DNA, 23 bp, Mus musculus
tggaacatttgtgaatttcttgt

SEQ ID NO: 204547 - DNA, 23 bp, Mus musculus
agtctcttactctctcggactct

SEQ ID NO: 204548 - DNA, 22 bp, Mus musculus
tggagacagaggccagttggaa

SEQ ID NO: 204549 - DNA, 22 bp, Mus musculus
agatgacaacatggaggtagct

SEQ ID NO: 204550 - DNA, 23 bp, Mus musculus
acacaggatctttaaagccctaa

SEQ ID NO: 204551 - DNA, 21 bp, Mus musculus
atgtgcatttatatgtgtgtg

SEQ ID NO: 204552 - DNA, 21 bp, Mus musculus
gaatccatgcatgagcgagcg

SEQ ID NO: 204553 - DNA, 23 bp, Mus musculus
cactctgtctagttgtgggtctc

SEQ ID NO: 204554 - DNA, 23 bp, Mus musculus
gggtcactgtggctctgactgag

SEQ ID NO: 204555 - DNA, 23 bp, Mus musculus
gtatgtatgtatgtatgtatgta

SEQ ID NO: 204556 - DNA, 23 bp, Mus musculus
agtggagactgtctctgactgtg

SEQ ID NO: 204557 - DNA, 22 bp, Mus musculus
gtttcagctctcactgactggc

SEQ ID NO: 204558 - DNA, 22 bp, Mus musculus
aatcacactgtgtctaactggt

SEQ ID NO: 204559 - DNA, 23 bp, Mus musculus
tgcctgcctgcctgcctgcctgc

SEQ ID NO: 204560 - DNA, 23 bp, Mus musculus
agcatgagcacctggaccaccag

SEQ ID NO: 204561 - DNA, 23 bp, Mus musculus
cactggtcactctgagtgctggg

SEQ ID NO: 204562 - DNA, 22 bp, Mus musculus
tgttttgtgaccaattatatgg

SEQ ID NO: 204563 - DNA, 22 bp, Mus musculus
agaagtgacacatgagacaggg

SEQ ID NO: 204564 - DNA, 23 bp, Mus musculus
gtccctcactctctctatgttgt

SEQ ID NO: 204565 - DNA, 19 bp, Mus musculus
aagcgtaccatgtagcagg

SEQ ID NO: 204566 - DNA, 21 bp, Mus musculus
tgtgtgaggtggtggatctct

SEQ ID NO: 204567 - DNA, 23 bp, Mus musculus
aattagcttgaagattgtgatca

SEQ ID NO: 204568 - DNA, 20 bp, Mus musculus
atctctctgagtctattggc

SEQ ID NO: 204569 - DNA, 23 bp, Mus musculus
atatgtatgtatgtatgtatgta

SEQ ID NO: 204570 - DNA, 21 bp, Mus musculus
tcactggctctctctatttga

SEQ ID NO: 204571 - DNA, 21 bp, Mus musculus
atgaacatgtcctggagccac

SEQ ID NO: 204572 - DNA, 23 bp, Mus musculus
aatgtcagtttcatagaattgct

SEQ ID NO: 204573 - DNA, 23 bp, Mus musculus
aggtcatgttcactattgctgtt

SEQ ID NO: 204574 - DNA, 18 bp, Mus musculus
tatggtaaatgtatgctc

SEQ ID NO: 204575 - DNA, 22 bp, Mus musculus
tgttttgtgaccaattatatgg

SEQ ID NO: 204576 - DNA, 19 bp, Mus musculus
tgtatgtatgtaagtatgt

SEQ ID NO: 204577 - DNA, 23 bp, Mus musculus
ttccacacagtattgcttctgac

SEQ ID NO: 204578 - DNA, 21 bp, Mus musculus
tttcacagccagaaaagtacg

SEQ ID NO: 204579 - DNA, 23 bp, Mus musculus
ctgtgtctgtctgtgtgtgcctg

SEQ ID NO: 204580 - DNA, 20 bp, Mus musculus
cagaggtcctgagttcaatt

SEQ ID NO: 204581 - DNA, 20 bp, Mus musculus
tatgtgtgtgagcatagcat

SEQ ID NO: 204582 - DNA, 23 bp, Mus musculus
tcagtcaggagtcagtgcagtca

SEQ ID NO: 204583 - DNA, 22 bp, Mus musculus
acacagaaaagagtcagctgtt

SEQ ID NO: 204584 - DNA, 21 bp, Mus musculus
tgtggtacagacagacagaca

SEQ ID NO: 204585 - DNA, 23 bp, Mus musculus
tgcctgcctgcctgtctacctgc

SEQ ID NO: 204586 - DNA, 20 bp, Mus musculus
tactgcagcactctctgaag

SEQ ID NO: 204587 - DNA, 18 bp, Mus musculus
ttctagaccttttgcttg

SEQ ID NO: 204588 - DNA, 22 bp, Mus musculus
tgcatcatctggggctggagag

SEQ ID NO: 204589 - DNA, 18 bp, Mus musculus
gtatgtatgtatgtatgt

SEQ ID NO: 204590 - DNA, 23 bp, Mus musculus
gcatgtatgtatgcatgtatgtg

SEQ ID NO: 204591 - DNA, 22 bp, Mus musculus
tgtttgcatgtatatatgtatg

SEQ ID NO: 204592 - DNA, 18 bp, Mus musculus
atatgtatgtatgtatgt

SEQ ID NO: 204593 - DNA, 23 bp, Mus musculus
tgtctgtctgtctgtctgtgtcc

SEQ ID NO: 204594 - DNA, 21 bp, Mus musculus
ggtgtgtgtcattaccctgac

SEQ ID NO: 204595 - DNA, 21 bp, Mus musculus
atggctaagtcaggaaaatgg

SEQ ID NO: 204596 - DNA, 21 bp, Mus musculus
acgactctgaggaaacagtgt

SEQ ID NO: 204597 - DNA, 23 bp, Mus musculus
ggtatgcatatgtgtgtgtgttc

SEQ ID NO: 204598 - DNA, 21 bp, Mus musculus
atacacatgtgtatctgttta

SEQ ID NO: 204599 - DNA, 23 bp, Mus musculus
atgtgtatgcatatatgtgtgta

SEQ ID NO: 204600 - DNA, 23 bp, Mus musculus
agagtgtgtatatgcatatgtgt

SEQ ID NO: 204601 - DNA, 23 bp, Mus musculus
tcccctactgaaattgaagttct

SEQ ID NO: 204602 - DNA, 20 bp, Mus musculus
ttctggctagagacgggcag

SEQ ID NO: 204603 - DNA, 22 bp, Mus musculus
aggtgtgggtggtagagtccta

SEQ ID NO: 204604 - DNA, 22 bp, Mus musculus
atgctggctcactgtgtctgtc

SEQ ID NO: 204605 - DNA, 23 bp, Mus musculus
tctctgagtgtgactgtctctct

SEQ ID NO: 204606 - DNA, 22 bp, Mus musculus
tcagtgccagccaattcgctgt

SEQ ID NO: 204607 - DNA, 19 bp, Mus musculus
agccagagacgccttgagc

SEQ ID NO: 204608 - DNA, 21 bp, Mus musculus
aatgagagcttagtcactctc

SEQ ID NO: 204609 - DNA, 23 bp, Mus musculus
tatagtcctgagagtgcagtcag

SEQ ID NO: 204610 - DNA, 22 bp, Mus musculus
tctctgtctgtctgtctgtctg

SEQ ID NO: 204611 - DNA, 23 bp, Mus musculus
aattcactatcagcatagtgagt

SEQ ID NO: 204612 - DNA, 22 bp, Mus musculus
ttggagcactcagtctttgtct

SEQ ID NO: 204613 - DNA, 19 bp, Mus musculus
aataagatcagggatcagt

SEQ ID NO: 204614 - DNA, 23 bp, Mus musculus
tgcttctctctcagtctctgagc

SEQ ID NO: 204615 - DNA, 22 bp, Mus musculus
cactgcaaaagaatagtctctg

SEQ ID NO: 204616 - DNA, 23 bp, Mus musculus
aggctctctctgagtcacttctt

SEQ ID NO: 204617 - DNA, 18 bp, Mus musculus
agccagtctccctgaatg

SEQ ID NO: 204618 - DNA, 20 bp, Mus musculus
ctgagcttcagagtgtgact

SEQ ID NO: 204619 - DNA, 23 bp, Mus musculus
tgagtctgcctcactgcctgcca

SEQ ID NO: 204620 - DNA, 20 bp, Mus musculus
agtcagtcagtctgtctcta

SEQ ID NO: 204621 - DNA, 20 bp, Mus musculus
aagaagaagggctggagaga

SEQ ID NO: 204622 - DNA, 19 bp, Mus musculus
agagcactgactgctcttc

SEQ ID NO: 204623 - DNA, 22 bp, Mus musculus
agctctgcctgtctctgcctcc

SEQ ID NO: 204624 - DNA, 18 bp, Mus musculus
atcagactcaagagaagt

SEQ ID NO: 204625 - DNA, 23 bp, Mus musculus
gtaatgtagtatgtaaatgcagt

SEQ ID NO: 204626 - DNA, 22 bp, Mus musculus
atttatgtatgtgtataggtgt

SEQ ID NO: 204627 - DNA, 22 bp, Mus musculus
tgtatgtatgtatatatgagtg

SEQ ID NO: 204628 - DNA, 19 bp, Mus musculus
gttcaattctcagcaacca

SEQ ID NO: 204629 - DNA, 19 bp, Mus musculus
aattcttcagaaatcctga

SEQ ID NO: 204630 - DNA, 23 bp, Mus musculus
caaggatctatagatttgagaaa

SEQ ID NO: 204631 - DNA, 22 bp, Mus musculus
gtgcatatgtatagtgaatcaa

SEQ ID NO: 204632 - DNA, 21 bp, Mus musculus
tatttctacgcattgcaacac

SEQ ID NO: 204633 - DNA, 23 bp, Mus musculus
ttcttttgttttttaaatgctaa

SEQ ID NO: 204634 - DNA, 23 bp, Mus musculus
tctctgtgtctcttgattagttt

SEQ ID NO: 204635 - DNA, 23 bp, Mus musculus
actctgtctgtctgtctgtctgt

SEQ ID NO: 204636 - DNA, 18 bp, Mus musculus
tgaccctctgactctgta

SEQ ID NO: 204637 - DNA, 18 bp, Mus musculus
aagtgtagttcttagctt

SEQ ID NO: 204638 - DNA, 23 bp, Mus musculus
ctgatgggtaactataggtatct

SEQ ID NO: 204639 - DNA, 23 bp, Mus musculus
tctatgtgtgtttgtagttctct

SEQ ID NO: 204640 - DNA, 23 bp, Mus musculus
aatagtctgtgggtatctataag

SEQ ID NO: 204641 - DNA, 19 bp, Mus musculus
aaaatctatggtgtctgta

SEQ ID NO: 204642 - DNA, 23 bp, Mus musculus
ggtgtctctgggcgtctataggc

SEQ ID NO: 204643 - DNA, 22 bp, Mus musculus
aatctgtacatgcctgtgagag

SEQ ID NO: 204644 - DNA, 23 bp, Mus musculus
aatttctctgtctccatctctct

SEQ ID NO: 204645 - DNA, 23 bp, Mus musculus
gggagcctgagagctatggacct

SEQ ID NO: 204646 - DNA, 23 bp, Mus musculus
ctgtctgtctgtctgtgagtaag

SEQ ID NO: 204647 - DNA, 19 bp, Mus musculus
ctgtccctctgtccctctg

SEQ ID NO: 204648 - DNA, 21 bp, Mus musculus
gttttgtgacattaagctgtg

SEQ ID NO: 204649 - DNA, 23 bp, Mus musculus
ctagtctgtctgtgtctgtcctg

SEQ ID NO: 204650 - DNA, 22 bp, Mus musculus
cactgaagactctgtgctctgg

SEQ ID NO: 204651 - DNA, 23 bp, Mus musculus
ggttcttgttgaagtcgatgcac

SEQ ID NO: 204652 - DNA, 23 bp, Mus musculus
cttgatgttcttgatcttctgca

SEQ ID NO: 204653 - DNA, 18 bp, Mus musculus
tgtatatatatgtgtgtg

SEQ ID NO: 204654 - DNA, 23 bp, Mus musculus
tgtgtgtatatgtatatgtggat

SEQ ID NO: 204655 - DNA, 23 bp, Mus musculus
tatatgtgtatatgtatatatgt

SEQ ID NO: 204656 - DNA, 22 bp, Mus musculus
atgtgtatatatatatgtgagt

SEQ ID NO: 204657 - DNA, 21 bp, Mus musculus
tgtgtaggtatacatatgtat

SEQ ID NO: 204658 - DNA, 22 bp, Mus musculus
tgtgtgtatgtatgtatatgtg

SEQ ID NO: 204659 - DNA, 21 bp, Mus musculus
agcttgagctacagaatgagt

SEQ ID NO: 204660 - DNA, 18 bp, Mus musculus
acagcagtactctgcctc

SEQ ID NO: 204661 - DNA, 23 bp, Mus musculus
taagagcactgactgctcctcca

SEQ ID NO: 204662 - DNA, 23 bp, Mus musculus
tctgtctgtgtgcatgtgtcagt

SEQ ID NO: 204663 - DNA, 23 bp, Mus musculus
ccatgtctctctgtccctgtgga

SEQ ID NO: 204664 - DNA, 22 bp, Mus musculus
tctgcggctctctgaggctctg

SEQ ID NO: 204665 - DNA, 19 bp, Mus musculus
actctttggcagatgtact

SEQ ID NO: 204666 - DNA, 21 bp, Mus musculus
tcgcacggtgcctggatccct

SEQ ID NO: 204667 - DNA, 23 bp, Mus musculus
tgtgcatctgcatgtgtattcat

SEQ ID NO: 204668 - DNA, 22 bp, Mus musculus
gtctgtgtctctcagcgcctgc

SEQ ID NO: 204669 - DNA, 23 bp, Mus musculus
tctggctcagtctctcttgaccc

SEQ ID NO: 204670 - DNA, 22 bp, Mus musculus
gtctgcctcttacagtctctct

SEQ ID NO: 204671 - DNA, 22 bp, Mus musculus
taagtctactgagaggtagacg

SEQ ID NO: 204672 - DNA, 22 bp, Mus musculus
gaatgcctctgtctctgtgtct

SEQ ID NO: 204673 - DNA, 22 bp, Mus musculus
tgttttgtgaccaattatatgg

SEQ ID NO: 204674 - DNA, 22 bp, Mus musculus
tgttttgtgaccaattatatgg

SEQ ID NO: 204675 - DNA, 20 bp, Mus musculus
tcacagaactgagtgacttg

SEQ ID NO: 204676 - DNA, 22 bp, Mus musculus
gactgtctctgactctgttgcc

SEQ ID NO: 204677 - DNA, 23 bp, Mus musculus
cttgtcccattcatatcaatggt

SEQ ID NO: 204678 - DNA, 23 bp, Mus musculus
cccagactgtgtaaatgtgacag

SEQ ID NO: 204679 - DNA, 23 bp, Mus musculus
cagtccctctccctctctgagcc

SEQ ID NO: 204680 - DNA, 22 bp, Mus musculus
tgttttgtgaccaattatatgg

SEQ ID NO: 204681 - DNA, 23 bp, Mus musculus
ctgtcactgctgccacacccact

SEQ ID NO: 204682 - DNA, 22 bp, Mus musculus
tatgtatgtatgtatatatgta

SEQ ID NO: 204683 - DNA, 22 bp, Mus musculus
ctggttctctgtctccctgtct

SEQ ID NO: 204684 - DNA, 20 bp, Mus musculus
aataagagttgatcttggga

SEQ ID NO: 204685 - DNA, 20 bp, Mus musculus
agcagaacacacgctggaga

SEQ ID NO: 204686 - DNA, 23 bp, Mus musculus
tctgtctgtctgtctgtctgcca

SEQ ID NO: 204687 - DNA, 23 bp, Mus musculus
gtctgtctgtctgtctgtctgtc

SEQ ID NO: 204688 - DNA, 22 bp, Mus musculus
tcccactcactgtctgacgaca

SEQ ID NO: 204689 - DNA, 23 bp, Mus musculus
tgcttgcctgcctgtgtgcctgt

SEQ ID NO: 204690 - DNA, 23 bp, Mus musculus
acagtgtgtacagtatgtgtaca

SEQ ID NO: 204691 - DNA, 22 bp, Mus musculus
aaagatgaggtcagacagcaga

SEQ ID NO: 204692 - DNA, 23 bp, Mus musculus
tgtatgtgtgtaagtgcatgaat

SEQ ID NO: 204693 - DNA, 23 bp, Mus musculus
atgattcatgtgtgtgagaggct

SEQ ID NO: 204694 - DNA, 19 bp, Mus musculus
atgagtgaatttatctata

SEQ ID NO: 204695 - DNA, 20 bp, Mus musculus
cagaggtcctgagttcaatt

SEQ ID NO: 204696 - DNA, 23 bp, Mus musculus
gagttcaattctcagcaaccaca

SEQ ID NO: 204697 - DNA, 22 bp, Mus musculus
tacagcttctcgtgcaactgag

SEQ ID NO: 204698 - DNA, 23 bp, Mus musculus
cgattaccagcacctacatagtg

SEQ ID NO: 204699 - DNA, 23 bp, Mus musculus
ttgtcagtactcagtgtgctggg

SEQ ID NO: 204700 - DNA, 20 bp, Mus musculus
tgtgctgcctctgcaggctg

SEQ ID NO: 204701 - DNA, 18 bp, Mus musculus
tgtgttatgtctgtctgt

SEQ ID NO: 204702 - DNA, 23 bp, Mus musculus
gtatgtgtatatgtatatgtgtg

SEQ ID NO: 204703 - DNA, 20 bp, Mus musculus
tgaacactggggctggagag

SEQ ID NO: 204704 - DNA, 18 bp, Mus musculus
tgaggaggacaaaggaca

SEQ ID NO: 204705 - DNA, 21 bp, Mus musculus
atgtatgtatggtagagatat

SEQ ID NO: 204706 - DNA, 23 bp, Mus musculus
atatatatgtatatctacatata

SEQ ID NO: 204707 - DNA, 23 bp, Mus musculus
atatgtatatatgtgtatatgta

SEQ ID NO: 204708 - DNA, 20 bp, Mus musculus
aggtatatatatatgtgtgt

SEQ ID NO: 204709 - DNA, 23 bp, Mus musculus
ctgagacaagtgatactggtcag

SEQ ID NO: 204710 - DNA, 23 bp, Mus musculus
acagtcactgccactcttgctgc

SEQ ID NO: 204711 - DNA, 23 bp, Mus musculus
gtatgtaagtatgtatgtatgta

SEQ ID NO: 204712 - DNA, 22 bp, Mus musculus
atacatgtttatacgtatatgt

SEQ ID NO: 204713 - DNA, 18 bp, Mus musculus
tgacctttctgtctgtgt

SEQ ID NO: 204714 - DNA, 23 bp, Mus musculus
actgcgtctgtctgtccctcgta

SEQ ID NO: 204715 - DNA, 23 bp, Mus musculus
gctcactgtcactctggctcact

SEQ ID NO: 204716 - DNA, 23 bp, Mus musculus
gagcactgactgctcttccagag

SEQ ID NO: 204717 - DNA, 23 bp, Mus musculus
tctatagctacagatatagatat

SEQ ID NO: 204718 - DNA, 21 bp, Mus musculus
gcctgtccttgaattcacaga

SEQ ID NO: 204719 - DNA, 23 bp, Mus musculus
ctctgtctctgtgagtattggga

SEQ ID NO: 204720 - DNA, 23 bp, Mus musculus
tgtcagagtagagactaagctgt

SEQ ID NO: 204721 - DNA, 23 bp, Mus musculus
tgtgtgcgtgtctgtcagtctgt

SEQ ID NO: 204722 - DNA, 23 bp, Mus musculus
tgttcaggtcattcaccctgctc

SEQ ID NO: 204723 - DNA, 19 bp, Mus musculus
tttaagttcagatgctcct

SEQ ID NO: 204724 - DNA, 23 bp, Mus musculus
tgcctgcctgactctctgctttt

SEQ ID NO: 204725 - DNA, 21 bp, Mus musculus
agctggagagatggttcagta

SEQ ID NO: 204726 - DNA, 22 bp, Mus musculus
tcgctctcactcactgccttac

SEQ ID NO: 204727 - DNA, 21 bp, Mus musculus
cccagtgtctctctctccctg

SEQ ID NO: 204728 - DNA, 22 bp, Mus musculus
taagagttggtgagatagtgca

SEQ ID NO: 204729 - DNA, 23 bp, Mus musculus
tgtgtggctgtgtggctgccaca

SEQ ID NO: 204730 - DNA, 23 bp, Mus musculus
aagtacaacatccttctgagtcc

SEQ ID NO: 204731 - DNA, 19 bp, Mus musculus
tgagaaagaaccctgtgct

SEQ ID NO: 204732 - DNA, 23 bp, Mus musculus
tgtctggctgtgtgtgtgagatc

SEQ ID NO: 204733 - DNA, 21 bp, Mus musculus
tactgactcctcttccagagg

SEQ ID NO: 204734 - DNA, 21 bp, Mus musculus
aaaggtgagtggatttgcgat

SEQ ID NO: 204735 - DNA, 22 bp, Mus musculus
ttcctatgtactttagggtact

SEQ ID NO: 204736 - DNA, 23 bp, Mus musculus
tgtgcactcacaggtgtttgaga

SEQ ID NO: 204737 - DNA, 23 bp, Mus musculus
catatatgtgtagatgtatgtac

SEQ ID NO: 204738 - DNA, 21 bp, Mus musculus
tgtgtgtgtgcataggtatat

SEQ ID NO: 204739 - DNA, 19 bp, Mus musculus
gtatgtatatatgtgtgtg

SEQ ID NO: 204740 - DNA, 23 bp, Mus musculus
tgtatgcatgtatgtatgtatgt

SEQ ID NO: 204741 - DNA, 23 bp, Mus musculus
tgtctcagtctctgttccctgtg

SEQ ID NO: 204742 - DNA, 23 bp, Mus musculus
gtatgtgtgtgtgcatgtgcatg

SEQ ID NO: 204743 - DNA, 23 bp, Mus musculus
tgtgtgtatatatatgtgtgtgt

SEQ ID NO: 204744 - DNA, 18 bp, Mus musculus
tatacacatatgtatgca

SEQ ID NO: 204745 - DNA, 23 bp, Mus musculus
tatgtatatgtatacatatatgt

SEQ ID NO: 204746 - DNA, 21 bp, Mus musculus
atttgggtggctgtgtattga

SEQ ID NO: 204747 - DNA, 23 bp, Mus musculus
taaaggttaacttgatctacaac

SEQ ID NO: 204748 - DNA, 20 bp, Mus musculus
tgacacatgagacagtcccc

SEQ ID NO: 204749 - DNA, 23 bp, Mus musculus
tacacacacacacatatgtgtgt

SEQ ID NO: 204750 - DNA, 21 bp, Mus musculus
tgtatatatatatatgtgtgt

SEQ ID NO: 204751 - DNA, 22 bp, Mus musculus
tgtcagctggtatatgctgcct

SEQ ID NO: 204752 - DNA, 20 bp, Mus musculus
aatgaatatgtatatgtgta

SEQ ID NO: 204753 - DNA, 18 bp, Mus musculus
atatctatatatgtatat

SEQ ID NO: 204754 - DNA, 21 bp, Mus musculus
aggtttccactacattgagat

SEQ ID NO: 204755 - DNA, 18 bp, Mus musculus
tgagtgcaacatacatgt

SEQ ID NO: 204756 - DNA, 21 bp, Mus musculus
atgtgcactcactgataagtg

SEQ ID NO: 204757 - DNA, 22 bp, Mus musculus
tgttttgtgaccaattatatgg

SEQ ID NO: 204758 - DNA, 18 bp, Mus musculus
ttctggatccaatgtgtt

SEQ ID NO: 204759 - DNA, 19 bp, Mus musculus
actatataatgtatgctgt

SEQ ID NO: 204760 - DNA, 20 bp, Mus musculus
aatgcacctgaatctgttgt

SEQ ID NO: 204761 - DNA, 23 bp, Mus musculus
atgtatgtatgtatgttgataga

SEQ ID NO: 204762 - DNA, 23 bp, Mus musculus
tagatagatagatagatagatag

SEQ ID NO: 204763 - DNA, 20 bp, Mus musculus
tagatagatgggtgtgggtg

SEQ ID NO: 204764 - DNA, 23 bp, Mus musculus
tatatatgtgtgtgtgtgtatat

SEQ ID NO: 204765 - DNA, 19 bp, Mus musculus
aatgacagccaatgaaatc

SEQ ID NO: 204766 - DNA, 19 bp, Mus musculus
acatacacacatatgtgta

SEQ ID NO: 204767 - DNA, 23 bp, Mus musculus
catacacgtgtgtgtgtgtgtgt

SEQ ID NO: 204768 - DNA, 23 bp, Mus musculus
gggtatagagtttctgatttggg

SEQ ID NO: 204769 - DNA, 19 bp, Mus musculus
gtcagtctatctgtctgtt

SEQ ID NO: 204770 - DNA, 22 bp, Mus musculus
ccagaaagactttgctgtcagg

SEQ ID NO: 204771 - DNA, 20 bp, Mus musculus
aagagcactgactgctcttc

SEQ ID NO: 204772 - DNA, 21 bp, Mus musculus
acagagggcaaggacagagag

SEQ ID NO: 204773 - DNA, 23 bp, Mus musculus
atatatgtagatatgcatatatg

SEQ ID NO: 204774 - DNA, 23 bp, Mus musculus
atatgagtatatgtatatatgag

SEQ ID NO: 204775 - DNA, 23 bp, Mus musculus
tatgtatatatgtttgtatgcat

SEQ ID NO: 204776 - DNA, 19 bp, Mus musculus
tgtatacatttatgtatgc

SEQ ID NO: 204777 - DNA, 23 bp, Mus musculus
catatgaatgtatatatgtgttt

SEQ ID NO: 204778 - DNA, 23 bp, Mus musculus
atgtatgtatatgtatatatgta

SEQ ID NO: 204779 - DNA, 23 bp, Mus musculus
tatctgcatgtgctcacctgtgt

SEQ ID NO: 204780 - DNA, 23 bp, Mus musculus
gtatgtatatgtgcaagtacagg

SEQ ID NO: 204781 - DNA, 18 bp, Mus musculus
tgtatacatatgtatata

SEQ ID NO: 204782 - DNA, 18 bp, Mus musculus
tgagagagagttcattct

SEQ ID NO: 204783 - DNA, 22 bp, Mus musculus
tgaagagtttgattgttcttgg

SEQ ID NO: 204784 - DNA, 22 bp, Mus musculus
tcatatgtatatgtatatgtat

SEQ ID NO: 204785 - DNA, 23 bp, Mus musculus
tatgtgtatatgtatgtgtatgt

SEQ ID NO: 204786 - DNA, 20 bp, Mus musculus
tgtatatatgtatgtgtgtg

SEQ ID NO: 204787 - DNA, 21 bp, Mus musculus
atgcatgtatgcatatgtgtg

SEQ ID NO: 204788 - DNA, 23 bp, Mus musculus
atgtgtatatatgtatatgtgta

SEQ ID NO: 204789 - DNA, 21 bp, Mus musculus
tgtgtgtatatatatgtatgt

SEQ ID NO: 204790 - DNA, 21 bp, Mus musculus
tgtgtgcatatatatatatgt

SEQ ID NO: 204791 - DNA, 23 bp, Mus musculus
ggtgacactctctggctgagcta

SEQ ID NO: 204792 - DNA, 23 bp, Mus musculus
tttgcctttattttcaaatctct

SEQ ID NO: 204793 - DNA, 22 bp, Mus musculus
tgttttgtgaccaattatatgg

SEQ ID NO: 204794 - DNA, 23 bp, Mus musculus
tgattggttatcttgctctttag

SEQ ID NO: 204795 - DNA, 18 bp, Mus musculus
tgtatatgtaatgtgtaa

SEQ ID NO: 204796 - DNA, 19 bp, Mus musculus
acatgtcctcattgaagac

SEQ ID NO: 204797 - DNA, 19 bp, Mus musculus
cagagcttctgagttcact

SEQ ID NO: 204798 - DNA, 23 bp, Mus musculus
gctcagtggttaagagttcttgg

SEQ ID NO: 204799 - DNA, 23 bp, Mus musculus
aaggtgtatatgtatgtgtgcgc

SEQ ID NO: 204800 - DNA, 21 bp, Mus musculus
atgtatgtatatatgtatgta

SEQ ID NO: 204801 - DNA, 19 bp, Mus musculus
tataagactgtgggtaaaa

SEQ ID NO: 204802 - DNA, 18 bp, Mus musculus
ctactttaagttgacata

SEQ ID NO: 204803 - DNA, 23 bp, Mus musculus
acactgtcagtttctcaaaatgc

SEQ ID NO: 204804 - DNA, 23 bp, Mus musculus
ctcacagtcagtgcctctcataa

SEQ ID NO: 204805 - DNA, 21 bp, Mus musculus
atgtatgtttgtatgtgtgta

SEQ ID NO: 204806 - DNA, 23 bp, Mus musculus
tgcacaagtatgtgtcagtgtat

SEQ ID NO: 204807 - DNA, 23 bp, Mus musculus
tactagccactgtctctcagtca

SEQ ID NO: 204808 - DNA, 21 bp, Mus musculus
aggagagtaatgaagaccttc

SEQ ID NO: 204809 - DNA, 18 bp, Mus musculus
tgtatatatgtatgcatg

SEQ ID NO: 204810 - DNA, 23 bp, Mus musculus
atgtatgtatgcatgtatgtatg

SEQ ID NO: 204811 - DNA, 23 bp, Mus musculus
taagagcactgactgctcttcca

SEQ ID NO: 204812 - DNA, 19 bp, Mus musculus
ttaggaataaatgactggg

SEQ ID NO: 204813 - DNA, 23 bp, Mus musculus
atgtatgtatgtatgtatgtatg

SEQ ID NO: 204814 - DNA, 22 bp, Mus musculus
ttttttttgtcaagcctggttc

SEQ ID NO: 204815 - DNA, 22 bp, Mus musculus
tgttttgtgaccaattatatgg

SEQ ID NO: 204816 - DNA, 21 bp, Mus musculus
ctgagatgaaacagttatggt

SEQ ID NO: 204817 - DNA, 22 bp, Mus musculus
tcaggcacacactcatatatgt

SEQ ID NO: 204818 - DNA, 23 bp, Mus musculus
gtaagtgtgtctctgtgagtgtg

SEQ ID NO: 204819 - DNA, 23 bp, Mus musculus
ctgtgtctctatggtcaagttgc

SEQ ID NO: 204820 - DNA, 23 bp, Mus musculus
gaaaccttgtgatattgttgatg

SEQ ID NO: 204821 - DNA, 23 bp, Mus musculus
ggtttcagttaagattatgttta

SEQ ID NO: 204822 - DNA, 23 bp, Mus musculus
actgacacaaaggagtatacact

SEQ ID NO: 204823 - DNA, 23 bp, Mus musculus
tgtgtttgttcttctgtgagtgt

SEQ ID NO: 204824 - DNA, 21 bp, Mus musculus
agagagaagagtctgtgttcc

SEQ ID NO: 204825 - DNA, 23 bp, Mus musculus
ttaacaaaggctttgaattgtct

SEQ ID NO: 204826 - DNA, 22 bp, Mus musculus
aacaacgtatcactcataagtg

SEQ ID NO: 204827 - DNA, 23 bp, Mus musculus
taacactgtcaacttgacaggat

SEQ ID NO: 204828 - DNA, 23 bp, Mus musculus
tctctgggtgtgtctgtggcaga

SEQ ID NO: 204829 - DNA, 18 bp, Mus musculus
gatgtatatgtatgaata

SEQ ID NO: 204830 - DNA, 22 bp, Mus musculus
gtcagtctgtcatttgggaccc

SEQ ID NO: 204831 - DNA, 20 bp, Mus musculus
tggctcagtggttaggagca

SEQ ID NO: 204832 - DNA, 18 bp, Mus musculus
ctagtatgtatatatgta

SEQ ID NO: 204833 - DNA, 21 bp, Mus musculus
tatgtgtgtatatatatgtat

SEQ ID NO: 204834 - DNA, 23 bp, Mus musculus
tgcaagtatgtatgtatgtatgt

SEQ ID NO: 204835 - DNA, 18 bp, Mus musculus
tatatggaattcagaaga

SEQ ID NO: 204836 - DNA, 23 bp, Mus musculus
tgtatgtgtatatgcatgtgtat

SEQ ID NO: 204837 - DNA, 23 bp, Mus musculus
atgtgtatgcatgtatatttgta

SEQ ID NO: 204838 - DNA, 23 bp, Mus musculus
tggatatgactttttgttgttga

SEQ ID NO: 204839 - DNA, 20 bp, Mus musculus
caaactctggggctaatgtg

SEQ ID NO: 204840 - DNA, 23 bp, Mus musculus
tgagcatgagagagtctgagggg

SEQ ID NO: 204841 - DNA, 19 bp, Mus musculus
tcacgcactcactcactct

SEQ ID NO: 204842 - DNA, 22 bp, Mus musculus
gttactctgtatggttatgtgt

SEQ ID NO: 204843 - DNA, 23 bp, Mus musculus
tgaggaagtatgttgtttgggtt

SEQ ID NO: 204844 - DNA, 18 bp, Mus musculus
gtatgtatgtatgaatgt

SEQ ID NO: 204845 - DNA, 19 bp, Mus musculus
atatgtgcatatgtatatg

SEQ ID NO: 204846 - DNA, 23 bp, Mus musculus
tgtgtgtgcatgtgcatgtgtgt

SEQ ID NO: 204847 - DNA, 20 bp, Mus musculus
gagactctgactggcagttc

SEQ ID NO: 204848 - DNA, 23 bp, Mus musculus
tatctgtctgtcactcattgtcc

SEQ ID NO: 204849 - DNA, 23 bp, Mus musculus
aatgatgcaattagattggatat

SEQ ID NO: 204850 - DNA, 20 bp, Mus musculus
atgtgtgtatgtgtgtgtgc

SEQ ID NO: 204851 - DNA, 22 bp, Mus musculus
gggagtctgtgtcactgactct

SEQ ID NO: 204852 - DNA, 22 bp, Mus musculus
tgtgtatgttgtatgcatgtat

SEQ ID NO: 204853 - DNA, 19 bp, Mus musculus
tgtgtgtgcatgaattgtg

SEQ ID NO: 204854 - DNA, 23 bp, Mus musculus
ctctctctgactgagatgcctgt

SEQ ID NO: 204855 - DNA, 18 bp, Mus musculus
ctggggctgaagagatgg

SEQ ID NO: 204856 - DNA, 23 bp, Mus musculus
aagcacacatatgtatgggtcca

SEQ ID NO: 204857 - DNA, 23 bp, Mus musculus
tatatgtgcatatgcatgtgcat

SEQ ID NO: 204858 - DNA, 22 bp, Mus musculus
tgttttgtgaccaattatatgg

SEQ ID NO: 204859 - DNA, 23 bp, Mus musculus
tctcagcctcagtgtctttatct

SEQ ID NO: 204860 - DNA, 23 bp, Mus musculus
taaaacagtgatgtctgtggtca

SEQ ID NO: 204861 - DNA, 23 bp, Mus musculus
aggagagtgagcagtctgtgaga

SEQ ID NO: 204862 - DNA, 23 bp, Mus musculus
ttgcatgtgtgcatatgtctatg

SEQ ID NO: 204863 - DNA, 22 bp, Mus musculus
tgttttgtgaccaattatatgg

SEQ ID NO: 204864 - DNA, 22 bp, Mus musculus
tatatatgtatggaaatgtcct

SEQ ID NO: 204865 - DNA, 20 bp, Mus musculus
aatatatgtatgagtatgca

SEQ ID NO: 204866 - DNA, 21 bp, Mus musculus
tatatgcatatttatttgtat

SEQ ID NO: 204867 - DNA, 22 bp, Mus musculus
tgttttgtgaccaattatatgg

SEQ ID NO: 204868 - DNA, 19 bp, Mus musculus
tcacagaatctgtcagtca

SEQ ID NO: 204869 - DNA, 21 bp, Mus musculus
tgtcctgttgatgggattctc

SEQ ID NO: 204870 - DNA, 21 bp, Mus musculus
atacatgtgtatgcttttgta

SEQ ID NO: 204871 - DNA, 23 bp, Mus musculus
gtatgtgatatatatatgtgtat

SEQ ID NO: 204872 - DNA, 23 bp, Mus musculus
tgatatatatatgtatatgtgtg

SEQ ID NO: 204873 - DNA, 18 bp, Mus musculus
ataggtatgtgtatgtat

SEQ ID NO: 204874 - DNA, 23 bp, Mus musculus
acagtaatgattttgttgtcctt

SEQ ID NO: 204875 - DNA, 23 bp, Mus musculus
tgtggaaatataaacataaatga

SEQ ID NO: 204876 - DNA, 23 bp, Mus musculus
atgtatgtatgtatgtatgtgtg

SEQ ID NO: 204877 - DNA, 23 bp, Mus musculus
catcgtctctctcgctgtctcat

SEQ ID NO: 204878 - DNA, 23 bp, Mus musculus
tatgtgcctatacacgtgcatac

SEQ ID NO: 204879 - DNA, 18 bp, Mus musculus
agagctcttcctccagag

SEQ ID NO: 204880 - DNA, 19 bp, Mus musculus
actgaggttcccctaggag

SEQ ID NO: 204881 - DNA, 20 bp, Mus musculus
tgtgtgtatatatatgtatg

SEQ ID NO: 204882 - DNA, 23 bp, Mus musculus
tggctctctcagtagatagaggt

SEQ ID NO: 204883 - DNA, 23 bp, Mus musculus
cctctctctgactgtgatatggc

SEQ ID NO: 204884 - DNA, 22 bp, Mus musculus
ttgtgtgtctgttagtaagagg

SEQ ID NO: 204885 - DNA, 21 bp, Mus musculus
tatgtgtatatgtatatgtgt

SEQ ID NO: 204886 - DNA, 21 bp, Mus musculus
atacacacacatataaatatg

SEQ ID NO: 204887 - DNA, 23 bp, Mus musculus
atctatgtatacatgtatgtatg

SEQ ID NO: 204888 - DNA, 20 bp, Mus musculus
tgtgtgtatgtatatatgta

SEQ ID NO: 204889 - DNA, 19 bp, Mus musculus
tcaatatatatgtgtgtgt

SEQ ID NO: 204890 - DNA, 23 bp, Mus musculus
tatgtatgtatatatatatgtat

SEQ ID NO: 204891 - DNA, 23 bp, Mus musculus
agtcactcagtcattgagcagga

SEQ ID NO: 204892 - DNA, 22 bp, Mus musculus
atatgcatgtatatacctatat

SEQ ID NO: 204893 - DNA, 20 bp, Mus musculus
ttatgtatacttatatatgt

SEQ ID NO: 204894 - DNA, 19 bp, Mus musculus
tcagagatgtgactgtgga

SEQ ID NO: 204895 - DNA, 22 bp, Mus musculus
tgttttgtgaccaattatatgg

SEQ ID NO: 204896 - DNA, 21 bp, Mus musculus
accagctcaacttctccatga

SEQ ID NO: 204897 - DNA, 23 bp, Mus musculus
atgacatgtgtaagtgttgtttt

SEQ ID NO: 204898 - DNA, 20 bp, Mus musculus
agagactgagtgaatctggt

SEQ ID NO: 204899 - DNA, 23 bp, Mus musculus
taagagcactgactgctcttcca

SEQ ID NO: 204900 - DNA, 23 bp, Mus musculus
gtgtgtgctctcacagtctctgt

SEQ ID NO: 204901 - DNA, 23 bp, Mus musculus
tctccagatctaaagacaaagca

SEQ ID NO: 204902 - DNA, 23 bp, Mus musculus
aataattctgattttcttgttga

SEQ ID NO: 204903 - DNA, 23 bp, Mus musculus
gtatgtgtttatgtacaggtgtg

SEQ ID NO: 204904 - DNA, 19 bp, Mus musculus
aaaggtactgagttcaatt

SEQ ID NO: 204905 - DNA, 18 bp, Mus musculus
atacacacacatatacgt

SEQ ID NO: 204906 - DNA, 23 bp, Mus musculus
tgtatatgtatgtatatgtatgt

SEQ ID NO: 204907 - DNA, 23 bp, Mus musculus
cctgagtgtgtctgagtctgtgc

SEQ ID NO: 204908 - DNA, 22 bp, Mus musculus
ctcctgtgccaggaatgctgct

SEQ ID NO: 204909 - DNA, 18 bp, Mus musculus
gaggggctgaagagatgg

SEQ ID NO: 204910 - DNA, 21 bp, Mus musculus
cagcaaccatctgtaatgaga

SEQ ID NO: 204911 - DNA, 23 bp, Mus musculus
atatgaccctgcaaatgagaact

SEQ ID NO: 204912 - DNA, 23 bp, Mus musculus
tgttgagactttgtttatctgtg

SEQ ID NO: 204913 - DNA, 23 bp, Mus musculus
aatgttagttgagtttagtaagg

SEQ ID NO: 204914 - DNA, 21 bp, Mus musculus
gcctgtccatgtagtatgtgg

SEQ ID NO: 204915 - DNA, 23 bp, Mus musculus
tctgtcacaggctacctggcttc

SEQ ID NO: 204916 - DNA, 20 bp, Mus musculus
agtctgagcaacagcatctg

SEQ ID NO: 204917 - DNA, 23 bp, Mus musculus
gcagctaactgtgtgtctgtctg

SEQ ID NO: 204918 - DNA, 18 bp, Mus musculus
tgtgtatgtatgtgtgtg

SEQ ID NO: 204919 - DNA, 22 bp, Mus musculus
ttatctctgtatgtgtatgtgt

SEQ ID NO: 204920 - DNA, 19 bp, Mus musculus
tatgtatgtatatatatgt

SEQ ID NO: 204921 - DNA, 23 bp, Mus musculus
atgcatgtatatgtgtgtgtgta

SEQ ID NO: 204922 - DNA, 23 bp, Mus musculus
agtcctgactgctcttccagagg

SEQ ID NO: 204923 - DNA, 20 bp, Mus musculus
tgcaggaatggatatgtgtg

SEQ ID NO: 204924 - DNA, 23 bp, Mus musculus
tctctctctctgtgagtttgagg

SEQ ID NO: 204925 - DNA, 23 bp, Mus musculus
acagccagtgtctgtctgtcttc

SEQ ID NO: 204926 - DNA, 20 bp, Mus musculus
gtatgtatgtatatgtgtgc

SEQ ID NO: 204927 - DNA, 23 bp, Mus musculus
tcagcctctcagtctctgtgtgc

SEQ ID NO: 204928 - DNA, 23 bp, Mus musculus
tctgtctctttccttctctatgc

SEQ ID NO: 204929 - DNA, 23 bp, Mus musculus
agtcagtcagtcagtcagtcagc

SEQ ID NO: 204930 - DNA, 23 bp, Mus musculus
gatgacagagaagaatgtgggca

SEQ ID NO: 204931 - DNA, 22 bp, Mus musculus
ttttttggtcttatagcatcca

SEQ ID NO: 204932 - DNA, 23 bp, Mus musculus
tgtcacacagatctgcctagaca

SEQ ID NO: 204933 - DNA, 23 bp, Mus musculus
aaagtagtactgggactggagag

SEQ ID NO: 204934 - DNA, 20 bp, Mus musculus
tgaatatatatgtatatgag

SEQ ID NO: 204935 - DNA, 23 bp, Mus musculus
tatgagtatatatgtataagtat

SEQ ID NO: 204936 - DNA, 23 bp, Mus musculus
tgagtgaggtgtagctggtgttt

SEQ ID NO: 204937 - DNA, 18 bp, Mus musculus
tgtctgtctgtctgtctc

SEQ ID NO: 204938 - DNA, 23 bp, Mus musculus
ttaagagcactcagtgctcttcc

SEQ ID NO: 204939 - DNA, 23 bp, Mus musculus
tctctgtctgactggctttgagc

SEQ ID NO: 204940 - DNA, 23 bp, Mus musculus
tgagtcagtgccactgtctgtca

SEQ ID NO: 204941 - DNA, 20 bp, Mus musculus
agaaagtgtactacagggtg

SEQ ID NO: 204942 - DNA, 23 bp, Mus musculus
tagcctcagaactttgtacctaa

SEQ ID NO: 204943 - DNA, 23 bp, Mus musculus
tgtctgagcctctgagtctggga

SEQ ID NO: 204944 - DNA, 19 bp, Mus musculus
agagatcaaagtgtgcagt

SEQ ID NO: 204945 - DNA, 23 bp, Mus musculus
agtctagcctgtgacagtgagtg

SEQ ID NO: 204946 - DNA, 21 bp, Mus musculus
gtatgcataggggctggagag

SEQ ID NO: 204947 - DNA, 23 bp, Mus musculus
tgtaggtccacacactgtaagct

SEQ ID NO: 204948 - DNA, 23 bp, Mus musculus
tctctgtgtgcctcactctaagc

SEQ ID NO: 204949 - DNA, 22 bp, Mus musculus
atgtgtgtgtatatgtatataa

SEQ ID NO: 204950 - DNA, 21 bp, Mus musculus
aatatatattactggagccag

SEQ ID NO: 204951 - DNA, 23 bp, Mus musculus
tgtatgcatgtgtatatgtgtat

SEQ ID NO: 204952 - DNA, 22 bp, Mus musculus
tatgtatacatgtatatgtgta

SEQ ID NO: 204953 - DNA, 19 bp, Mus musculus
acagtctttgtctctctgg

SEQ ID NO: 204954 - DNA, 23 bp, Mus musculus
accttgtctctttttctacatgt

SEQ ID NO: 204955 - DNA, 20 bp, Mus musculus
tggctcagtggttaggagca

SEQ ID NO: 204956 - DNA, 20 bp, Mus musculus
tgagttcaactcccagtaaa

SEQ ID NO: 204957 - DNA, 20 bp, Mus musculus
aaactggagtgggagctggt

SEQ ID NO: 204958 - DNA, 23 bp, Mus musculus
aggctgtctgtctgtctgtccta

SEQ ID NO: 204959 - DNA, 23 bp, Mus musculus
aatcagtcacactgtcagggctg

SEQ ID NO: 204960 - DNA, 18 bp, Mus musculus
tgagctgaaagactgtgg

SEQ ID NO: 204961 - DNA, 18 bp, Mus musculus
atcagagtgatgaatgct

SEQ ID NO: 204962 - DNA, 23 bp, Mus musculus
gtgtagtctgctgtttgttttga

SEQ ID NO: 204963 - DNA, 22 bp, Mus musculus
tgagttgtgagttgagttaagg

SEQ ID NO: 204964 - DNA, 23 bp, Mus musculus
agcacagccagactctctgggtc

SEQ ID NO: 204965 - DNA, 23 bp, Mus musculus
ctacacagtcagactgtctcaaa

SEQ ID NO: 204966 - DNA, 23 bp, Mus musculus
tatgtgcttgtatgtatgtgtgt

SEQ ID NO: 204967 - DNA, 23 bp, Mus musculus
acagacacacagagtagatatgg

SEQ ID NO: 204968 - DNA, 23 bp, Mus musculus
taccactacaacatggtactgtg

SEQ ID NO: 204969 - DNA, 19 bp, Mus musculus
atatatgtatagatgtatg

SEQ ID NO: 204970 - DNA, 23 bp, Mus musculus
gtctgtctgtctgtgtgtgtata

SEQ ID NO: 204971 - DNA, 23 bp, Mus musculus
gtgtctctgagtgctagagagat

SEQ ID NO: 204972 - DNA, 20 bp, Mus musculus
taggttgcatggtaggggga

SEQ ID NO: 204973 - DNA, 23 bp, Mus musculus
tctctgactgattgcaacttgag

SEQ ID NO: 204974 - DNA, 23 bp, Mus musculus
tgtgtgtgctgtcacagtctctg

SEQ ID NO: 204975 - DNA, 21 bp, Mus musculus
accttgctcatgaagcagcat

SEQ ID NO: 204976 - DNA, 22 bp, Mus musculus
tgttttgtgaccaattatatgg

SEQ ID NO: 204977 - DNA, 21 bp, Mus musculus
aaaggactctggggctggaga

SEQ ID NO: 204978 - DNA, 23 bp, Mus musculus
ccttgcagtgagcgtggcttacc

SEQ ID NO: 204979 - DNA, 20 bp, Mus musculus
tgaccctcactgtgtcacag

SEQ ID NO: 204980 - DNA, 19 bp, Mus musculus
atgacacaaactaaacagc

SEQ ID NO: 204981 - DNA, 21 bp, Mus musculus
tgagagctctgactctgtcag

SEQ ID NO: 204982 - DNA, 21 bp, Mus musculus
acattggtgagcaagcactca

SEQ ID NO: 204983 - DNA, 23 bp, Mus musculus
tacagatgtttgtgagctgacct

SEQ ID NO: 204984 - DNA, 23 bp, Mus musculus
ggttgagtggattgatgactggg

SEQ ID NO: 204985 - DNA, 23 bp, Mus musculus
cttgtctgaatttgtaaactgta

SEQ ID NO: 204986 - DNA, 22 bp, Mus musculus
tgttttgtgaccaattatatgg

SEQ ID NO: 204987 - DNA, 23 bp, Mus musculus
ctgtctgtctgtctgtctggatg

SEQ ID NO: 204988 - DNA, 23 bp, Mus musculus
ggatgtttactattgatgctgct

SEQ ID NO: 204989 - DNA, 22 bp, Mus musculus
actggttggaacatcttctgga

SEQ ID NO: 204990 - DNA, 20 bp, Mus musculus
tcagttcattgacactgaaa

SEQ ID NO: 204991 - DNA, 23 bp, Mus musculus
cccttcctgactctgtctgtgtg

SEQ ID NO: 204992 - DNA, 23 bp, Mus musculus
tagtccatggtgatctgatagga

SEQ ID NO: 204993 - DNA, 22 bp, Mus musculus
ttttatgtacaatattgtggtc

SEQ ID NO: 204994 - DNA, 22 bp, Mus musculus
ctgtcttagactctcaagtttt

SEQ ID NO: 204995 - DNA, 23 bp, Mus musculus
tattgatatgtattgatgtatgt

SEQ ID NO: 204996 - DNA, 23 bp, Mus musculus
tgtctctgactctgtgtctgtgt

SEQ ID NO: 204997 - DNA, 21 bp, Mus musculus
gtatgtatatatgtatgtatg

SEQ ID NO: 204998 - DNA, 22 bp, Mus musculus
tctgtgtgtgtacatgcttgtg

SEQ ID NO: 204999 - DNA, 23 bp, Mus musculus
aagtgtgtgcatgtatatatgtg

SEQ ID NO: 205000 - DNA, 19 bp, Mus musculus
gcaagtgtatgcccataga

SEQ ID NO: 205001 - DNA, 21 bp, Mus musculus
tataagggcctgcaactaatg

SEQ ID NO: 205002 - DNA, 22 bp, Mus musculus
tgttttgtgaccaattatatgg

SEQ ID NO: 205003 - DNA, 22 bp, Mus musculus
tgttttgtgaccaattatatgg

SEQ ID NO: 205004 - DNA, 20 bp, Mus musculus
tcacagaactgagtgacttg

SEQ ID NO: 205005 - DNA, 20 bp, Mus musculus
tgcatgtatgtatatatgta

SEQ ID NO: 205006 - DNA, 23 bp, Mus musculus
ggggtttatagtgagtttatgaa

SEQ ID NO: 205007 - DNA, 18 bp, Mus musculus
atgtatatatacatgtgt

SEQ ID NO: 205008 - DNA, 23 bp, Mus musculus
tgtcagcatatagattgctacct

SEQ ID NO: 205009 - DNA, 23 bp, Mus musculus
aagttagtaagctattgctcaga

SEQ ID NO: 205010 - DNA, 22 bp, Mus musculus
aaacagctagtaatgttatgag

SEQ ID NO: 205011 - DNA, 21 bp, Mus musculus
aatgtgtgtatatatatatgt

SEQ ID NO: 205012 - DNA, 23 bp, Mus musculus
atatatgtgtgcatgtgcatgca

SEQ ID NO: 205013 - DNA, 18 bp, Mus musculus
cttctaagtcattgctct

SEQ ID NO: 205014 - DNA, 23 bp, Mus musculus
aagagacacattatgcttgttca

SEQ ID NO: 205015 - DNA, 22 bp, Mus musculus
tgttttgtgaccaattatatgg

SEQ ID NO: 205016 - DNA, 23 bp, Mus musculus
tagtccatggtgatctgatagga

SEQ ID NO: 205017 - DNA, 19 bp, Mus musculus
ctctgcttctgacacactc

SEQ ID NO: 205018 - DNA, 23 bp, Mus musculus
attgaacttgcatgctttggtga

SEQ ID NO: 205019 - DNA, 23 bp, Mus musculus
tctctgggtctcagagactgact

SEQ ID NO: 205020 - DNA, 23 bp, Mus musculus
atatgtgtgtatgtgtatgtatg

SEQ ID NO: 205021 - DNA, 23 bp, Mus musculus
cggctgtgtgtctggcttactcc

SEQ ID NO: 205022 - DNA, 21 bp, Mus musculus
tgtgtgtgtatgtctgtgtgt

SEQ ID NO: 205023 - DNA, 19 bp, Mus musculus
ttacaggagcccatagttg

SEQ ID NO: 205024 - DNA, 22 bp, Mus musculus
ttaagtgagattttgttgttgt

SEQ ID NO: 205025 - DNA, 23 bp, Mus musculus
aaaaaagagcttggggtttcact

SEQ ID NO: 205026 - DNA, 18 bp, Mus musculus
agtgatgtgagggtggag

SEQ ID NO: 205027 - DNA, 23 bp, Mus musculus
tattcaggaagaggaggggaatg

SEQ ID NO: 205028 - DNA, 23 bp, Mus musculus
tctgacttagtatctctgtctct

SEQ ID NO: 205029 - DNA, 23 bp, Mus musculus
tttatgagtttaggaattctgtc

SEQ ID NO: 205030 - DNA, 19 bp, Mus musculus
tgcttgctgataggagcct

SEQ ID NO: 205031 - DNA, 23 bp, Mus musculus
ataaatgagattttgtagtaatc

SEQ ID NO: 205032 - DNA, 22 bp, Mus musculus
ttgactatccttgaaatctcag

SEQ ID NO: 205033 - DNA, 23 bp, Mus musculus
tagtccatggtaatctgatagga

SEQ ID NO: 205034 - DNA, 21 bp, Mus musculus
tgttttgtgaccaattatatg

SEQ ID NO: 205035 - DNA, 23 bp, Mus musculus
actcagagagtgcagacttgtaa

SEQ ID NO: 205036 - DNA, 22 bp, Mus musculus
tcatgtagttgcttctatactg

SEQ ID NO: 205037 - DNA, 23 bp, Mus musculus
cagtggctctgtgcctctgcctg

SEQ ID NO: 205038 - DNA, 18 bp, Mus musculus
tgcagtggtcttctatct

SEQ ID NO: 205039 - DNA, 19 bp, Mus musculus
tagactatatatatgtatg

SEQ ID NO: 205040 - DNA, 18 bp, Mus musculus
tattgtggttcatgtatt

SEQ ID NO: 205041 - DNA, 23 bp, Mus musculus
ctatatgtgtgtatgtgtatctc

SEQ ID NO: 205042 - DNA, 20 bp, Mus musculus
tagcaacatcatgaagctct

SEQ ID NO: 205043 - DNA, 22 bp, Mus musculus
gattgaagtcacagtggtcatg

SEQ ID NO: 205044 - DNA, 23 bp, Mus musculus
tgtgtgtatatgtatgtctgtgt

SEQ ID NO: 205045 - DNA, 23 bp, Mus musculus
ctatgtattcatgtatgtatgtg

SEQ ID NO: 205046 - DNA, 19 bp, Mus musculus
atttatcttcatatgtatt

SEQ ID NO: 205047 - DNA, 21 bp, Mus musculus
tgtctttctgtcactcagtag

SEQ ID NO: 205048 - DNA, 21 bp, Mus musculus
actcagtaagctttactgctc

SEQ ID NO: 205049 - DNA, 21 bp, Mus musculus
atgtaagtatggatgtgtact

SEQ ID NO: 205050 - DNA, 22 bp, Mus musculus
taagaatgtatgaatgtgtgtg

SEQ ID NO: 205051 - DNA, 23 bp, Mus musculus
tcagtggtacaagtttcctgtag

SEQ ID NO: 205052 - DNA, 22 bp, Mus musculus
tctgactctgtgacaggcttca

SEQ ID NO: 205053 - DNA, 21 bp, Mus musculus
atatgtatatgtatatgtata

SEQ ID NO: 205054 - DNA, 22 bp, Mus musculus
tatgtatgtatgtatgtatgta

SEQ ID NO: 205055 - DNA, 21 bp, Mus musculus
tggtggtctgataggatacag

SEQ ID NO: 205056 - DNA, 22 bp, Mus musculus
tgttttgtgaccaattatatgg

SEQ ID NO: 205057 - DNA, 22 bp, Mus musculus
tgttttgtgaccaattatatgg

SEQ ID NO: 205058 - DNA, 23 bp, Mus musculus
ttatgtgaatgtgtttaagtgtt

SEQ ID NO: 205059 - DNA, 20 bp, Mus musculus
tcacagaactgagtgacttg

SEQ ID NO: 205060 - DNA, 19 bp, Mus musculus
actcatcctattgcactgt

SEQ ID NO: 205061 - DNA, 22 bp, Mus musculus
ttattctttggatatggaatga

SEQ ID NO: 205062 - DNA, 23 bp, Mus musculus
cacaggctcacagactcacagga

SEQ ID NO: 205063 - DNA, 19 bp, Mus musculus
tagtgtgcacacatagcac

SEQ ID NO: 205064 - DNA, 23 bp, Mus musculus
tatagttccatgtgtgtcattgt

SEQ ID NO: 205065 - DNA, 21 bp, Mus musculus
aacacatgtatggaaaagtgt

SEQ ID NO: 205066 - DNA, 23 bp, Mus musculus
agcagaccttggagactagctct

SEQ ID NO: 205067 - DNA, 21 bp, Mus musculus
actgtcagagggacagttatg

SEQ ID NO: 205068 - DNA, 23 bp, Mus musculus
ggattgtagtgtggttatcctgt

SEQ ID NO: 205069 - DNA, 23 bp, Mus musculus
cttagtgcatggtgatctgatag

SEQ ID NO: 205070 - DNA, 22 bp, Mus musculus
tgttttgtgaccaattatatgg

SEQ ID NO: 205071 - DNA, 23 bp, Mus musculus
tctctcattgtttctgaattgag

SEQ ID NO: 205072 - DNA, 23 bp, Mus musculus
caagaactcggtactcggtgagt

SEQ ID NO: 205073 - DNA, 18 bp, Mus musculus
gaatctacatgatacaga

SEQ ID NO: 205074 - DNA, 19 bp, Mus musculus
tgtgtgtctgtgtgtctgt

SEQ ID NO: 205075 - DNA, 23 bp, Mus musculus
atgtgtgtatatgtatatgtgta

SEQ ID NO: 205076 - DNA, 22 bp, Mus musculus
tatgtgcatatatatacatata

SEQ ID NO: 205077 - DNA, 23 bp, Mus musculus
agctgagagttggcactgagctc

SEQ ID NO: 205078 - DNA, 23 bp, Mus musculus
ctctctatgtgtgtgtctgtgcg

SEQ ID NO: 205079 - DNA, 23 bp, Mus musculus
aacaacatcagctgtattgtgtt

SEQ ID NO: 205080 - DNA, 22 bp, Mus musculus
tgtctcctcatgcagctgcaca

SEQ ID NO: 205081 - DNA, 23 bp, Mus musculus
agtcgctcgctcactcgctcgct

SEQ ID NO: 205082 - DNA, 23 bp, Mus musculus
gtgtgtatagatgtatgtgtgtg

SEQ ID NO: 205083 - DNA, 23 bp, Mus musculus
tcacaagttcaaggcctccatga

SEQ ID NO: 205084 - DNA, 23 bp, Mus musculus
tgagtgactcagtgagtccctgt

SEQ ID NO: 205085 - DNA, 23 bp, Mus musculus
cgctcactctgtctgtgtgcctg

SEQ ID NO: 205086 - DNA, 22 bp, Mus musculus
tgttttgtgaccaattatatgg

SEQ ID NO: 205087 - DNA, 23 bp, Mus musculus
tctgtccatctctctgcctgtct

SEQ ID NO: 205088 - DNA, 23 bp, Mus musculus
tatgtgtatgtatatgtatgtgt

SEQ ID NO: 205089 - DNA, 21 bp, Mus musculus
tagacattgtgataaatatct

SEQ ID NO: 205090 - DNA, 21 bp, Mus musculus
aggtatcaatagaacaaagcg

SEQ ID NO: 205091 - DNA, 23 bp, Mus musculus
gtacatgttagtatctgtttctc

SEQ ID NO: 205092 - DNA, 19 bp, Mus musculus
ataacagatacttaggagt

SEQ ID NO: 205093 - DNA, 23 bp, Mus musculus
aagctcacactgtgtaggaacag

SEQ ID NO: 205094 - DNA, 23 bp, Mus musculus
gtctgtctgtctgcttatctgcc

SEQ ID NO: 205095 - DNA, 23 bp, Mus musculus
tctgtctcaggctctttgatgag

SEQ ID NO: 205096 - DNA, 19 bp, Mus musculus
ttgggacttgtcacgggca

SEQ ID NO: 205097 - DNA, 23 bp, Mus musculus
tctgagaagaaagagtgcattcc

SEQ ID NO: 205098 - DNA, 23 bp, Mus musculus
agccacagtctgtccctgtctgc

SEQ ID NO: 205099 - DNA, 23 bp, Mus musculus
ggagagccacagtctgttcctgt

SEQ ID NO: 205100 - DNA, 23 bp, Mus musculus
tgctcatgttggacttgaactca

SEQ ID NO: 205101 - DNA, 22 bp, Mus musculus
tgttttgtgaccaattatatgg

SEQ ID NO: 205102 - DNA, 22 bp, Mus musculus
gagcactgtctccctctatgtg

SEQ ID NO: 205103 - DNA, 22 bp, Mus musculus
gtggtgtgcttgtatgtccgtg

SEQ ID NO: 205104 - DNA, 23 bp, Mus musculus
atatgtgtatgcttatgatgtgt

SEQ ID NO: 205105 - DNA, 22 bp, Mus musculus
gatctgtctatagtgttagcca

SEQ ID NO: 205106 - DNA, 21 bp, Mus musculus
acagagcagccttcttcctgc

SEQ ID NO: 205107 - DNA, 20 bp, Mus musculus
tgactcactgtgtgcctcgc

SEQ ID NO: 205108 - DNA, 18 bp, Mus musculus
tctgggaggcagtatttg

SEQ ID NO: 205109 - DNA, 23 bp, Mus musculus
tgtctgtatatataggtatgtgt

SEQ ID NO: 205110 - DNA, 23 bp, Mus musculus
agtctgtcactggttctccagtc

SEQ ID NO: 205111 - DNA, 23 bp, Mus musculus
tgcgcacagtcagtgtctcacac

SEQ ID NO: 205112 - DNA, 22 bp, Mus musculus
agtcactgttttactatggggt

SEQ ID NO: 205113 - DNA, 18 bp, Mus musculus
agaggagagccacagttg

SEQ ID NO: 205114 - DNA, 21 bp, Mus musculus
tgtatatatagataagtgtgt

SEQ ID NO: 205115 - DNA, 23 bp, Mus musculus
gcatgcctgtgtggatttgtgta

SEQ ID NO: 205116 - DNA, 21 bp, Mus musculus
ttgcatatatatatatatgtc

SEQ ID NO: 205117 - DNA, 23 bp, Mus musculus
ttgtgtatagtgtatgtagtggt

SEQ ID NO: 205118 - DNA, 23 bp, Mus musculus
tcaatgtctgtggctcatgttac

SEQ ID NO: 205119 - DNA, 23 bp, Mus musculus
gagtgcagagagagtcacactgc

SEQ ID NO: 205120 - DNA, 23 bp, Mus musculus
tatgtgtatatgtatgtgtgtgt

SEQ ID NO: 205121 - DNA, 20 bp, Mus musculus
agccgtgtggatttcatggg

SEQ ID NO: 205122 - DNA, 23 bp, Mus musculus
agacacacattcaggtttacatg

SEQ ID NO: 205123 - DNA, 19 bp, Mus musculus
tctcatcctctctgtctca

SEQ ID NO: 205124 - DNA, 23 bp, Mus musculus
gctggctctgtccctcactggct

SEQ ID NO: 205125 - DNA, 23 bp, Mus musculus
atttcagctcctggtaacctgct

SEQ ID NO: 205126 - DNA, 23 bp, Mus musculus
atgtttctctctagtctctgtgt

SEQ ID NO: 205127 - DNA, 22 bp, Mus musculus
tgcaaagttctacagtatggta

SEQ ID NO: 205128 - DNA, 19 bp, Mus musculus
aatgtgtgtatgcatatgt

SEQ ID NO: 205129 - DNA, 23 bp, Mus musculus
ccactgactgctctttcagacag

SEQ ID NO: 205130 - DNA, 23 bp, Mus musculus
gactactgactgctcttccagag

SEQ ID NO: 205131 - DNA, 21 bp, Mus musculus
tgtctgtctgtctgtcttgac

SEQ ID NO: 205132 - DNA, 23 bp, Mus musculus
ctgtgtctctgtttagtttctgt

SEQ ID NO: 205133 - DNA, 23 bp, Mus musculus
caatctctgtctctgtcactccg

SEQ ID NO: 205134 - DNA, 19 bp, Mus musculus
tggctgtgagcgtgcctgt

SEQ ID NO: 205135 - DNA, 22 bp, Mus musculus
gcgtgcctgtgagcgtgcctgt

SEQ ID NO: 205136 - DNA, 18 bp, Mus musculus
tgtgactgatctgggagc

SEQ ID NO: 205137 - DNA, 23 bp, Mus musculus
ctgtctgctcttccagggttact

SEQ ID NO: 205138 - DNA, 23 bp, Mus musculus
tcttggagtttgcaagatttctg

SEQ ID NO: 205139 - DNA, 22 bp, Mus musculus
gtactagatagtgatcagagtt

SEQ ID NO: 205140 - DNA, 21 bp, Mus musculus
cacagaggacagagagaccag

SEQ ID NO: 205141 - DNA, 23 bp, Mus musculus
actgtctccctcagactctgttg

SEQ ID NO: 205142 - DNA, 23 bp, Mus musculus
agagagtctgcatcttttctcat

SEQ ID NO: 205143 - DNA, 20 bp, Mus musculus
acacacatcacagagtgctg

SEQ ID NO: 205144 - DNA, 23 bp, Mus musculus
agaacactgactgctcttccaga

SEQ ID NO: 205145 - DNA, 23 bp, Mus musculus
agactgtctgtctatctgtctct

SEQ ID NO: 205146 - DNA, 22 bp, Mus musculus
ttgtgtagctgtgagaaaactg

SEQ ID NO: 205147 - DNA, 23 bp, Mus musculus
gtgtctgtgtgtgcctgtgagcc

SEQ ID NO: 205148 - DNA, 22 bp, Mus musculus
tgttttgtgaccaattatatgg

SEQ ID NO: 205149 - DNA, 23 bp, Mus musculus
ttgtatgtgtgcatgtgtatgtg

SEQ ID NO: 205150 - DNA, 21 bp, Mus musculus
cacaagaggatatcttgggct

SEQ ID NO: 205151 - DNA, 20 bp, Mus musculus
tccatgttgatctgatagga

SEQ ID NO: 205152 - DNA, 22 bp, Mus musculus
ttctctgaccaattatatggtc

SEQ ID NO: 205153 - DNA, 23 bp, Mus musculus
ctatgtgtctgtgtgtctacatg

SEQ ID NO: 205154 - DNA, 22 bp, Mus musculus
gtgtcactctgtgatttcaaac

SEQ ID NO: 205155 - DNA, 23 bp, Mus musculus
agcaggtgtgagggaactgaaga

SEQ ID NO: 205156 - DNA, 23 bp, Mus musculus
gtgaccatatcattgactggagt

SEQ ID NO: 205157 - DNA, 23 bp, Mus musculus
acacactctgtcagtttgtactc

SEQ ID NO: 205158 - DNA, 23 bp, Mus musculus
tgtctgtatggtatacatgtata

SEQ ID NO: 205159 - DNA, 23 bp, Mus musculus
agacactgtcagtctcattcagg

SEQ ID NO: 205160 - DNA, 23 bp, Mus musculus
tgaaggatatgatatgtaaacat

SEQ ID NO: 205161 - DNA, 19 bp, Mus musculus
tctggtccagtctatttgg

SEQ ID NO: 205162 - DNA, 20 bp, Mus musculus
agtccctggtgatctgatag

SEQ ID NO: 205163 - DNA, 22 bp, Mus musculus
ttatatggtcatttttggagaa

SEQ ID NO: 205164 - DNA, 18 bp, Mus musculus
tgagatgaagcagcttcc

SEQ ID NO: 205165 - DNA, 22 bp, Mus musculus
agctctgtctctgtcactcctt

SEQ ID NO: 205166 - DNA, 23 bp, Mus musculus
tatatgtgcatatatgtacatat

SEQ ID NO: 205167 - DNA, 23 bp, Mus musculus
ggccatttgatatgtttttcttc

SEQ ID NO: 205168 - DNA, 19 bp, Mus musculus
tcagacaggattcaggagc

SEQ ID NO: 205169 - DNA, 23 bp, Mus musculus
ggtgtctgtctgtctgtctgact

SEQ ID NO: 205170 - DNA, 22 bp, Mus musculus
tgtgactgtgactaaaacagct

SEQ ID NO: 205171 - DNA, 21 bp, Mus musculus
gggtctggtagattagtgttg

SEQ ID NO: 205172 - DNA, 22 bp, Mus musculus
agtctggctgcctggaagccag

SEQ ID NO: 205173 - DNA, 22 bp, Mus musculus
tgttttgtgaccaattatatgg

SEQ ID NO: 205174 - DNA, 22 bp, Mus musculus
tgttttgtgaccaattatatgg

SEQ ID NO: 205175 - DNA, 23 bp, Mus musculus
gtgtgtgtctgtttgtcactcat

SEQ ID NO: 205176 - DNA, 19 bp, Mus musculus
tcctattctctatctagcc

SEQ ID NO: 205177 - DNA, 20 bp, Mus musculus
tgtgtgtgtgtatgtatgta

SEQ ID NO: 205178 - DNA, 18 bp, Mus musculus
acagctctatctctgatg

SEQ ID NO: 205179 - DNA, 18 bp, Mus musculus
atatatgtacacatgcat

SEQ ID NO: 205180 - DNA, 23 bp, Mus musculus
atatatgcatatgtgtgtgtgtg

SEQ ID NO: 205181 - DNA, 23 bp, Mus musculus
tgttttgcttcagaagctattca

SEQ ID NO: 205182 - DNA, 20 bp, Mus musculus
tcaaccttcctaatgttgtg

SEQ ID NO: 205183 - DNA, 23 bp, Mus musculus
atctctctctcttactctgcgtg

SEQ ID NO: 205184 - DNA, 23 bp, Mus musculus
gtgtgtgtgtctgtgtctgcaaa

SEQ ID NO: 205185 - DNA, 23 bp, Mus musculus
tatatgtatatatgtatatgtgt

SEQ ID NO: 205186 - DNA, 22 bp, Mus musculus
agggatgttgttaccattggag

SEQ ID NO: 205187 - DNA, 22 bp, Mus musculus
tcagtctgtttttcaaaaacag

SEQ ID NO: 205188 - DNA, 19 bp, Mus musculus
agcatgattgagatggagt

SEQ ID NO: 205189 - DNA, 20 bp, Mus musculus
tgagctatttctctaagcac

SEQ ID NO: 205190 - DNA, 20 bp, Mus musculus
tgtttgagtgagtatgtgga

SEQ ID NO: 205191 - DNA, 20 bp, Mus musculus
tatatgtatatatacatgta

SEQ ID NO: 205192 - DNA, 20 bp, Mus musculus
tgtgcatatgtatatatgta

SEQ ID NO: 205193 - DNA, 21 bp, Mus musculus
tatgtgtatatgtatgtgtgt

SEQ ID NO: 205194 - DNA, 20 bp, Mus musculus
tatgtatgtatgtatatgtg

SEQ ID NO: 205195 - DNA, 23 bp, Mus musculus
caggaacagatcacacagagcag

SEQ ID NO: 205196 - DNA, 20 bp, Mus musculus
tatgtgaagatctggatttg

SEQ ID NO: 205197 - DNA, 23 bp, Mus musculus
atatgtgtatgtgtgtatatata

SEQ ID NO: 205198 - DNA, 22 bp, Mus musculus
ttttctgattttctatttctgt

SEQ ID NO: 205199 - DNA, 23 bp, Mus musculus
taagcacaaatggtagaaatcag

SEQ ID NO: 205200 - DNA, 23 bp, Mus musculus
agttgacattttgttcttgtctc

SEQ ID NO: 205201 - DNA, 23 bp, Mus musculus
tgctagatatagttcaactagca

SEQ ID NO: 205202 - DNA, 23 bp, Mus musculus
tgagaggctctgtcagtgcctga

SEQ ID NO: 205203 - DNA, 19 bp, Mus musculus
tgagatcaagctgtaagct

SEQ ID NO: 205204 - DNA, 23 bp, Mus musculus
cacatcattgagtttcatggtga

SEQ ID NO: 205205 - DNA, 22 bp, Mus musculus
aagcatcttgaacaaatggtga

SEQ ID NO: 205206 - DNA, 23 bp, Mus musculus
ttatcatcttgtacaaagctcaa

SEQ ID NO: 205207 - DNA, 23 bp, Mus musculus
tttgtatctgtgcctgtgtatat

SEQ ID NO: 205208 - DNA, 23 bp, Mus musculus
tatggttgtatctatgtctgttt

SEQ ID NO: 205209 - DNA, 23 bp, Mus musculus
gtaggatggatgtgtcttttgtg

SEQ ID NO: 205210 - DNA, 22 bp, Mus musculus
atatatctgtatgtcatatcta

SEQ ID NO: 205211 - DNA, 23 bp, Mus musculus
gagagtactgactgctcttccag

SEQ ID NO: 205212 - DNA, 20 bp, Mus musculus
ttaagtgcgattagactgag

SEQ ID NO: 205213 - DNA, 22 bp, Mus musculus
tatgatgatcttaatcctttgt

SEQ ID NO: 205214 - DNA, 22 bp, Mus musculus
gaaaataatctcttattgtagt

SEQ ID NO: 205215 - DNA, 23 bp, Mus musculus
atatgtatatatgtatatgtaca

SEQ ID NO: 205216 - DNA, 22 bp, Mus musculus
tgttttgtgaccaattatatgg

SEQ ID NO: 205217 - DNA, 20 bp, Mus musculus
ttttggagaagagagggcat

SEQ ID NO: 205218 - DNA, 23 bp, Mus musculus
tgacctagatggttctattgttc

SEQ ID NO: 205219 - DNA, 23 bp, Mus musculus
catgtacatgtacatgtacatgt

SEQ ID NO: 205220 - DNA, 22 bp, Mus musculus
gatgtatatgtatatgtatatg

SEQ ID NO: 205221 - DNA, 20 bp, Mus musculus
aagaggaggtaatatttact

SEQ ID NO: 205222 - DNA, 22 bp, Mus musculus
tgttttgtgaccaattatatgg

SEQ ID NO: 205223 - DNA, 23 bp, Mus musculus
ttggctgtgctagaactcactct

SEQ ID NO: 205224 - DNA, 18 bp, Mus musculus
ctctagagtcacagaact

SEQ ID NO: 205225 - DNA, 22 bp, Mus musculus
tgttttgtgaccaattatatgg

SEQ ID NO: 205226 - DNA, 23 bp, Mus musculus
acagcagagagagaggtctgttg

SEQ ID NO: 205227 - DNA, 22 bp, Mus musculus
agtgcttttagattctcctagg

SEQ ID NO: 205228 - DNA, 23 bp, Mus musculus
tgtatctgtatatgtatatatgt

SEQ ID NO: 205229 - DNA, 23 bp, Mus musculus
ctggctcagaattctttcccaag

SEQ ID NO: 205230 - DNA, 23 bp, Mus musculus
tatgtgtgtgttattcatgtaaa

SEQ ID NO: 205231 - DNA, 21 bp, Mus musculus
ttgtgcatgtaaatgtatatg

SEQ ID NO: 205232 - DNA, 23 bp, Mus musculus
atatgtatgcaaatgtatatgta

SEQ ID NO: 205233 - DNA, 23 bp, Mus musculus
tgtgcattgatgtgtgcatgtgg

SEQ ID NO: 205234 - DNA, 23 bp, Mus musculus
atagtggatgtagtatgtatagt

SEQ ID NO: 205235 - DNA, 23 bp, Mus musculus
tgaagctctgtgtgtgtgtgtgt

SEQ ID NO: 205236 - DNA, 20 bp, Mus musculus
gtatacatgtatgtgtctgt

SEQ ID NO: 205237 - DNA, 23 bp, Mus musculus
taaaagcagagtctgcagcaagc

SEQ ID NO: 205238 - DNA, 23 bp, Mus musculus
gtgcttagtagagactgagcaga

SEQ ID NO: 205239 - DNA, 22 bp, Mus musculus
tgttttgtgaccaattatatgg

SEQ ID NO: 205240 - DNA, 22 bp, Mus musculus
aaggcttctgaggatgtacatt

SEQ ID NO: 205241 - DNA, 23 bp, Mus musculus
ctgtgtctgtgtttagtttctgt

SEQ ID NO: 205242 - DNA, 23 bp, Mus musculus
ttattgtatttcattatgctttg

SEQ ID NO: 205243 - DNA, 18 bp, Mus musculus
atgtgctatgtatataca

SEQ ID NO: 205244 - DNA, 22 bp, Mus musculus
tcactaattgttaatgtgtaca

SEQ ID NO: 205245 - DNA, 23 bp, Mus musculus
ctccgtctcactcacttcatggg

SEQ ID NO: 205246 - DNA, 23 bp, Mus musculus
atttttgtatctgttgagtcctg

SEQ ID NO: 205247 - DNA, 23 bp, Mus musculus
tcaatgagtggttttcttcagat

SEQ ID NO: 205248 - DNA, 23 bp, Mus musculus
gtcacagactggagagatggctc

SEQ ID NO: 205249 - DNA, 19 bp, Mus musculus
cagaggtcttgagttcaat

SEQ ID NO: 205250 - DNA, 23 bp, Mus musculus
tatgtgtatgtatatatgtgtgt

SEQ ID NO: 205251 - DNA, 23 bp, Mus musculus
tacacacaatcatatatcctttt

SEQ ID NO: 205252 - DNA, 23 bp, Mus musculus
attgtgtgtatatatgtatgtgt

SEQ ID NO: 205253 - DNA, 19 bp, Mus musculus
agaaactgccaagcttttg

SEQ ID NO: 205254 - DNA, 23 bp, Mus musculus
ttccagattctactagatcagga

SEQ ID NO: 205255 - DNA, 21 bp, Mus musculus
ttttctacacagaatcttgaa

SEQ ID NO: 205256 - DNA, 23 bp, Mus musculus
cactgtctgtgtcttacttagaa

SEQ ID NO: 205257 - DNA, 23 bp, Mus musculus
tctctcagtgagacagaacctac

SEQ ID NO: 205258 - DNA, 20 bp, Mus musculus
gtcctctctctctcagtgag

SEQ ID NO: 205259 - DNA, 22 bp, Mus musculus
atgctggatatgatatgatttt

SEQ ID NO: 205260 - DNA, 23 bp, Mus musculus
catgtatatgtgtatgtatatgt

SEQ ID NO: 205261 - DNA, 19 bp, Mus musculus
atcacattcacaattcggt

SEQ ID NO: 205262 - DNA, 22 bp, Mus musculus
caaccactcactgtgtctctcc

SEQ ID NO: 205263 - DNA, 18 bp, Mus musculus
gtatgtatgtatatatgt

SEQ ID NO: 205264 - DNA, 23 bp, Mus musculus
gggattatgttcagagaccctgt

SEQ ID NO: 205265 - DNA, 20 bp, Mus musculus
aggatgtctactgatattgt

SEQ ID NO: 205266 - DNA, 22 bp, Mus musculus
aagaacaagctctccagcctta

SEQ ID NO: 205267 - DNA, 23 bp, Mus musculus
ctgggttagttgagactgctggt

SEQ ID NO: 205268 - DNA, 23 bp, Mus musculus
ctctctctcacagcttcttcagt

SEQ ID NO: 205269 - DNA, 23 bp, Mus musculus
ctttagttgttggtagtatagtt

SEQ ID NO: 205270 - DNA, 23 bp, Mus musculus
taagacaaaaggttatcgttcac

SEQ ID NO: 205271 - DNA, 22 bp, Mus musculus
attttttactccatgtgaatgt

SEQ ID NO: 205272 - DNA, 22 bp, Mus musculus
tgttttgtgaccaattatatgg

SEQ ID NO: 205273 - DNA, 23 bp, Mus musculus
agactttatgttcagggagctgg

SEQ ID NO: 205274 - DNA, 23 bp, Mus musculus
gtttctggtaatgatttgtttcg

SEQ ID NO: 205275 - DNA, 18 bp, Mus musculus
taaggctggtacagtgcc

SEQ ID NO: 205276 - DNA, 23 bp, Mus musculus
agtgagactcactgaggctctgc

SEQ ID NO: 205277 - DNA, 19 bp, Mus musculus
taaagctgtaggaagtccc

SEQ ID NO: 205278 - DNA, 18 bp, Mus musculus
tgggttgatgagagctgt

SEQ ID NO: 205279 - DNA, 23 bp, Mus musculus
catgtgtctgtctgtctatctgg

SEQ ID NO: 205280 - DNA, 23 bp, Mus musculus
aagtgtgtagatgtgtatatgtg

SEQ ID NO: 205281 - DNA, 23 bp, Mus musculus
tatgtctatgtacatatgtgtat

SEQ ID NO: 205282 - DNA, 22 bp, Mus musculus
ggtggtctgataggatacactg

SEQ ID NO: 205283 - DNA, 23 bp, Mus musculus
ctgtctgttactctctgtgtagt

SEQ ID NO: 205284 - DNA, 18 bp, Mus musculus
tcagaggcatgattcggg

SEQ ID NO: 205285 - DNA, 22 bp, Mus musculus
atgtatgtgtatatgtatgtat

SEQ ID NO: 205286 - DNA, 23 bp, Mus musculus
tgatgaagtactagtcttgctct

SEQ ID NO: 205287 - DNA, 23 bp, Mus musculus
ttgtgtgtgtctgcatctgctat

SEQ ID NO: 205288 - DNA, 23 bp, Mus musculus
ctgtctgtctgtctgtctgtctg

SEQ ID NO: 205289 - DNA, 23 bp, Mus musculus
gtatgtatgtatgtgtgtgacgt

SEQ ID NO: 205290 - DNA, 23 bp, Mus musculus
tctctgagacagagatttgccct

SEQ ID NO: 205291 - DNA, 21 bp, Mus musculus
aaccttaccatagataagatt

SEQ ID NO: 205292 - DNA, 22 bp, Mus musculus
aatagtgtctgggtttggtggc

SEQ ID NO: 205293 - DNA, 23 bp, Mus musculus
tggctgcctctgtgcctgtgact

SEQ ID NO: 205294 - DNA, 23 bp, Mus musculus
tatctgtctgtttgtctgtctgt

SEQ ID NO: 205295 - DNA, 22 bp, Mus musculus
tttcacagccatgtttggaaca

SEQ ID NO: 205296 - DNA, 21 bp, Mus musculus
ggtgtgtgtatgtgtgcttgt

SEQ ID NO: 205297 - DNA, 22 bp, Mus musculus
agaaggttgttttgttatgagt

SEQ ID NO: 205298 - DNA, 21 bp, Mus musculus
ctctgtctatagcctatcact

SEQ ID NO: 205299 - DNA, 18 bp, Mus musculus
tccatgataacatttttt

SEQ ID NO: 205300 - DNA, 23 bp, Mus musculus
ctgcctgcctgcctgcctctgtg

SEQ ID NO: 205301 - DNA, 21 bp, Mus musculus
tgggactggagagatggctca

SEQ ID NO: 205302 - DNA, 23 bp, Mus musculus
gtgtctgtgtgtgcatgtgcatg

SEQ ID NO: 205303 - DNA, 23 bp, Mus musculus
ttgtgcatgtgtatgataacatg

SEQ ID NO: 205304 - DNA, 23 bp, Mus musculus
ctgtttctcactggctgttttgg

SEQ ID NO: 205305 - DNA, 22 bp, Mus musculus
gtatgtatgtatgtatgtatgt

SEQ ID NO: 205306 - DNA, 23 bp, Mus musculus
acatgtgtgtgcatgtgtacagg

SEQ ID NO: 205307 - DNA, 23 bp, Mus musculus
tcattagttttgtagagaaaggt

SEQ ID NO: 205308 - DNA, 23 bp, Mus musculus
ctctgactctcatagttgggtgt

SEQ ID NO: 205309 - DNA, 23 bp, Mus musculus
cagctgacagactgtctctgtct

SEQ ID NO: 205310 - DNA, 23 bp, Mus musculus
tatatgtatatatgtatgtatac

SEQ ID NO: 205311 - DNA, 22 bp, Mus musculus
ttaagacagcatcttatctgct

SEQ ID NO: 205312 - DNA, 23 bp, Mus musculus
gcttacacttccacattgctgtt

SEQ ID NO: 205313 - DNA, 23 bp, Mus musculus
gagagagaggatatgtatatgta

SEQ ID NO: 205314 - DNA, 19 bp, Mus musculus
aaagcaaaactagcaaaat

SEQ ID NO: 205315 - DNA, 23 bp, Mus musculus
ctctcctctctgtgtgtctgtct

SEQ ID NO: 205316 - DNA, 22 bp, Mus musculus
atgtgcatatttgtacatatag

SEQ ID NO: 205317 - DNA, 19 bp, Mus musculus
tgtgcatatttgtatatat

SEQ ID NO: 205318 - DNA, 23 bp, Mus musculus
ccactgtctctgagtgaaatacc

SEQ ID NO: 205319 - DNA, 23 bp, Mus musculus
agccctgagacagaactgagagt

SEQ ID NO: 205320 - DNA, 18 bp, Mus musculus
tctgaactggcaagtttc

SEQ ID NO: 205321 - DNA, 20 bp, Mus musculus
cactgagttgtgaagtcaga

SEQ ID NO: 205322 - DNA, 23 bp, Mus musculus
taaatgactgtttttcattttct

SEQ ID NO: 205323 - DNA, 19 bp, Mus musculus
atgaagatgcccagattca

SEQ ID NO: 205324 - DNA, 23 bp, Mus musculus
tataaatggatatttttggtgtg

SEQ ID NO: 205325 - DNA, 23 bp, Mus musculus
acaatgatgatgatggtgatggt

SEQ ID NO: 205326 - DNA, 23 bp, Mus musculus
atgatgatgatgatggtgatgat

SEQ ID NO: 205327 - DNA, 23 bp, Mus musculus
ttttctcttttgatatttatgtg

SEQ ID NO: 205328 - DNA, 23 bp, Mus musculus
gtgtgtgtgtgcatgtgcatgtg

SEQ ID NO: 205329 - DNA, 19 bp, Mus musculus
cttcctcctcctcctcctc

SEQ ID NO: 205330 - DNA, 22 bp, Mus musculus
tgttttgtgaccaattatatgg

SEQ ID NO: 205331 - DNA, 18 bp, Mus musculus
tgagagcagtgagagtga

SEQ ID NO: 205332 - DNA, 23 bp, Mus musculus
atacttgtagatgttcagttctg

SEQ ID NO: 205333 - DNA, 20 bp, Mus musculus
ctggtttatgtttgcctctc

SEQ ID NO: 205334 - DNA, 23 bp, Mus musculus
aaaagctattcatacctatgtga

SEQ ID NO: 205335 - DNA, 23 bp, Mus musculus
aaagcttgcaggatgttttgtgt

SEQ ID NO: 205336 - DNA, 23 bp, Mus musculus
acactctctctgcttgttgttgt

SEQ ID NO: 205337 - DNA, 22 bp, Mus musculus
tcacagagaacagacagtgctc

SEQ ID NO: 205338 - DNA, 21 bp, Mus musculus
atatatgtgagcttgtgcaga

SEQ ID NO: 205339 - DNA, 18 bp, Mus musculus
atgtatacatatgtacac

SEQ ID NO: 205340 - DNA, 18 bp, Mus musculus
tatttcctctggctggag

SEQ ID NO: 205341 - DNA, 22 bp, Mus musculus
tcacacaacagagacagcttcc

SEQ ID NO: 205342 - DNA, 23 bp, Mus musculus
gtcagcctccgtgtgtgtgtgtg

SEQ ID NO: 205343 - DNA, 23 bp, Mus musculus
tctcactctctgaataatgtcta

SEQ ID NO: 205344 - DNA, 21 bp, Mus musculus
tatgcatatatgtatgtatgt

SEQ ID NO: 205345 - DNA, 22 bp, Mus musculus
tttatgcatgtgtatatgtatg

SEQ ID NO: 205346 - DNA, 23 bp, Mus musculus
agtgtcactctgtgacatttctt

SEQ ID NO: 205347 - DNA, 23 bp, Mus musculus
tggctgtgtccctcactctccct

SEQ ID NO: 205348 - DNA, 22 bp, Mus musculus
acaggatgctctgtgagatgtg

SEQ ID NO: 205349 - DNA, 23 bp, Mus musculus
agcctcagtgcgtgagtcatcgc

SEQ ID NO: 205350 - DNA, 23 bp, Mus musculus
gagtgtatgtgtatatgtgcgtg

SEQ ID NO: 205351 - DNA, 23 bp, Mus musculus
gtatatatctgtgtgtgcatgag

SEQ ID NO: 205352 - DNA, 18 bp, Mus musculus
tgaacttgtcattcagtc

SEQ ID NO: 205353 - DNA, 23 bp, Mus musculus
aggctgagatgagactgaccaca

SEQ ID NO: 205354 - DNA, 23 bp, Mus musculus
tgtcaaggttttggtcacggtga

SEQ ID NO: 205355 - DNA, 18 bp, Mus musculus
acacagagaaaccctgtc

SEQ ID NO: 205356 - DNA, 19 bp, Mus musculus
ggctgttgttgagcacagg

SEQ ID NO: 205357 - DNA, 23 bp, Mus musculus
tgagctccaccttcagtgagaga

SEQ ID NO: 205358 - DNA, 18 bp, Mus musculus
aaggaaggaaggtggtga

SEQ ID NO: 205359 - DNA, 22 bp, Mus musculus
tgtctgtctggttatgtggatg

SEQ ID NO: 205360 - DNA, 23 bp, Mus musculus
tatatggttatgtagatgtttgt

SEQ ID NO: 205361 - DNA, 23 bp, Mus musculus
tgtatgcatgtatgtatatatgt

SEQ ID NO: 205362 - DNA, 23 bp, Mus musculus
gtatgcatgcatgtatgtatcta

SEQ ID NO: 205363 - DNA, 20 bp, Mus musculus
aatgtatctgtgcatgtaca

SEQ ID NO: 205364 - DNA, 23 bp, Mus musculus
tagtccatggtgatctgatagga

SEQ ID NO: 205365 - DNA, 22 bp, Mus musculus
tgttttgtgaccaattatatgg

SEQ ID NO: 205366 - DNA, 18 bp, Mus musculus
tgcttccggtttctgtct

SEQ ID NO: 205367 - DNA, 23 bp, Mus musculus
agatcacagaaatgtgtgtggtc

SEQ ID NO: 205368 - DNA, 22 bp, Mus musculus
taatgtggattagtatatgtga

SEQ ID NO: 205369 - DNA, 21 bp, Mus musculus
aagctgagtgaagactgtctg

SEQ ID NO: 205370 - DNA, 23 bp, Mus musculus
gaggagactctgacatcatcaag

SEQ ID NO: 205371 - DNA, 23 bp, Mus musculus
gagcacagtgcgtgcagagactc

SEQ ID NO: 205372 - DNA, 21 bp, Mus musculus
atatatgtgtatatgtatgtg

SEQ ID NO: 205373 - DNA, 23 bp, Mus musculus
tgtgtatatatatatgtgtgtgt

SEQ ID NO: 205374 - DNA, 22 bp, Mus musculus
tgtctgtatatatatgtatgta

SEQ ID NO: 205375 - DNA, 22 bp, Mus musculus
ttatgcatgtgtatgggtatgt

SEQ ID NO: 205376 - DNA, 19 bp, Mus musculus
agagtctgaggggagttgg

SEQ ID NO: 205377 - DNA, 20 bp, Mus musculus
actgggtggctattgtgtgt

SEQ ID NO: 205378 - DNA, 18 bp, Mus musculus
tggtttactgtatgtatg

SEQ ID NO: 205379 - DNA, 23 bp, Mus musculus
tcctactctctgacttaaagctc

SEQ ID NO: 205380 - DNA, 21 bp, Mus musculus
tggctctgagtaaccagccta

SEQ ID NO: 205381 - DNA, 23 bp, Mus musculus
ctgaggacagagtgagtacacat

SEQ ID NO: 205382 - DNA, 22 bp, Mus musculus
tgttttgtgaccaattatatgg

SEQ ID NO: 205383 - DNA, 21 bp, Mus musculus
taacacttccagctttgaatt

SEQ ID NO: 205384 - DNA, 21 bp, Mus musculus
gaatctgtgcttctggatctg

SEQ ID NO: 205385 - DNA, 23 bp, Mus musculus
tagtgttccctacattttggtgt

SEQ ID NO: 205386 - DNA, 20 bp, Mus musculus
acgcagaagaggggactcac

SEQ ID NO: 205387 - DNA, 23 bp, Mus musculus
tgtctgtctgtgtgtacgtgcat

SEQ ID NO: 205388 - DNA, 23 bp, Mus musculus
ctctaggtctctctgtctttgtt

SEQ ID NO: 205389 - DNA, 23 bp, Mus musculus
tatatatgtatatgtacatatgt

SEQ ID NO: 205390 - DNA, 23 bp, Mus musculus
actgcattgtgagcagctgtctg

SEQ ID NO: 205391 - DNA, 21 bp, Mus musculus
aaacagactgcttatcagtct

SEQ ID NO: 205392 - DNA, 20 bp, Mus musculus
attatgtatatatatatgtg

SEQ ID NO: 205393 - DNA, 23 bp, Mus musculus
ttgtctcttcttaggtctttgga

SEQ ID NO: 205394 - DNA, 21 bp, Mus musculus
tccaagtcacattaagctgtg

SEQ ID NO: 205395 - DNA, 23 bp, Mus musculus
cacagaagtgtgtgacctgaagc

SEQ ID NO: 205396 - DNA, 22 bp, Mus musculus
tttgaagataatgagtaggcaa

SEQ ID NO: 205397 - DNA, 18 bp, Mus musculus
cttaaattgtttttctca

SEQ ID NO: 205398 - DNA, 21 bp, Mus musculus
atactgcttattaattgtgca

SEQ ID NO: 205399 - DNA, 23 bp, Mus musculus
acttcctgctttctctctgtgtc

SEQ ID NO: 205400 - DNA, 19 bp, Mus musculus
atgtgtgtggatactatat

SEQ ID NO: 205401 - DNA, 23 bp, Mus musculus
tgtctctgtaactctttccatgg

SEQ ID NO: 205402 - DNA, 20 bp, Mus musculus
acacaagaccgacaagcatt

SEQ ID NO: 205403 - DNA, 23 bp, Mus musculus
gctctgtctctgtctctgtctct

SEQ ID NO: 205404 - DNA, 18 bp, Mus musculus
atccaggaacttcttggc

SEQ ID NO: 205405 - DNA, 23 bp, Mus musculus
atacagctaaccatgtcgaagtt

SEQ ID NO: 205406 - DNA, 22 bp, Mus musculus
atgtacatatatatatgtgtgt

SEQ ID NO: 205407 - DNA, 21 bp, Mus musculus
tgtatgtatgtatgtatgtat

SEQ ID NO: 205408 - DNA, 23 bp, Mus musculus
attaacagtggatcacatgtggg

SEQ ID NO: 205409 - DNA, 20 bp, Mus musculus
tttgtagtcaggaagtacta

SEQ ID NO: 205410 - DNA, 23 bp, Mus musculus
tgtgcttctgtgggtctgtggct

SEQ ID NO: 205411 - DNA, 23 bp, Mus musculus
tgcgactctgactgcctctcagc

SEQ ID NO: 205412 - DNA, 23 bp, Mus musculus
gagactgctctctctctcagagc

SEQ ID NO: 205413 - DNA, 23 bp, Mus musculus
taagggagtgcattttttctgct

SEQ ID NO: 205414 - DNA, 19 bp, Mus musculus
tctcctggtgtgaaattgc

SEQ ID NO: 205415 - DNA, 22 bp, Mus musculus
tctgtgaggcaagccagtcaca

SEQ ID NO: 205416 - DNA, 23 bp, Mus musculus
tgtaatgtatacatgtatatgta

SEQ ID NO: 205417 - DNA, 23 bp, Mus musculus
tatatgtaatgtatacatgtata

SEQ ID NO: 205418 - DNA, 20 bp, Mus musculus
atgagctaggacttgggaga

SEQ ID NO: 205419 - DNA, 19 bp, Mus musculus
tctcacactgtcttcctgc

SEQ ID NO: 205420 - DNA, 22 bp, Mus musculus
taagcagagacaggagtgagag

SEQ ID NO: 205421 - DNA, 23 bp, Mus musculus
tgtccctgactctctggcaagca

SEQ ID NO: 205422 - DNA, 23 bp, Mus musculus
tctcactgtgacagtttttcctg

SEQ ID NO: 205423 - DNA, 23 bp, Mus musculus
atctgtgagttcaaggacagtct

SEQ ID NO: 205424 - DNA, 23 bp, Mus musculus
aacagacacaccctgactcacta

SEQ ID NO: 205425 - DNA, 23 bp, Mus musculus
aaactctagtcggtgccacaaac

SEQ ID NO: 205426 - DNA, 23 bp, Mus musculus
gtatgtatgtatgtatgtatgta

SEQ ID NO: 205427 - DNA, 23 bp, Mus musculus
tgcatgtgcatatgtatatgtgt

SEQ ID NO: 205428 - DNA, 20 bp, Mus musculus
tggctcagtggttaggagca

SEQ ID NO: 205429 - DNA, 23 bp, Mus musculus
tctgtctgtatgtctgactgccc

SEQ ID NO: 205430 - DNA, 23 bp, Mus musculus
ctctctctctctaagtgttttgg

SEQ ID NO: 205431 - DNA, 23 bp, Mus musculus
tagtccgtgatgatctgatagga

SEQ ID NO: 205432 - DNA, 23 bp, Mus musculus
tctgctctcatcatgatgtagaa

SEQ ID NO: 205433 - DNA, 23 bp, Mus musculus
aatgagagcatctgcatgtcctt

SEQ ID NO: 205434 - DNA, 21 bp, Mus musculus
tgcatatatatatatatgtgt

SEQ ID NO: 205435 - DNA, 22 bp, Mus musculus
atatgtatgtatgtatgtgtgt

SEQ ID NO: 205436 - DNA, 23 bp, Mus musculus
gtggtcttgtgtgtacctgtatg

SEQ ID NO: 205437 - DNA, 19 bp, Mus musculus
taaagatatggagctggag

SEQ ID NO: 205438 - DNA, 20 bp, Mus musculus
tcagacaggaacaattaaag

SEQ ID NO: 205439 - DNA, 23 bp, Mus musculus
tgtatgtgtgcttgtgcatgtgt

SEQ ID NO: 205440 - DNA, 23 bp, Mus musculus
tatgtgtctctgtatgcatgtgt

SEQ ID NO: 205441 - DNA, 20 bp, Mus musculus
tcacagaactgagtgacttg

SEQ ID NO: 205442 - DNA, 23 bp, Mus musculus
ctgtctgtctgtctgtctgtctg

SEQ ID NO: 205443 - DNA, 23 bp, Mus musculus
tagtccatggtgatctgatagga

SEQ ID NO: 205444 - DNA, 23 bp, Mus musculus
tgttttgtgaccaattacatggt

SEQ ID NO: 205445 - DNA, 19 bp, Mus musculus
agagttgagagtgttcaca

SEQ ID NO: 205446 - DNA, 23 bp, Mus musculus
ttcagacatgagctagcatgtgg

SEQ ID NO: 205447 - DNA, 23 bp, Mus musculus
gctatgttacagtgacacaatac

SEQ ID NO: 205448 - DNA, 21 bp, Mus musculus
attacatacatattctaatgt

SEQ ID NO: 205449 - DNA, 23 bp, Mus musculus
gtctgtctgtctgtctgtgtaca

SEQ ID NO: 205450 - DNA, 21 bp, Mus musculus
aagtatgtatgcatgtgtgta

SEQ ID NO: 205451 - DNA, 23 bp, Mus musculus
gtatgcatgtatgtaagtgtgta

SEQ ID NO: 205452 - DNA, 23 bp, Mus musculus
agcatgtatgtatgtatgtatgt

SEQ ID NO: 205453 - DNA, 23 bp, Mus musculus
agacacatgtgagtgagaactga

SEQ ID NO: 205454 - DNA, 22 bp, Mus musculus
tttatgtcacatgcatatattt

SEQ ID NO: 205455 - DNA, 19 bp, Mus musculus
taggagctgattataaatg

SEQ ID NO: 205456 - DNA, 23 bp, Mus musculus
tgcgtctgtgtctgtgtatatac

SEQ ID NO: 205457 - DNA, 20 bp, Mus musculus
atgtatgtatgtatatgtgg

SEQ ID NO: 205458 - DNA, 22 bp, Mus musculus
tgtatgtatgtaaagctagggt

SEQ ID NO: 205459 - DNA, 22 bp, Mus musculus
atatgtgaatatatatctatgt

SEQ ID NO: 205460 - DNA, 20 bp, Mus musculus
ctctgcattcctttattgag

SEQ ID NO: 205461 - DNA, 23 bp, Mus musculus
tttgagtctgagattagctggag

SEQ ID NO: 205462 - DNA, 20 bp, Mus musculus
aagagcactgactgctcttc

SEQ ID NO: 205463 - DNA, 23 bp, Mus musculus
tgtgtgtgtgtgagcatgtgtac

SEQ ID NO: 205464 - DNA, 23 bp, Mus musculus
ttaacactgactgctcttccaga

SEQ ID NO: 205465 - DNA, 23 bp, Mus musculus
accacatcagagtgagcagtgtc

SEQ ID NO: 205466 - DNA, 21 bp, Mus musculus
ttaagagcactgactgctctt

SEQ ID NO: 205467 - DNA, 22 bp, Mus musculus
actggaacttcattccctgccg

SEQ ID NO: 205468 - DNA, 23 bp, Mus musculus
tgcacagactgaagtccctgagg

SEQ ID NO: 205469 - DNA, 23 bp, Mus musculus
ctgtgtgtgcctgccaagatgtg

SEQ ID NO: 205470 - DNA, 23 bp, Mus musculus
gctagaagcaggaagatggagct

SEQ ID NO: 205471 - DNA, 23 bp, Mus musculus
tgtgtgtgtctatgtgtgtgtga

SEQ ID NO: 205472 - DNA, 21 bp, Mus musculus
tgggtgtgaatgaacccagaa

SEQ ID NO: 205473 - DNA, 23 bp, Mus musculus
tctctctgtgcgtgcctgtgtcc

SEQ ID NO: 205474 - DNA, 23 bp, Mus musculus
gactgctcttccagaggtcctga

SEQ ID NO: 205475 - DNA, 20 bp, Mus musculus
acaaccatctgtaatgggat

SEQ ID NO: 205476 - DNA, 18 bp, Mus musculus
agagagatgactcagcag

SEQ ID NO: 205477 - DNA, 19 bp, Mus musculus
agtgctgtttccattcttc

SEQ ID NO: 205478 - DNA, 21 bp, Mus musculus
tcccaggcctttgtcattgcc

SEQ ID NO: 205479 - DNA, 23 bp, Mus musculus
gtgtgtctctgtccctgtgtccc

SEQ ID NO: 205480 - DNA, 18 bp, Mus musculus
aagggatccatctctgtg

SEQ ID NO: 205481 - DNA, 21 bp, Mus musculus
tcaggaggcagaggcaggcag

SEQ ID NO: 205482 - DNA, 23 bp, Mus musculus
cagcctcactcagcctgagtgag

SEQ ID NO: 205483 - DNA, 23 bp, Mus musculus
attgcctctggatgacttcaccg

SEQ ID NO: 205484 - DNA, 23 bp, Mus musculus
ggtcagtgtgtggcacagcttga

SEQ ID NO: 205485 - DNA, 19 bp, Mus musculus
agcagcatggctaatgggt

SEQ ID NO: 205486 - DNA, 20 bp, Mus musculus
tgacagagttttgttcagta

SEQ ID NO: 205487 - DNA, 23 bp, Mus musculus
agtctgcctgtctgcctgtctgt

SEQ ID NO: 205488 - DNA, 18 bp, Mus musculus
agtggacaaaagtgagac

SEQ ID NO: 205489 - DNA, 23 bp, Mus musculus
ctatgcctgtcttctgtctgtct

SEQ ID NO: 205490 - DNA, 20 bp, Mus musculus
acttctcttgtctctggctg

SEQ ID NO: 205491 - DNA, 23 bp, Mus musculus
tctgaacaagtcattggctgttg

SEQ ID NO: 205492 - DNA, 18 bp, Mus musculus
ttctcagtaccacacagt

SEQ ID NO: 205493 - DNA, 23 bp, Mus musculus
tagactgatagttgaagatgcag

SEQ ID NO: 205494 - DNA, 18 bp, Mus musculus
tgcactcttgagggttgg

SEQ ID NO: 205495 - DNA, 22 bp, Mus musculus
tctgtcaggctctcagtcagtc

SEQ ID NO: 205496 - DNA, 23 bp, Mus musculus
agtgaacaaattgagaggagttg

SEQ ID NO: 205497 - DNA, 23 bp, Mus musculus
ttgtgttgaagatgtcctggtga

SEQ ID NO: 205498 - DNA, 23 bp, Mus musculus
cggtcttgacacagtctgtctct

SEQ ID NO: 205499 - DNA, 22 bp, Mus musculus
gctctctgtttctctcaggctg

SEQ ID NO: 205500 - DNA, 20 bp, Mus musculus
ttctgcttggtatagtaatg

SEQ ID NO: 205501 - DNA, 23 bp, Mus musculus
tcctatcatgattgtgtgcagtg

SEQ ID NO: 205502 - DNA, 22 bp, Mus musculus
tgttttgtgaccaattatatgg

SEQ ID NO: 205503 - DNA, 22 bp, Mus musculus
tgtgtgcatctctatgtgtgtg

SEQ ID NO: 205504 - DNA, 23 bp, Mus musculus
tagtatgagcttgcacataccat

SEQ ID NO: 205505 - DNA, 23 bp, Mus musculus
tgtctgtctgtctgcctgcctgc

SEQ ID NO: 205506 - DNA, 23 bp, Mus musculus
tgtgcagaagttagactatgaat

SEQ ID NO: 205507 - DNA, 20 bp, Mus musculus
taggaatacagtggcttggt

SEQ ID NO: 205508 - DNA, 18 bp, Mus musculus
tgagggtatctgatgctt

SEQ ID NO: 205509 - DNA, 23 bp, Mus musculus
tgttaaagcttgactactcttag

SEQ ID NO: 205510 - DNA, 19 bp, Mus musculus
tatgtgtgggtaaatgtgt

SEQ ID NO: 205511 - DNA, 23 bp, Mus musculus
tctgtgactgtctgttgagtctc

SEQ ID NO: 205512 - DNA, 23 bp, Mus musculus
ataatgatgatgatgatgatgat

SEQ ID NO: 205513 - DNA, 22 bp, Mus musculus
gaagagttgtcatattcttctc

SEQ ID NO: 205514 - DNA, 20 bp, Mus musculus
tgtgaagattgtcaatctgg

SEQ ID NO: 205515 - DNA, 23 bp, Mus musculus
caacttcagaaggtgcagtacac

SEQ ID NO: 205516 - DNA, 23 bp, Mus musculus
tgtgtgtgtgcctgtgtgtgctc

SEQ ID NO: 205517 - DNA, 18 bp, Mus musculus
tcagaagggagtgtgcag

SEQ ID NO: 205518 - DNA, 23 bp, Mus musculus
attagctcagactcagctgatcc

SEQ ID NO: 205519 - DNA, 21 bp, Mus musculus
atgtgtatacacatacacatg

SEQ ID NO: 205520 - DNA, 20 bp, Mus musculus
tgtatacacacatgtatata

SEQ ID NO: 205521 - DNA, 23 bp, Mus musculus
atgcttatctctggcagctatga

SEQ ID NO: 205522 - DNA, 22 bp, Mus musculus
tgttttgtgaccaattatatgg

SEQ ID NO: 205523 - DNA, 21 bp, Mus musculus
ctgtgtggtagtacttaagag

SEQ ID NO: 205524 - DNA, 22 bp, Mus musculus
tgttttgtgaccaattatatgg

SEQ ID NO: 205525 - DNA, 23 bp, Mus musculus
agttttgcctggtattgtagtct

SEQ ID NO: 205526 - DNA, 22 bp, Mus musculus
tgttttgtgaccaattatatgg

SEQ ID NO: 205527 - DNA, 20 bp, Mus musculus
tatgtggttatatatgtgtg

SEQ ID NO: 205528 - DNA, 22 bp, Mus musculus
tgttttgtgaccaattatatgg

SEQ ID NO: 205529 - DNA, 19 bp, Mus musculus
cagtggctctctgcccctc

SEQ ID NO: 205530 - DNA, 23 bp, Mus musculus
aaatctcaggaaatttattcttg

SEQ ID NO: 205531 - DNA, 23 bp, Mus musculus
tagtatgtctctagaatgctcat

SEQ ID NO: 205532 - DNA, 22 bp, Mus musculus
tgttttgtgaccaattatatgg

SEQ ID NO: 205533 - DNA, 23 bp, Mus musculus
tgtctgtctgtgagtctctgtac

SEQ ID NO: 205534 - DNA, 18 bp, Mus musculus
agataggttctctcatgg

SEQ ID NO: 205535 - DNA, 19 bp, Mus musculus
taatacatgcagcattaga

SEQ ID NO: 205536 - DNA, 23 bp, Mus musculus
agtatatatgtatatctgtatgg

SEQ ID NO: 205537 - DNA, 21 bp, Mus musculus
tggattgtaatgaactatgtc

SEQ ID NO: 205538 - DNA, 23 bp, Mus musculus
tttttggttgaatagaaatctgt

SEQ ID NO: 205539 - DNA, 23 bp, Mus musculus
ctctctgtgcctcacttgacagc

SEQ ID NO: 205540 - DNA, 23 bp, Mus musculus
gacagtgaagatggtcagctcca

SEQ ID NO: 205541 - DNA, 22 bp, Mus musculus
tgcactagctctgtctctctta

SEQ ID NO: 205542 - DNA, 18 bp, Mus musculus
tacagacatgtgtgttct

SEQ ID NO: 205543 - DNA, 22 bp, Mus musculus
tgttttgtgaccaattatatgg

SEQ ID NO: 205544 - DNA, 23 bp, Mus musculus
acactcactgtgtgattctgtgg

SEQ ID NO: 205545 - DNA, 21 bp, Mus musculus
tcaggttttctagctttcaca

SEQ ID NO: 205546 - DNA, 23 bp, Mus musculus
aacattcatttccttctgtgaaa

SEQ ID NO: 205547 - DNA, 21 bp, Mus musculus
gggtctctgtatctgtctcct

SEQ ID NO: 205548 - DNA, 23 bp, Mus musculus
tgtgtgtctgtttgtcattcatc

SEQ ID NO: 205549 - DNA, 21 bp, Mus musculus
tatgtatgtatgtatgtatgt

SEQ ID NO: 205550 - DNA, 19 bp, Mus musculus
tgtatatatgtgtgtgtgt

SEQ ID NO: 205551 - DNA, 18 bp, Mus musculus
atatatgtatgtatatgt

SEQ ID NO: 205552 - DNA, 22 bp, Mus musculus
tgttttgtgaccaattatatgg

SEQ ID NO: 205553 - DNA, 18 bp, Mus musculus
tggctctctggcgctctg

SEQ ID NO: 205554 - DNA, 23 bp, Mus musculus
tactgtgtgagtaacatctgctt

SEQ ID NO: 205555 - DNA, 23 bp, Mus musculus
tccctgtgaacacagtaagtgag

SEQ ID NO: 205556 - DNA, 22 bp, Mus musculus
atcacaagagattatcttgatg

SEQ ID NO: 205557 - DNA, 21 bp, Mus musculus
tgtgaagtgcttcatttctcc

SEQ ID NO: 205558 - DNA, 23 bp, Mus musculus
tacacagttcaagctaaaaccta

SEQ ID NO: 205559 - DNA, 19 bp, Mus musculus
tgagagtgacaaacagccg

SEQ ID NO: 205560 - DNA, 21 bp, Mus musculus
tgtctctatttgtctcattta

SEQ ID NO: 205561 - DNA, 20 bp, Mus musculus
tctatcagactctataggga

SEQ ID NO: 205562 - DNA, 20 bp, Mus musculus
aatgtcatttgttttcttgg

SEQ ID NO: 205563 - DNA, 23 bp, Mus musculus
cagatgacagactccagtgttta

SEQ ID NO: 205564 - DNA, 22 bp, Mus musculus
atatatgcatataatggtgaat

SEQ ID NO: 205565 - DNA, 19 bp, Mus musculus
tttattcctctcacacctg

SEQ ID NO: 205566 - DNA, 22 bp, Mus musculus
tgtgtctctgtttagtttctgt

SEQ ID NO: 205567 - DNA, 22 bp, Mus musculus
atctgtccagtgatgagagtgg

SEQ ID NO: 205568 - DNA, 23 bp, Mus musculus
tgttagaaagatatagtacagtt

SEQ ID NO: 205569 - DNA, 23 bp, Mus musculus
aattctgattttgttattctcta

SEQ ID NO: 205570 - DNA, 22 bp, Mus musculus
tgttttgtgaccaattatatgg

SEQ ID NO: 205571 - DNA, 23 bp, Mus musculus
agagcctgtctctgtctctctgg

SEQ ID NO: 205572 - DNA, 21 bp, Mus musculus
atggttggctgtgagcatgcg

SEQ ID NO: 205573 - DNA, 21 bp, Mus musculus
atttgtcacactcacagagcc

SEQ ID NO: 205574 - DNA, 23 bp, Mus musculus
aatatttttgtatctgttgaggc

SEQ ID NO: 205575 - DNA, 21 bp, Mus musculus
tctcaggcagtgtctcagctg

SEQ ID NO: 205576 - DNA, 23 bp, Mus musculus
agacagtacagagtatggagatg

SEQ ID NO: 205577 - DNA, 19 bp, Mus musculus
cactgccttctaagcaggt

SEQ ID NO: 205578 - DNA, 23 bp, Mus musculus
ttctggtccagtctatttggagt

SEQ ID NO: 205579 - DNA, 22 bp, Mus musculus
tgttttgtgaccaattatatgg

SEQ ID NO: 205580 - DNA, 23 bp, Mus musculus
atgtgtctctgtgtgtaactaga

SEQ ID NO: 205581 - DNA, 23 bp, Mus musculus
tagcattagagagacaagcaatg

SEQ ID NO: 205582 - DNA, 23 bp, Mus musculus
agaatacatccttcagacttcat

SEQ ID NO: 205583 - DNA, 18 bp, Mus musculus
acatatgtagcagaggac

SEQ ID NO: 205584 - DNA, 23 bp, Mus musculus
atctgacattagtgagagaggag

SEQ ID NO: 205585 - DNA, 23 bp, Mus musculus
agagcgctgactgctcttccaga

SEQ ID NO: 205586 - DNA, 22 bp, Mus musculus
tactcagtccaatggttggagg

SEQ ID NO: 205587 - DNA, 23 bp, Mus musculus
caaacatgcagctcagtctctgt

SEQ ID NO: 205588 - DNA, 20 bp, Mus musculus
tctgtgtctctgtgtgtaca

SEQ ID NO: 205589 - DNA, 19 bp, Mus musculus
tgtatgcatgcatgtgtgt

SEQ ID NO: 205590 - DNA, 22 bp, Mus musculus
tgttttgtgaccaattatatgg

SEQ ID NO: 205591 - DNA, 23 bp, Mus musculus
gttttcactgtagagattttgtg

SEQ ID NO: 205592 - DNA, 23 bp, Mus musculus
ctactacttacagagctggctgt

SEQ ID NO: 205593 - DNA, 23 bp, Mus musculus
tagtcttgtgtgtttgtaattga

SEQ ID NO: 205594 - DNA, 23 bp, Mus musculus
tgactctgagtctctcttaatgc

SEQ ID NO: 205595 - DNA, 20 bp, Mus musculus
caatgctggtgctgctgaag

SEQ ID NO: 205596 - DNA, 23 bp, Mus musculus
caaatctagagtagtatgaagaa

SEQ ID NO: 205597 - DNA, 23 bp, Mus musculus
tatatgtgtatggtatacgtggg

SEQ ID NO: 205598 - DNA, 22 bp, Mus musculus
taaaagcatatgaaaatgtgtg

SEQ ID NO: 205599 - DNA, 23 bp, Mus musculus
tctttctctgatagatgtttgag

SEQ ID NO: 205600 - DNA, 23 bp, Mus musculus
tgtgcgtgcgtgcgtgcgtgcgt

SEQ ID NO: 205601 - DNA, 23 bp, Mus musculus
tggagatctctctgtctgtgtct

SEQ ID NO: 205602 - DNA, 22 bp, Mus musculus
tatgtgtttgcatgatgtgtgt

SEQ ID NO: 205603 - DNA, 23 bp, Mus musculus
tgagtctgattactatatgtata

SEQ ID NO: 205604 - DNA, 23 bp, Mus musculus
tttgtatatcaatatgtatatgt

SEQ ID NO: 205605 - DNA, 23 bp, Mus musculus
aagggtcttcatgggaaaatcag

SEQ ID NO: 205606 - DNA, 23 bp, Mus musculus
agacagacagatgtgaaagtggt

SEQ ID NO: 205607 - DNA, 23 bp, Mus musculus
tgagtcagagagtctctgtgaga

SEQ ID NO: 205608 - DNA, 23 bp, Mus musculus
ttagttactttttgttgctgtga

SEQ ID NO: 205609 - DNA, 22 bp, Mus musculus
cagaggaatgttgtcagggtgg

SEQ ID NO: 205610 - DNA, 23 bp, Mus musculus
tcagtctttccgtgtgtcagtgg

SEQ ID NO: 205611 - DNA, 21 bp, Mus musculus
ctcacttctgactcagtcagc

SEQ ID NO: 205612 - DNA, 22 bp, Mus musculus
agtctctgggtctcaaactgct

SEQ ID NO: 205613 - DNA, 23 bp, Mus musculus
actatttgcatatgatatgatag

SEQ ID NO: 205614 - DNA, 21 bp, Mus musculus
tatcatatgcaaatagtgata

SEQ ID NO: 205615 - DNA, 18 bp, Mus musculus
tgtgttgtaggtacctga

SEQ ID NO: 205616 - DNA, 23 bp, Mus musculus
cagggtcactgtgtctctcacat

SEQ ID NO: 205617 - DNA, 23 bp, Mus musculus
tgtctgtctgtctctgaattctc

SEQ ID NO: 205618 - DNA, 23 bp, Mus musculus
gccgctcactgtctgtgtgactc

SEQ ID NO: 205619 - DNA, 21 bp, Mus musculus
cagttctaattgatgactgat

SEQ ID NO: 205620 - DNA, 23 bp, Mus musculus
cagatctcagttacttaattgtg

SEQ ID NO: 205621 - DNA, 23 bp, Mus musculus
ctcaatcaggaactgcttgtgga

SEQ ID NO: 205622 - DNA, 19 bp, Mus musculus
tatggatatatatatgtat

SEQ ID NO: 205623 - DNA, 23 bp, Mus musculus
gtcagtctctctctctctcatct

SEQ ID NO: 205624 - DNA, 23 bp, Mus musculus
actgtgtctctgttcagtttctg

SEQ ID NO: 205625 - DNA, 23 bp, Mus musculus
tgtgtgtgtgtgtgtgtaccatg

SEQ ID NO: 205626 - DNA, 23 bp, Mus musculus
taagagcactgactgctctttca

SEQ ID NO: 205627 - DNA, 20 bp, Mus musculus
aagagcactgactgctcttc

SEQ ID NO: 205628 - DNA, 23 bp, Mus musculus
tcaagtgcaagaatgtatatttt

SEQ ID NO: 205629 - DNA, 22 bp, Mus musculus
tcaggcacactcactatatctg

SEQ ID NO: 205630 - DNA, 18 bp, Mus musculus
tgtactggctggttttgt

SEQ ID NO: 205631 - DNA, 22 bp, Mus musculus
tctcacacacacaaatatgtta

SEQ ID NO: 205632 - DNA, 23 bp, Mus musculus
atctgtctgtctgtctgtctatc

SEQ ID NO: 205633 - DNA, 18 bp, Mus musculus
tgtgtagatggacactgg

SEQ ID NO: 205634 - DNA, 23 bp, Mus musculus
tctgtctgtctgtctctcccaac

SEQ ID NO: 205635 - DNA, 23 bp, Mus musculus
acagctgtgtgtgtctgtgtgtg

SEQ ID NO: 205636 - DNA, 23 bp, Mus musculus
tgtcagtgtgtatgtatgcgcat

SEQ ID NO: 205637 - DNA, 23 bp, Mus musculus
tgtgtgtcagtgtgcatgtgcat

SEQ ID NO: 205638 - DNA, 23 bp, Mus musculus
agtcagtctgcataactattgag

SEQ ID NO: 205639 - DNA, 23 bp, Mus musculus
ctcagtggttcttgtttatagac

SEQ ID NO: 205640 - DNA, 23 bp, Mus musculus
tgactgctcttccagaggtcctg

SEQ ID NO: 205641 - DNA, 19 bp, Mus musculus
acgaccatctgtaatggca

SEQ ID NO: 205642 - DNA, 22 bp, Mus musculus
tctcagactcggaatgaattgt

SEQ ID NO: 205643 - DNA, 19 bp, Mus musculus
acagaagagaatcagcagt

SEQ ID NO: 205644 - DNA, 19 bp, Mus musculus
aaactgctctcactttgtg

SEQ ID NO: 205645 - DNA, 21 bp, Mus musculus
taaacaacagaaagcaggacc

SEQ ID NO: 205646 - DNA, 23 bp, Mus musculus
atcagactgtagatggagtcctc

SEQ ID NO: 205647 - DNA, 23 bp, Mus musculus
tgtgtatctccatctgcatgtgg

SEQ ID NO: 205648 - DNA, 23 bp, Mus musculus
taacacatactggtattttcctt

SEQ ID NO: 205649 - DNA, 18 bp, Mus musculus
tcaggggctggagagatg

SEQ ID NO: 205650 - DNA, 21 bp, Mus musculus
cacacaagagagtctggaaag

SEQ ID NO: 205651 - DNA, 21 bp, Mus musculus
ataaacatgttttctgaaaga

SEQ ID NO: 205652 - DNA, 22 bp, Mus musculus
tgtacagaaagtatagagtctg

SEQ ID NO: 205653 - DNA, 23 bp, Mus musculus
tgagtgggacacctgtgggagcg

SEQ ID NO: 205654 - DNA, 23 bp, Mus musculus
ctctgtctgtctgtctgtctcag

SEQ ID NO: 205655 - DNA, 23 bp, Mus musculus
tgtgtgtgtctatgtgtctgtgt

SEQ ID NO: 205656 - DNA, 21 bp, Mus musculus
tatgtatgtatgtatatgtgt

SEQ ID NO: 205657 - DNA, 23 bp, Mus musculus
tgtgtgtttgtgtatgtgcacgt

SEQ ID NO: 205658 - DNA, 22 bp, Mus musculus
tgttttgtgaccaattatatgg

SEQ ID NO: 205659 - DNA, 23 bp, Mus musculus
tcacacaagagacagagtgcaag

SEQ ID NO: 205660 - DNA, 21 bp, Mus musculus
accttttgcataacttttcat

SEQ ID NO: 205661 - DNA, 23 bp, Mus musculus
atgggattttgtagtatgcagat

SEQ ID NO: 205662 - DNA, 21 bp, Mus musculus
gcacttgagtgtctctttcca

SEQ ID NO: 205663 - DNA, 23 bp, Mus musculus
agctgatcctttgagttggggaa

SEQ ID NO: 205664 - DNA, 23 bp, Mus musculus
tctgactggctgtgtgactctga

SEQ ID NO: 205665 - DNA, 21 bp, Mus musculus
atgtgtgtatatatgtatatg

SEQ ID NO: 205666 - DNA, 23 bp, Mus musculus
tagtccatggtgatctgataggg

SEQ ID NO: 205667 - DNA, 22 bp, Mus musculus
tgttttgtgaccaattatatgg

SEQ ID NO: 205668 - DNA, 23 bp, Mus musculus
tcttggtcactgtaatgtgtgag

SEQ ID NO: 205669 - DNA, 22 bp, Mus musculus
aaacacacagcgcaaacgcttt

SEQ ID NO: 205670 - DNA, 23 bp, Mus musculus
tgagtctcagtgtgtgtgatggg

SEQ ID NO: 205671 - DNA, 20 bp, Mus musculus
aatcatgctgattctggttc

SEQ ID NO: 205672 - DNA, 21 bp, Mus musculus
ttatagatagatataaataga

SEQ ID NO: 205673 - DNA, 23 bp, Mus musculus
tagtccatggtgatctggtagga

SEQ ID NO: 205674 - DNA, 18 bp, Mus musculus
tgtctgtccatatgcatg

SEQ ID NO: 205675 - DNA, 19 bp, Mus musculus
gtatgtactatacatacgt

SEQ ID NO: 205676 - DNA, 23 bp, Mus musculus
tcacagtctctgtgtgatttatc

SEQ ID NO: 205677 - DNA, 22 bp, Mus musculus
tgttttgtgaccaattatatgg

SEQ ID NO: 205678 - DNA, 19 bp, Mus musculus
agagtttggctgggtatag

SEQ ID NO: 205679 - DNA, 23 bp, Mus musculus
tctcagtgtctgtataacatctg

SEQ ID NO: 205680 - DNA, 23 bp, Mus musculus
tcatagtattagatttgggcatg

SEQ ID NO: 205681 - DNA, 19 bp, Mus musculus
acacagaaaggctctcttg

SEQ ID NO: 205682 - DNA, 18 bp, Mus musculus
gtgtggatgcctctctgt

SEQ ID NO: 205683 - DNA, 21 bp, Mus musculus
atgtttgcctgtatatgtatt

SEQ ID NO: 205684 - DNA, 21 bp, Mus musculus
gagaacatactttgctgtcag

SEQ ID NO: 205685 - DNA, 23 bp, Mus musculus
tggcactgtccctcactgtctac

SEQ ID NO: 205686 - DNA, 22 bp, Mus musculus
ttaatctcagctggcaactgtg

SEQ ID NO: 205687 - DNA, 23 bp, Mus musculus
tactgcatcaggaactgactgga

SEQ ID NO: 205688 - DNA, 21 bp, Mus musculus
atcagttcctaatgcattgcc

SEQ ID NO: 205689 - DNA, 23 bp, Mus musculus
tctaaagttctctttctttgtta

SEQ ID NO: 205690 - DNA, 23 bp, Mus musculus
tagaatgaattgggtagaatacc

SEQ ID NO: 205691 - DNA, 20 bp, Mus musculus
tcttgtatatccctatatgt

SEQ ID NO: 205692 - DNA, 22 bp, Mus musculus
tgttttgtgaccaattatatgg

SEQ ID NO: 205693 - DNA, 23 bp, Mus musculus
ttcagtctcgttgtctttctttt

SEQ ID NO: 205694 - DNA, 22 bp, Mus musculus
ttcttgtagtaagtagtaatgt

SEQ ID NO: 205695 - DNA, 18 bp, Mus musculus
cagtatggtttcctggat

SEQ ID NO: 205696 - DNA, 22 bp, Mus musculus
tgtgaatttgtgttaatgatgt

SEQ ID NO: 205697 - DNA, 23 bp, Mus musculus
tcagccactctgtcagtatctat

SEQ ID NO: 205698 - DNA, 21 bp, Mus musculus
ttgctgtcaaatgtggtactg

SEQ ID NO: 205699 - DNA, 23 bp, Mus musculus
ctgcctcacagggtgctaatttc

SEQ ID NO: 205700 - DNA, 23 bp, Mus musculus
ttgatgagttcactggagcagag

SEQ ID NO: 205701 - DNA, 22 bp, Mus musculus
tgaagttctctttctttgttgt

SEQ ID NO: 205702 - DNA, 23 bp, Mus musculus
tagtgcatggtgatctgatagga

SEQ ID NO: 205703 - DNA, 21 bp, Mus musculus
tgagacctgttttgtgaccta

SEQ ID NO: 205704 - DNA, 22 bp, Mus musculus
tgttttgtgaccaattatatgg

SEQ ID NO: 205705 - DNA, 23 bp, Mus musculus
tctcactctggattacctcactc

SEQ ID NO: 205706 - DNA, 23 bp, Mus musculus
agactctgcatgtgcttgtggaa

SEQ ID NO: 205707 - DNA, 22 bp, Mus musculus
acctcagcagcagctctccagt

SEQ ID NO: 205708 - DNA, 23 bp, Mus musculus
tacaaatctgattttgaagatga

SEQ ID NO: 205709 - DNA, 22 bp, Mus musculus
ccactggggtttgtctcagtct

SEQ ID NO: 205710 - DNA, 19 bp, Mus musculus
atgtgtgtatgtaggtgta

SEQ ID NO: 205711 - DNA, 23 bp, Mus musculus
taactgtatgtaggtggtataga

SEQ ID NO: 205712 - DNA, 22 bp, Mus musculus
tgttttgtgaccaattatatgg

SEQ ID NO: 205713 - DNA, 22 bp, Mus musculus
tgttttgtgaccaattatatgg

SEQ ID NO: 205714 - DNA, 19 bp, Mus musculus
tactgaggtctgtttggtg

SEQ ID NO: 205715 - DNA, 23 bp, Mus musculus
tgcatgtatgtatgtatgtatgc

SEQ ID NO: 205716 - DNA, 22 bp, Mus musculus
tatacatatgaatacatgcaca

SEQ ID NO: 205717 - DNA, 23 bp, Mus musculus
tctgagtctgactctgtcttctg

SEQ ID NO: 205718 - DNA, 23 bp, Mus musculus
tgacactagatagacagcaggag

SEQ ID NO: 205719 - DNA, 23 bp, Mus musculus
tgtctctgtctctgtctcagttc

SEQ ID NO: 205720 - DNA, 21 bp, Mus musculus
tcactggctgtctcactccct

SEQ ID NO: 205721 - DNA, 22 bp, Mus musculus
ctctggctctgtgggcctcaga

SEQ ID NO: 205722 - DNA, 20 bp, Mus musculus
tatcacagagcagggtgggc

SEQ ID NO: 205723 - DNA, 23 bp, Mus musculus
tctgtctgtgtatgttttgcaca

SEQ ID NO: 205724 - DNA, 18 bp, Mus musculus
gagatcatttggaaagga

SEQ ID NO: 205725 - DNA, 23 bp, Mus musculus
gatggctctgtggttaagagaac

SEQ ID NO: 205726 - DNA, 23 bp, Mus musculus
tgtctgtgactccaattccagag

SEQ ID NO: 205727 - DNA, 22 bp, Mus musculus
tggaaacttgagttctttggag

SEQ ID NO: 205728 - DNA, 23 bp, Mus musculus
tctgccaaacctgcactttctgg

SEQ ID NO: 205729 - DNA, 23 bp, Mus musculus
gctctcactgacactgtcttctg

SEQ ID NO: 205730 - DNA, 22 bp, Mus musculus
tgcaggaaagtaggggggaaag

SEQ ID NO: 205731 - DNA, 21 bp, Mus musculus
ttgtgggtctgtctctgtcag

SEQ ID NO: 205732 - DNA, 23 bp, Mus musculus
aaggttttgtcattgatatcctt

SEQ ID NO: 205733 - DNA, 22 bp, Mus musculus
aatatctcttgagtgggcctgt

SEQ ID NO: 205734 - DNA, 23 bp, Mus musculus
agaacactgactgctcttccaga

SEQ ID NO: 205735 - DNA, 23 bp, Mus musculus
gtgtatgtctgtgtgtgtgcctg

SEQ ID NO: 205736 - DNA, 23 bp, Mus musculus
tctgtctccattctcctctgagc

SEQ ID NO: 205737 - DNA, 19 bp, Mus musculus
ctgagttcaattccagcac

SEQ ID NO: 205738 - DNA, 20 bp, Mus musculus
cattggtcttctctggcttt

SEQ ID NO: 205739 - DNA, 23 bp, Mus musculus
tcaatccttttctatctgtaagt

SEQ ID NO: 205740 - DNA, 21 bp, Mus musculus
ctcactcgctcactcgcttgt

SEQ ID NO: 205741 - DNA, 23 bp, Mus musculus
agagatcagagtcaggtcttcct

SEQ ID NO: 205742 - DNA, 22 bp, Mus musculus
ggcctctctcttgctctcagtg

SEQ ID NO: 205743 - DNA, 20 bp, Mus musculus
atttatcacctggtattctt

SEQ ID NO: 205744 - DNA, 23 bp, Mus musculus
gtatatatgcatgtatgtatgtg

SEQ ID NO: 205745 - DNA, 23 bp, Mus musculus
cattgagagaacagagtgagggc

SEQ ID NO: 205746 - DNA, 20 bp, Mus musculus
tttgcaattatttccccttt

SEQ ID NO: 205747 - DNA, 23 bp, Mus musculus
tgtctgggtctctgcctgcctct

SEQ ID NO: 205748 - DNA, 23 bp, Mus musculus
ctggcactgcatctgcatctgca

SEQ ID NO: 205749 - DNA, 23 bp, Mus musculus
aggcactgagtctctgagagatt

SEQ ID NO: 205750 - DNA, 23 bp, Mus musculus
tgagtgtgtcagtgtttctctct

SEQ ID NO: 205751 - DNA, 21 bp, Mus musculus
atttttctatttgtttgagca

SEQ ID NO: 205752 - DNA, 23 bp, Mus musculus
tcttcatctgcctgtctgtctgt

SEQ ID NO: 205753 - DNA, 18 bp, Mus musculus
attgcaatttactctgtc

SEQ ID NO: 205754 - DNA, 22 bp, Mus musculus
tctgtgactccttccctctttc

SEQ ID NO: 205755 - DNA, 18 bp, Mus musculus
tgtgcacatgcatgtgtg

SEQ ID NO: 205756 - DNA, 23 bp, Mus musculus
atggtgacaggatgagaaatggg

SEQ ID NO: 205757 - DNA, 20 bp, Mus musculus
agggtagattagtttaggct

SEQ ID NO: 205758 - DNA, 21 bp, Mus musculus
ttgagctgactcagtaacctg

SEQ ID NO: 205759 - DNA, 22 bp, Mus musculus
ttgtcacacgaaagcatctcat

SEQ ID NO: 205760 - DNA, 20 bp, Mus musculus
aacagattgttgtctgtaag

SEQ ID NO: 205761 - DNA, 22 bp, Mus musculus
ttagctagttagttaatttttc

SEQ ID NO: 205762 - DNA, 23 bp, Mus musculus
acttcactgagtcatctcttcag

SEQ ID NO: 205763 - DNA, 22 bp, Mus musculus
attcttctagaggctgggataa

SEQ ID NO: 205764 - DNA, 23 bp, Mus musculus
ggctcagactctcactggctggc

SEQ ID NO: 205765 - DNA, 23 bp, Mus musculus
tctctcagagtcaaagctcttga

SEQ ID NO: 205766 - DNA, 20 bp, Mus musculus
agagagaagagacagagcag

SEQ ID NO: 205767 - DNA, 22 bp, Mus musculus
tttgtgcttgatctaaccatgt

SEQ ID NO: 205768 - DNA, 20 bp, Mus musculus
cggaacatggttctgtcaag

SEQ ID NO: 205769 - DNA, 19 bp, Mus musculus
agtttgaatctcagcaacc

SEQ ID NO: 205770 - DNA, 23 bp, Mus musculus
agcagcattgtacagggctatga

SEQ ID NO: 205771 - DNA, 20 bp, Mus musculus
tctgcctgcctctgtctctg

SEQ ID NO: 205772 - DNA, 20 bp, Mus musculus
gtccttctagagtagggtag

SEQ ID NO: 205773 - DNA, 20 bp, Mus musculus
tactcacctgaattctgtga

SEQ ID NO: 205774 - DNA, 18 bp, Mus musculus
gtgtggctgcttctcagg

SEQ ID NO: 205775 - DNA, 19 bp, Mus musculus
tacaaacatatgtgtatct

SEQ ID NO: 205776 - DNA, 22 bp, Mus musculus
aacctggaattcgtgaagatgg

SEQ ID NO: 205777 - DNA, 23 bp, Mus musculus
ctgtctgtctctcattctccagt

SEQ ID NO: 205778 - DNA, 19 bp, Mus musculus
tgcacgcacatgtgcatgt

SEQ ID NO: 205779 - DNA, 23 bp, Mus musculus
atttactgtgtggttatgttagt

SEQ ID NO: 205780 - DNA, 21 bp, Mus musculus
tttctctctttgctatacctg

SEQ ID NO: 205781 - DNA, 19 bp, Mus musculus
ctgtgcggtgtgtacctgt

SEQ ID NO: 205782 - DNA, 22 bp, Mus musculus
tctatgtacatgtgcttgtaca

SEQ ID NO: 205783 - DNA, 22 bp, Mus musculus
atgtatgtgtgcatgtgtatgc

SEQ ID NO: 205784 - DNA, 23 bp, Mus musculus
atatgtatatgtatatgatgtgt

SEQ ID NO: 205785 - DNA, 21 bp, Mus musculus
aagagtacatagcagaaagca

SEQ ID NO: 205786 - DNA, 21 bp, Mus musculus
aagagaaatgattatgttcta

SEQ ID NO: 205787 - DNA, 20 bp, Mus musculus
tgtctgtgcattatttatct

SEQ ID NO: 205788 - DNA, 23 bp, Mus musculus
tgtgtgtgtgtgtgcgtgcatgt

SEQ ID NO: 205789 - DNA, 23 bp, Mus musculus
atcagtgagtgcatatcaagtga

SEQ ID NO: 205790 - DNA, 23 bp, Mus musculus
tgtctcactgtgacaatctgcag

SEQ ID NO: 205791 - DNA, 23 bp, Mus musculus
gatcagtcacacttggtgacaga

SEQ ID NO: 205792 - DNA, 23 bp, Mus musculus
agaggctctcagtgactctctgc

SEQ ID NO: 205793 - DNA, 23 bp, Mus musculus
taagtgttgtgtcagtgaccaag

SEQ ID NO: 205794 - DNA, 23 bp, Mus musculus
tgtatgtatgtatgtgtgtgtgt

SEQ ID NO: 205795 - DNA, 23 bp, Mus musculus
tcatatacatatatattctcata

SEQ ID NO: 205796 - DNA, 19 bp, Mus musculus
tgctataaaattcagttag

SEQ ID NO: 205797 - DNA, 22 bp, Mus musculus
tgttttgtgaccaattatatgg

SEQ ID NO: 205798 - DNA, 21 bp, Mus musculus
taaggaaaagtaattgttgct

SEQ ID NO: 205799 - DNA, 23 bp, Mus musculus
tctgtctgtctgtctgtctgtct

SEQ ID NO: 205800 - DNA, 23 bp, Mus musculus
agtccaaatcaatagttttgctt

SEQ ID NO: 205801 - DNA, 23 bp, Mus musculus
tatggttgtatagtattgatttg

SEQ ID NO: 205802 - DNA, 21 bp, Mus musculus
tttgacatattgtatatgtgt

SEQ ID NO: 205803 - DNA, 23 bp, Mus musculus
gactgagttaagtcattatgatg

SEQ ID NO: 205804 - DNA, 23 bp, Mus musculus
atctgtgtgtatatatatatgtg

SEQ ID NO: 205805 - DNA, 23 bp, Mus musculus
tcaatttgctctgtgtgatctga

SEQ ID NO: 205806 - DNA, 23 bp, Mus musculus
taggagacagaacaaagtctgca

SEQ ID NO: 205807 - DNA, 23 bp, Mus musculus
gtctctctgtctctgaaagacct

SEQ ID NO: 205808 - DNA, 22 bp, Mus musculus
gctaacagaatgtagacagagg

SEQ ID NO: 205809 - DNA, 23 bp, Mus musculus
tctcagtgtctgtataacatctg

SEQ ID NO: 205810 - DNA, 22 bp, Mus musculus
tgttttgtgaccaattatatgg

SEQ ID NO: 205811 - DNA, 20 bp, Mus musculus
tgcaaactggatctgttctc

SEQ ID NO: 205812 - DNA, 22 bp, Mus musculus
tgttttgtgaccaattatatgg

SEQ ID NO: 205813 - DNA, 22 bp, Mus musculus
tgttttgtgaccaattatatgg

SEQ ID NO: 205814 - DNA, 19 bp, Mus musculus
tcagttggaaaccatagca

SEQ ID NO: 205815 - DNA, 22 bp, Mus musculus
tgtaaagcacattttattattg

SEQ ID NO: 205816 - DNA, 19 bp, Mus musculus
tgtgtgtgtgtgttcgtgg

SEQ ID NO: 205817 - DNA, 23 bp, Mus musculus
tgtgtcagtgctcacagaggaca

SEQ ID NO: 205818 - DNA, 23 bp, Mus musculus
ttgtttggatatgaaatgaattt

SEQ ID NO: 205819 - DNA, 23 bp, Mus musculus
taagagagggaagaagctcgctg

SEQ ID NO: 205820 - DNA, 23 bp, Mus musculus
actgagtcttttttttttgaatt

SEQ ID NO: 205821 - DNA, 23 bp, Mus musculus
tatatctatctatatctatatct

SEQ ID NO: 205822 - DNA, 23 bp, Mus musculus
gtatgtatatatgtatgtataga

SEQ ID NO: 205823 - DNA, 23 bp, Mus musculus
tatgtatatgtatatgtatatgc

SEQ ID NO: 205824 - DNA, 23 bp, Mus musculus
tgtatgtgcatgtgtatgtgtat

SEQ ID NO: 205825 - DNA, 22 bp, Mus musculus
tgttttgtgaccaattatatgg

SEQ ID NO: 205826 - DNA, 23 bp, Mus musculus
aggacaacatgctactgtctgtc

SEQ ID NO: 205827 - DNA, 21 bp, Mus musculus
tctcaccttctgtgtctcaga

SEQ ID NO: 205828 - DNA, 20 bp, Mus musculus
ggaagaggaagccagttcat

SEQ ID NO: 205829 - DNA, 22 bp, Mus musculus
atgagatttttttgatatgaga

SEQ ID NO: 205830 - DNA, 23 bp, Mus musculus
atgtgtgcatatgtatatgtgtg

SEQ ID NO: 205831 - DNA, 23 bp, Mus musculus
atatatctatgcatatgtatatt

SEQ ID NO: 205832 - DNA, 23 bp, Mus musculus
tcttactgtctgtgtattcagtc

SEQ ID NO: 205833 - DNA, 23 bp, Mus musculus
gaatacagtctgtgagatgttgc

SEQ ID NO: 205834 - DNA, 23 bp, Mus musculus
tagtccatggtgatctgatagga

SEQ ID NO: 205835 - DNA, 22 bp, Mus musculus
tgttttgtgaccaattatatgg

SEQ ID NO: 205836 - DNA, 23 bp, Mus musculus
tcttcatgtgggactcatagtgg

SEQ ID NO: 205837 - DNA, 23 bp, Mus musculus
tgagctgcctcatctagcctctg

SEQ ID NO: 205838 - DNA, 18 bp, Mus musculus
agtcactcttagtctctg

SEQ ID NO: 205839 - DNA, 22 bp, Mus musculus
attggtgtggaggaactttgag

SEQ ID NO: 205840 - DNA, 23 bp, Mus musculus
ttctttgagaatttcatatgcat

SEQ ID NO: 205841 - DNA, 19 bp, Mus musculus
gtctggctctctcacaggc

SEQ ID NO: 205842 - DNA, 21 bp, Mus musculus
actctgagtctcgaaagcaac

SEQ ID NO: 205843 - DNA, 23 bp, Mus musculus
tctgtctgtctgtctgcctgtcc

SEQ ID NO: 205844 - DNA, 23 bp, Mus musculus
tagaagtgggggaagtctctctg

SEQ ID NO: 205845 - DNA, 23 bp, Mus musculus
gtctggctctaagagtctctgtg

SEQ ID NO: 205846 - DNA, 21 bp, Mus musculus
aggtgtatatgtatatgcttt

SEQ ID NO: 205847 - DNA, 21 bp, Mus musculus
tggtatacatttgtaatccca

SEQ ID NO: 205848 - DNA, 23 bp, Mus musculus
cagggtctgtgtgacagtctctc

SEQ ID NO: 205849 - DNA, 21 bp, Mus musculus
acaccaggcccagagtctcac

SEQ ID NO: 205850 - DNA, 19 bp, Mus musculus
tagatggagagaaaggtga

SEQ ID NO: 205851 - DNA, 23 bp, Mus musculus
ttctgtctgtctgtctgtctgtc

SEQ ID NO: 205852 - DNA, 22 bp, Mus musculus
aaagatcaatatgtataagact

SEQ ID NO: 205853 - DNA, 23 bp, Mus musculus
ctttctctctctgtgtgtgtctg

SEQ ID NO: 205854 - DNA, 22 bp, Mus musculus
tctgtctgtgtctgtcttgtgc

SEQ ID NO: 205855 - DNA, 22 bp, Mus musculus
acacatgtacgtacacacacac

SEQ ID NO: 205856 - DNA, 23 bp, Mus musculus
tgtctttcatcattgtctttgag

SEQ ID NO: 205857 - DNA, 23 bp, Mus musculus
ttgagagtccaactagatgcttc

SEQ ID NO: 205858 - DNA, 23 bp, Mus musculus
gtatgcatgtatgtatatgtgtg

SEQ ID NO: 205859 - DNA, 23 bp, Mus musculus
gtatgtgtgtgcattgtgtgtgt

SEQ ID NO: 205860 - DNA, 23 bp, Mus musculus
gtgtgtatataagtgtgtgtatg

SEQ ID NO: 205861 - DNA, 20 bp, Mus musculus
acacatcacacatacacata

SEQ ID NO: 205862 - DNA, 22 bp, Mus musculus
tcacacagattcacattatggc

SEQ ID NO: 205863 - DNA, 23 bp, Mus musculus
tgacagatgtgagtgaggagcac

SEQ ID NO: 205864 - DNA, 23 bp, Mus musculus
tactcacaacacactctttctca

SEQ ID NO: 205865 - DNA, 22 bp, Mus musculus
tgttttgtgaccaattatatgg

SEQ ID NO: 205866 - DNA, 23 bp, Mus musculus
tctctgtctctctatctctctct

SEQ ID NO: 205867 - DNA, 23 bp, Mus musculus
gccagatcaagatgagtagattt

SEQ ID NO: 205868 - DNA, 23 bp, Mus musculus
acagtctctctgtgtgtggccct

SEQ ID NO: 205869 - DNA, 22 bp, Mus musculus
tgttttgtgaccaattatatgg

SEQ ID NO: 205870 - DNA, 23 bp, Mus musculus
tgtgtctgtctgtctgtcggtcc

SEQ ID NO: 205871 - DNA, 23 bp, Mus musculus
ttctctgttcattggattctctg

SEQ ID NO: 205872 - DNA, 23 bp, Mus musculus
agacaagggtttctgagacaatg

SEQ ID NO: 205873 - DNA, 23 bp, Mus musculus
tctgtctctgtctctgtctctgt

SEQ ID NO: 205874 - DNA, 19 bp, Mus musculus
agacatctaggataggtta

SEQ ID NO: 205875 - DNA, 22 bp, Mus musculus
tgttttgtgaccaattatatgg

SEQ ID NO: 205876 - DNA, 22 bp, Mus musculus
tgttttgtgaccaattatatgg

SEQ ID NO: 205877 - DNA, 23 bp, Mus musculus
tctctccctctgtgtgctcagtc

SEQ ID NO: 205878 - DNA, 22 bp, Mus musculus
tgttttgtgaccaattatatgg

SEQ ID NO: 205879 - DNA, 21 bp, Mus musculus
tccatggtggtctgataggat

SEQ ID NO: 205880 - DNA, 22 bp, Mus musculus
tgttttgtgaccaattatatgg

SEQ ID NO: 205881 - DNA, 23 bp, Mus musculus
caagtgtctctcactgtgagggc

SEQ ID NO: 205882 - DNA, 23 bp, Mus musculus
acaccgagagagtcactggaggt

SEQ ID NO: 205883 - DNA, 23 bp, Mus musculus
actccgagaaacatactcctgtg

SEQ ID NO: 205884 - DNA, 23 bp, Mus musculus
taggctttctcaggaaagcttat

SEQ ID NO: 205885 - DNA, 20 bp, Mus musculus
tcacagaactgagtgacttg

SEQ ID NO: 205886 - DNA, 22 bp, Mus musculus
agaggtagaaggatacattctt

SEQ ID NO: 205887 - DNA, 20 bp, Mus musculus
ttattcaaaagtaggtttgg

SEQ ID NO: 205888 - DNA, 22 bp, Mus musculus
actctcacagaaagatgattcc

SEQ ID NO: 205889 - DNA, 20 bp, Mus musculus
ttatgtttagtaggactact

SEQ ID NO: 205890 - DNA, 20 bp, Mus musculus
taggcagagtaagacaggac

SEQ ID NO: 205891 - DNA, 23 bp, Mus musculus
tagtagacacagaacacactagg

SEQ ID NO: 205892 - DNA, 22 bp, Mus musculus
tgtgtgtgtctctctctgtctc

SEQ ID NO: 205893 - DNA, 23 bp, Mus musculus
tgtgtgaagagtctgaggaaaag

SEQ ID NO: 205894 - DNA, 18 bp, Mus musculus
tgacatcatccagtttct

SEQ ID NO: 205895 - DNA, 23 bp, Mus musculus
ttgtgaccaattatatagtcaat

SEQ ID NO: 205896 - DNA, 23 bp, Mus musculus
ctctatgagtagtgggtgagctc

SEQ ID NO: 205897 - DNA, 23 bp, Mus musculus
tcatcttaggattcaaatgtcag

SEQ ID NO: 205898 - DNA, 23 bp, Mus musculus
tgctcatgtatacagtatgagtt

SEQ ID NO: 205899 - DNA, 23 bp, Mus musculus
tctctgcctctctggtgctgaga

SEQ ID NO: 205900 - DNA, 23 bp, Mus musculus
atactgtaagcagtttcctaaga

SEQ ID NO: 205901 - DNA, 22 bp, Mus musculus
tggctgacaggtgagcttcagg

SEQ ID NO: 205902 - DNA, 22 bp, Mus musculus
tggctgacaggtgagcttcagg

SEQ ID NO: 205903 - DNA, 20 bp, Mus musculus
ccagcactttagtctatgag

SEQ ID NO: 205904 - DNA, 19 bp, Mus musculus
tcagcatttgatgtgtagt

SEQ ID NO: 205905 - DNA, 23 bp, Mus musculus
gaaagtaaagtagtttagagtag

SEQ ID NO: 205906 - DNA, 18 bp, Mus musculus
tttcctttttttcttttt

SEQ ID NO: 205907 - DNA, 23 bp, Mus musculus
aaagagagtggctaagaagaacg

SEQ ID NO: 205908 - DNA, 22 bp, Mus musculus
atacatacaggtatacatgtgt

SEQ ID NO: 205909 - DNA, 23 bp, Mus musculus
aaatatacatgtgtatgtgatgt

SEQ ID NO: 205910 - DNA, 23 bp, Mus musculus
tgaggttggttgtagatatcttt

SEQ ID NO: 205911 - DNA, 22 bp, Mus musculus
tgttttgtgaccaattatatgg

SEQ ID NO: 205912 - DNA, 21 bp, Mus musculus
gaatgcatcttctcctagaag

SEQ ID NO: 205913 - DNA, 23 bp, Mus musculus
tggctcactctctcagagcctgg

SEQ ID NO: 205914 - DNA, 23 bp, Mus musculus
aatgagactgattgtcatatgtc

SEQ ID NO: 205915 - DNA, 23 bp, Mus musculus
tccgtctcagttactttatagcc

SEQ ID NO: 205916 - DNA, 23 bp, Mus musculus
agtgaagacagagtagtcatgaa

SEQ ID NO: 205917 - DNA, 21 bp, Mus musculus
ttgtggctcactctggctgtc

SEQ ID NO: 205918 - DNA, 23 bp, Mus musculus
ttagtgaacagagtgtgcacatg

SEQ ID NO: 205919 - DNA, 23 bp, Mus musculus
cactgagctacttcattagcctt

SEQ ID NO: 205920 - DNA, 23 bp, Mus musculus
gaacacagatgctctgtctcctg

SEQ ID NO: 205921 - DNA, 23 bp, Mus musculus
aggacctcatagtctacagactc

SEQ ID NO: 205922 - DNA, 22 bp, Mus musculus
tgggtgtcttgactcctcaatg

SEQ ID NO: 205923 - DNA, 19 bp, Mus musculus
caccaaagttattgtgtct

SEQ ID NO: 205924 - DNA, 23 bp, Mus musculus
ctctgtctctcagtgtgatgcct

SEQ ID NO: 205925 - DNA, 18 bp, Mus musculus
agacaatgtaagatctac

SEQ ID NO: 205926 - DNA, 20 bp, Mus musculus
ttttggttgcgagtcatttc

SEQ ID NO: 205927 - DNA, 22 bp, Mus musculus
tcaccctgtctctctcaatctc

SEQ ID NO: 205928 - DNA, 22 bp, Mus musculus
tgagctgagggtcttcagtgat

SEQ ID NO: 205929 - DNA, 23 bp, Mus musculus
agactgtgagctgacagcaggct

SEQ ID NO: 205930 - DNA, 23 bp, Mus musculus
tgtctgtctgtctgtctcctagt

SEQ ID NO: 205931 - DNA, 21 bp, Mus musculus
tgtctctatctctgtgtcctc

SEQ ID NO: 205932 - DNA, 23 bp, Mus musculus
acatacccagtgtctgtctgtct

SEQ ID NO: 205933 - DNA, 23 bp, Mus musculus
atgtgtatatgtatatatgtata

SEQ ID NO: 205934 - DNA, 23 bp, Mus musculus
agaggtgctgtgtatttgtgtgt

SEQ ID NO: 205935 - DNA, 22 bp, Mus musculus
tgttttgtgaccaattatatgg

SEQ ID NO: 205936 - DNA, 23 bp, Mus musculus
gtatgtatgtatgtatgtatgta

SEQ ID NO: 205937 - DNA, 23 bp, Mus musculus
tgtgcagatatatacatatatat

SEQ ID NO: 205938 - DNA, 19 bp, Mus musculus
tctctagctgcttttgtct

SEQ ID NO: 205939 - DNA, 20 bp, Mus musculus
gacagcaaccattctctgtc

SEQ ID NO: 205940 - DNA, 20 bp, Mus musculus
tgagagaagaatgtttgctc

SEQ ID NO: 205941 - DNA, 23 bp, Mus musculus
tgtatatgtgtatgtatgtatgt

SEQ ID NO: 205942 - DNA, 22 bp, Mus musculus
ttcactctggagagatggctca

SEQ ID NO: 205943 - DNA, 23 bp, Mus musculus
taagagcactgactgctcttcca

SEQ ID NO: 205944 - DNA, 23 bp, Mus musculus
aggttctgtgagagactctgtct

SEQ ID NO: 205945 - DNA, 22 bp, Mus musculus
ttcaattctcagcaaccacatg

SEQ ID NO: 205946 - DNA, 23 bp, Mus musculus
tttggaattgatacatttcttag

SEQ ID NO: 205947 - DNA, 21 bp, Mus musculus
tatgtgtacatgtgtatgtgt

SEQ ID NO: 205948 - DNA, 22 bp, Mus musculus
tatgtgtgcatgtgtatgtgta

SEQ ID NO: 205949 - DNA, 23 bp, Mus musculus
actgactgactgactgagaggca

SEQ ID NO: 205950 - DNA, 19 bp, Mus musculus
actcgctcgctcacacaca

SEQ ID NO: 205951 - DNA, 22 bp, Mus musculus
tgcactgcagagtgtgagctgt

SEQ ID NO: 205952 - DNA, 23 bp, Mus musculus
gtatgtatgtatgtgtgtgtgta

SEQ ID NO: 205953 - DNA, 22 bp, Mus musculus
tgcagttcaaggtgattataaa

SEQ ID NO: 205954 - DNA, 20 bp, Mus musculus
tagagcactgactgctcttc

SEQ ID NO: 205955 - DNA, 18 bp, Mus musculus
agctggctgaccaggcag

SEQ ID NO: 205956 - DNA, 23 bp, Mus musculus
tgccctggttcagttcctgtctt

SEQ ID NO: 205957 - DNA, 23 bp, Mus musculus
tgcctgcctgcctgcctgcctgc

SEQ ID NO: 205958 - DNA, 21 bp, Mus musculus
tcactgggatctctgtcactc

SEQ ID NO: 205959 - DNA, 18 bp, Mus musculus
tatatgtatatatatgtg

SEQ ID NO: 205960 - DNA, 23 bp, Mus musculus
atgtgtattgtatatgtgtatgt

SEQ ID NO: 205961 - DNA, 23 bp, Mus musculus
agagcagagagtgaccagagacc

SEQ ID NO: 205962 - DNA, 19 bp, Mus musculus
tgcagctttaggtagcctt

SEQ ID NO: 205963 - DNA, 23 bp, Mus musculus
atatacacatatgtatacacaca

SEQ ID NO: 205964 - DNA, 21 bp, Mus musculus
agtgactcagctttggaattc

SEQ ID NO: 205965 - DNA, 23 bp, Mus musculus
atctgtcttgtgtctcggtcact

SEQ ID NO: 205966 - DNA, 23 bp, Mus musculus
tgtgtgtgtgcatatgcatgtgt

SEQ ID NO: 205967 - DNA, 23 bp, Mus musculus
tgagcctcagtgtccctcagtct

SEQ ID NO: 205968 - DNA, 23 bp, Mus musculus
agcatcagaacatggacactggg

SEQ ID NO: 205969 - DNA, 22 bp, Mus musculus
tgtgtgtatgtcacatatgtgt

SEQ ID NO: 205970 - DNA, 23 bp, Mus musculus
tatgtatatgcatatgtatatat

SEQ ID NO: 205971 - DNA, 20 bp, Mus musculus
tgtgtatgtatgtatatgta

SEQ ID NO: 205972 - DNA, 23 bp, Mus musculus
tagtgtgtctgtgtgagggtgtc

SEQ ID NO: 205973 - DNA, 23 bp, Mus musculus
tgcctgtgtgtatgtctgtgtat

SEQ ID NO: 205974 - DNA, 19 bp, Mus musculus
tcagctcactctctcacac

SEQ ID NO: 205975 - DNA, 22 bp, Mus musculus
acagagcttcagagaggcagct

SEQ ID NO: 205976 - DNA, 23 bp, Mus musculus
tgtctctgcctgtgtgccacact

SEQ ID NO: 205977 - DNA, 23 bp, Mus musculus
aggcagatctctgtgagctcaag

SEQ ID NO: 205978 - DNA, 23 bp, Mus musculus
tctctcactgactgattgtctgt

SEQ ID NO: 205979 - DNA, 22 bp, Mus musculus
tttgtctgctttaaaaaagcaa

SEQ ID NO: 205980 - DNA, 23 bp, Mus musculus
aggcatgaggatgtgagatctgt

SEQ ID NO: 205981 - DNA, 23 bp, Mus musculus
acagagagactctgtccttcact

SEQ ID NO: 205982 - DNA, 23 bp, Mus musculus
gtgtccctctctgtcactctcca

SEQ ID NO: 205983 - DNA, 23 bp, Mus musculus
ctgtgtctgtctcactttctcca

SEQ ID NO: 205984 - DNA, 20 bp, Mus musculus
tgagagatgagactcaggag

SEQ ID NO: 205985 - DNA, 23 bp, Mus musculus
aagaatgacctactggtacaggt

SEQ ID NO: 205986 - DNA, 23 bp, Mus musculus
tgaaatgtgtgtttatttttgta

SEQ ID NO: 205987 - DNA, 23 bp, Mus musculus
tctcaagaaggtttagatttgga

SEQ ID NO: 205988 - DNA, 23 bp, Mus musculus
aaaaacagaaatggcacacctga

SEQ ID NO: 205989 - DNA, 22 bp, Mus musculus
aagacagcaggaaatcttttgt

SEQ ID NO: 205990 - DNA, 21 bp, Mus musculus
tcagaagtagttttaacatag

SEQ ID NO: 205991 - DNA, 23 bp, Mus musculus
agcactgtagtgactgtgcagtg

SEQ ID NO: 205992 - DNA, 21 bp, Mus musculus
tatatcatctctgtgtgtgtg

SEQ ID NO: 205993 - DNA, 23 bp, Mus musculus
tcattgagagccattgttgagac

SEQ ID NO: 205994 - DNA, 23 bp, Mus musculus
cactgtgtgtgtgacattcttct

SEQ ID NO: 205995 - DNA, 23 bp, Mus musculus
tgtctgtctacctgtctctctgt

SEQ ID NO: 205996 - DNA, 19 bp, Mus musculus
tgtatatgagagtctgcag

SEQ ID NO: 205997 - DNA, 19 bp, Mus musculus
ttcaagatcatgtggtctg

SEQ ID NO: 205998 - DNA, 23 bp, Mus musculus
taaacagctaggtattgtatgct

SEQ ID NO: 205999 - DNA, 21 bp, Mus musculus
aactatgtatgaagtgccagg

SEQ ID NO: 206000 - DNA, 23 bp, Mus musculus
tgcctccctgtgtccctgtgaag

SEQ ID NO: 206001 - DNA, 23 bp, Mus musculus
tctgtgtctctgcactcatgtgt

SEQ ID NO: 206002 - DNA, 23 bp, Mus musculus
actgtgtctgcctgcctgcctgc

SEQ ID NO: 206003 - DNA, 23 bp, Mus musculus
atgtgtgcatatgcattgcacgt

SEQ ID NO: 206004 - DNA, 23 bp, Mus musculus
atgtgtatgtgcatgtacatgtg

SEQ ID NO: 206005 - DNA, 23 bp, Mus musculus
atgttgtatgtgagcatgtttat

SEQ ID NO: 206006 - DNA, 22 bp, Mus musculus
agagcactgtcacaggcactgt

SEQ ID NO: 206007 - DNA, 23 bp, Mus musculus
ttgagcttgctgattgatttggt

SEQ ID NO: 206008 - DNA, 21 bp, Mus musculus
tttgttctctcggtccagctg

SEQ ID NO: 206009 - DNA, 22 bp, Mus musculus
tctgtgtctttctctgtcccag

SEQ ID NO: 206010 - DNA, 22 bp, Mus musculus
gtgaaagtttgaagtctatcct

SEQ ID NO: 206011 - DNA, 22 bp, Mus musculus
acatcaagtttcaatttctcat

SEQ ID NO: 206012 - DNA, 22 bp, Mus musculus
tgttttgtgaccaattatatgg

SEQ ID NO: 206013 - DNA, 23 bp, Mus musculus
tctctgtgtgtgattgtacatgt

SEQ ID NO: 206014 - DNA, 23 bp, Mus musculus
tcatactctcagtctgtcacggc

SEQ ID NO: 206015 - DNA, 22 bp, Mus musculus
attagatgcaaaacgaatgcaa

SEQ ID NO: 206016 - DNA, 21 bp, Mus musculus
aaacacacagggtgatctatg

SEQ ID NO: 206017 - DNA, 23 bp, Mus musculus
tggctctcagtatctctgtgtca

SEQ ID NO: 206018 - DNA, 22 bp, Mus musculus
aacagcttcagctgcagctttg

SEQ ID NO: 206019 - DNA, 22 bp, Mus musculus
tgttttgtgaccaattatatgg

SEQ ID NO: 206020 - DNA, 23 bp, Mus musculus
tgtatgtgtatatgtatatatgt

SEQ ID NO: 206021 - DNA, 19 bp, Mus musculus
agtgctatgtgcatgagtg

SEQ ID NO: 206022 - DNA, 20 bp, Mus musculus
tcactttttaaccaactgtg

SEQ ID NO: 206023 - DNA, 18 bp, Mus musculus
tatgtatatatgtataca

SEQ ID NO: 206024 - DNA, 18 bp, Mus musculus
tggaaatgtctctctata

SEQ ID NO: 206025 - DNA, 23 bp, Mus musculus
ttagagaacatttcttgttgttg

SEQ ID NO: 206026 - DNA, 23 bp, Mus musculus
atatgtgtgtgtgtctgtgtgtg

SEQ ID NO: 206027 - DNA, 22 bp, Mus musculus
ggtaggtagatagacagacaga

SEQ ID NO: 206028 - DNA, 23 bp, Mus musculus
aaactgtatgtatatatgtgtct

SEQ ID NO: 206029 - DNA, 22 bp, Mus musculus
atatatgtatataagtatacac

SEQ ID NO: 206030 - DNA, 22 bp, Mus musculus
gtctgtctgtctgtctgtgcag

SEQ ID NO: 206031 - DNA, 23 bp, Mus musculus
ctcagtgtgtctgagtgcctccc

SEQ ID NO: 206032 - DNA, 23 bp, Mus musculus
tatcagagccattttcttggctt

SEQ ID NO: 206033 - DNA, 23 bp, Mus musculus
actcactctgggtgtgtctgtga

SEQ ID NO: 206034 - DNA, 21 bp, Mus musculus
ttcagtgaacagccatggtca

SEQ ID NO: 206035 - DNA, 23 bp, Mus musculus
tatgtgtgcatctatgtgcgtgt

SEQ ID NO: 206036 - DNA, 18 bp, Mus musculus
tgttttaaagtggtggct

SEQ ID NO: 206037 - DNA, 18 bp, Mus musculus
ctcaattcccagcaaacc

SEQ ID NO: 206038 - DNA, 19 bp, Mus musculus
ttcattgtgtcttgctttg

SEQ ID NO: 206039 - DNA, 23 bp, Mus musculus
cttcagagaacacagattgaaga

SEQ ID NO: 206040 - DNA, 19 bp, Mus musculus
agtgcttccatgtttaggc

SEQ ID NO: 206041 - DNA, 22 bp, Mus musculus
ctgcctgactgcctgactgcct

SEQ ID NO: 206042 - DNA, 23 bp, Mus musculus
gccttctctgactctgactctct

SEQ ID NO: 206043 - DNA, 21 bp, Mus musculus
taggtgctttggatttgtgct

SEQ ID NO: 206044 - DNA, 23 bp, Mus musculus
atgtttgtcagaccttcttgaat

SEQ ID NO: 206045 - DNA, 19 bp, Mus musculus
tgcgtgtcagagccactct

SEQ ID NO: 206046 - DNA, 23 bp, Mus musculus
agagtttttcttctggatatgtt

SEQ ID NO: 206047 - DNA, 23 bp, Mus musculus
aactcctgatgaaaacatgtgag

SEQ ID NO: 206048 - DNA, 22 bp, Mus musculus
tgttttgtgaccaattatatgg

SEQ ID NO: 206049 - DNA, 23 bp, Mus musculus
gtctgcctctctctatctgatca

SEQ ID NO: 206050 - DNA, 21 bp, Mus musculus
accgagggaagtcagctgatt

SEQ ID NO: 206051 - DNA, 21 bp, Mus musculus
tatgtgtgtgtatgtctgtgc

SEQ ID NO: 206052 - DNA, 23 bp, Mus musculus
ttcccagtgtcacatatgactga

SEQ ID NO: 206053 - DNA, 21 bp, Mus musculus
tttataagagttgccacggtc

SEQ ID NO: 206054 - DNA, 23 bp, Mus musculus
ctgtgtctctgtttagtttctgt

SEQ ID NO: 206055 - DNA, 23 bp, Mus musculus
tgtccattgataagagtgaggtg

SEQ ID NO: 206056 - DNA, 22 bp, Mus musculus
tcactagtgtctcagtcagggt

SEQ ID NO: 206057 - DNA, 20 bp, Mus musculus
atgactgtgaagagacacca

SEQ ID NO: 206058 - DNA, 23 bp, Mus musculus
ctgaaagagttaagacaatggat

SEQ ID NO: 206059 - DNA, 23 bp, Mus musculus
tacattgtgtcttaggacttttg

SEQ ID NO: 206060 - DNA, 18 bp, Mus musculus
tgcatccctattctctgg

SEQ ID NO: 206061 - DNA, 23 bp, Mus musculus
tctgtcaggctgtctgtaagcca

SEQ ID NO: 206062 - DNA, 23 bp, Mus musculus
tctgtgtatctgtgtgtctgtat

SEQ ID NO: 206063 - DNA, 23 bp, Mus musculus
gctattgtgtgtgctagacttct

SEQ ID NO: 206064 - DNA, 19 bp, Mus musculus
ctgccttctgagctcttaa

SEQ ID NO: 206065 - DNA, 18 bp, Mus musculus
tccagttcaggctggaga

SEQ ID NO: 206066 - DNA, 23 bp, Mus musculus
tgcatgcatgatgtatgcagttc

SEQ ID NO: 206067 - DNA, 23 bp, Mus musculus
gtatgtatgtgtgtgtgcatgtg

SEQ ID NO: 206068 - DNA, 23 bp, Mus musculus
atgaacaagtggcttttgggtca

SEQ ID NO: 206069 - DNA, 22 bp, Mus musculus
tgacatgagacactttcaggag

SEQ ID NO: 206070 - DNA, 23 bp, Mus musculus
tctgctcactccctgactctcag

SEQ ID NO: 206071 - DNA, 20 bp, Mus musculus
aggccaggaagtccacccag

SEQ ID NO: 206072 - DNA, 23 bp, Mus musculus
aggagcactgactgctcttccag

SEQ ID NO: 206073 - DNA, 23 bp, Mus musculus
gatatctgtattacttgaggtga

SEQ ID NO: 206074 - DNA, 23 bp, Mus musculus
ctgtctgtctgaaagctgcagct

SEQ ID NO: 206075 - DNA, 23 bp, Mus musculus
tctcagtgtatctgtgtcaaggt

SEQ ID NO: 206076 - DNA, 22 bp, Mus musculus
ctgagaacagagtctggctact

SEQ ID NO: 206077 - DNA, 23 bp, Mus musculus
gaggttggacaaggctttcccag

SEQ ID NO: 206078 - DNA, 23 bp, Mus musculus
cagcctctgtgtcaccatctgga

SEQ ID NO: 206079 - DNA, 23 bp, Mus musculus
ctgtcactgtgtggtaaggggca

SEQ ID NO: 206080 - DNA, 20 bp, Mus musculus
tgtgtacatgcatgtgtgtg

SEQ ID NO: 206081 - DNA, 21 bp, Mus musculus
acactgaggaagaagaatcag

SEQ ID NO: 206082 - DNA, 23 bp, Mus musculus
tcctcagtctctctgtgcctggc

SEQ ID NO: 206083 - DNA, 23 bp, Mus musculus
tgccaggctctgtctctctctct

SEQ ID NO: 206084 - DNA, 20 bp, Mus musculus
cactcagtgtctctgtggag

SEQ ID NO: 206085 - DNA, 23 bp, Mus musculus
attgttgtctggtcttgatgttc

SEQ ID NO: 206086 - DNA, 23 bp, Mus musculus
tgtgtgtgtgtgctagtgcatgt

SEQ ID NO: 206087 - DNA, 21 bp, Mus musculus
tgtcctggttgtcctggaact

SEQ ID NO: 206088 - DNA, 23 bp, Mus musculus
aggttaaaggttgattagttgag

SEQ ID NO: 206089 - DNA, 23 bp, Mus musculus
acagtgtgcatgtgttttctctt

SEQ ID NO: 206090 - DNA, 19 bp, Mus musculus
agttctagacgagcacaga

SEQ ID NO: 206091 - DNA, 23 bp, Mus musculus
cattctgtctgtctgtctgtttg

SEQ ID NO: 206092 - DNA, 21 bp, Mus musculus
agccatcttgatgggctggag

SEQ ID NO: 206093 - DNA, 23 bp, Mus musculus
acatgtgtatatatgtatgtgtg

SEQ ID NO: 206094 - DNA, 23 bp, Mus musculus
tgctccagctccagtgtatggtc

SEQ ID NO: 206095 - DNA, 22 bp, Mus musculus
tgtgtgtgtatctgtgtgtgta

SEQ ID NO: 206096 - DNA, 23 bp, Mus musculus
aagagcactgactgctcttccag

SEQ ID NO: 206097 - DNA, 23 bp, Mus musculus
acacatgtgagtgatcagtgtct

SEQ ID NO: 206098 - DNA, 23 bp, Mus musculus
tcaaatctcagcaactacatggt

SEQ ID NO: 206099 - DNA, 23 bp, Mus musculus
tgttcctctctctgtctctggga

SEQ ID NO: 206100 - DNA, 23 bp, Mus musculus
aagaccactgactgctcttccag

SEQ ID NO: 206101 - DNA, 23 bp, Mus musculus
ctgttgcttctgatcttgggttt

SEQ ID NO: 206102 - DNA, 18 bp, Mus musculus
cagagaagagactggctg

SEQ ID NO: 206103 - DNA, 23 bp, Mus musculus
tcagttcagagtgtgcagatcgg

SEQ ID NO: 206104 - DNA, 20 bp, Mus musculus
aagagcactgactgctcttc

SEQ ID NO: 206105 - DNA, 18 bp, Mus musculus
gtttatccaggtttccca

SEQ ID NO: 206106 - DNA, 23 bp, Mus musculus
tcccagtctcactctgtgcttcc

SEQ ID NO: 206107 - DNA, 20 bp, Mus musculus
gagctggttcaaaatggcgt

SEQ ID NO: 206108 - DNA, 22 bp, Mus musculus
tgttttgtgaccaattatatgg

SEQ ID NO: 206109 - DNA, 21 bp, Mus musculus
tctatggttaacaagatatat

SEQ ID NO: 206110 - DNA, 20 bp, Mus musculus
agagaacatcttttccttat

SEQ ID NO: 206111 - DNA, 23 bp, Mus musculus
aaaatgagttttcctattctctt

SEQ ID NO: 206112 - DNA, 23 bp, Mus musculus
tcttggtgcagacattctgtggt

SEQ ID NO: 206113 - DNA, 23 bp, Mus musculus
ctccataagaccagcaagtacca

SEQ ID NO: 206114 - DNA, 23 bp, Mus musculus
tttctgtcactctcagttttttg

SEQ ID NO: 206115 - DNA, 20 bp, Mus musculus
tcactcttgcatttggtgac

SEQ ID NO: 206116 - DNA, 23 bp, Mus musculus
tataatatacatgatatacatgt

SEQ ID NO: 206117 - DNA, 23 bp, Mus musculus
ctatctgcatgtacatctgcttg

SEQ ID NO: 206118 - DNA, 23 bp, Mus musculus
tgggaatgtgtgtgactatgctg

SEQ ID NO: 206119 - DNA, 23 bp, Mus musculus
gtgaggcacacactctgtctcct

SEQ ID NO: 206120 - DNA, 23 bp, Mus musculus
gtctgactgaagaaaggagtgtg

SEQ ID NO: 206121 - DNA, 23 bp, Mus musculus
ccgcctgcctgcctgcctgcctg

SEQ ID NO: 206122 - DNA, 22 bp, Mus musculus
tctgagagtctctctttctcca

SEQ ID NO: 206123 - DNA, 22 bp, Mus musculus
tgttttgtgaccaattatatgg

SEQ ID NO: 206124 - DNA, 23 bp, Mus musculus
tcatgaaactgcttccacattgg

SEQ ID NO: 206125 - DNA, 22 bp, Mus musculus
aaaagaaaatctgtactttcct

SEQ ID NO: 206126 - DNA, 23 bp, Mus musculus
tgtctctctgagtctgtatttcc

SEQ ID NO: 206127 - DNA, 20 bp, Mus musculus
gcatctgctggctatccaca

SEQ ID NO: 206128 - DNA, 23 bp, Mus musculus
gcctctctgcctgtctctgcctg

SEQ ID NO: 206129 - DNA, 22 bp, Mus musculus
tctcaggttgcttatccacagt

SEQ ID NO: 206130 - DNA, 23 bp, Mus musculus
gccttctctgtccctctgccagt

SEQ ID NO: 206131 - DNA, 23 bp, Mus musculus
atatgcatgtacatgcctttgtt

SEQ ID NO: 206132 - DNA, 18 bp, Mus musculus
tatatgcagtaataagta

SEQ ID NO: 206133 - DNA, 23 bp, Mus musculus
gcatcttagtgggtctttgttac

SEQ ID NO: 206134 - DNA, 23 bp, Mus musculus
gttgagtgtagactggactttgg

SEQ ID NO: 206135 - DNA, 19 bp, Mus musculus
ctacatcttgtaaacactc

SEQ ID NO: 206136 - DNA, 23 bp, Mus musculus
tctctttctgccagctcatgatg

SEQ ID NO: 206137 - DNA, 20 bp, Mus musculus
atatgtgcacagagtgtcca

SEQ ID NO: 206138 - DNA, 20 bp, Mus musculus
tatgtatgtatatatgtatg

SEQ ID NO: 206139 - DNA, 23 bp, Mus musculus
acatttcagtggatggatgtgga

SEQ ID NO: 206140 - DNA, 23 bp, Mus musculus
gaggtactgcatcaccatctgga

SEQ ID NO: 206141 - DNA, 20 bp, Mus musculus
tcagtctctctctgttaaaa

SEQ ID NO: 206142 - DNA, 19 bp, Mus musculus
gatctctgtgagttctagg

SEQ ID NO: 206143 - DNA, 18 bp, Mus musculus
tagacagccaagtttaca

SEQ ID NO: 206144 - DNA, 18 bp, Mus musculus
tcttctcttttgtattga

SEQ ID NO: 206145 - DNA, 23 bp, Mus musculus
gggagctggcttcatgcaagtga

SEQ ID NO: 206146 - DNA, 21 bp, Mus musculus
tgagctcccgaaagcaagggt

SEQ ID NO: 206147 - DNA, 23 bp, Mus musculus
tgacagactgtctctatctccct

SEQ ID NO: 206148 - DNA, 23 bp, Mus musculus
tttcttcagatggctctgctgtc

SEQ ID NO: 206149 - DNA, 23 bp, Mus musculus
agtagacagtgttgacagttgct

SEQ ID NO: 206150 - DNA, 19 bp, Mus musculus
tacagcagcaattcttagc

SEQ ID NO: 206151 - DNA, 18 bp, Mus musculus
cagtgaagttagcaggct

SEQ ID NO: 206152 - DNA, 20 bp, Mus musculus
cagtgcctctctcattctct

SEQ ID NO: 206153 - DNA, 23 bp, Mus musculus
tcaattgagtgtatactatatct

SEQ ID NO: 206154 - DNA, 23 bp, Mus musculus
ttatatactcaatcaattgtgta

SEQ ID NO: 206155 - DNA, 23 bp, Mus musculus
tgtgtgtgtgcatgtgtatgtgt

SEQ ID NO: 206156 - DNA, 23 bp, Mus musculus
acagtctctgagtctgtgacttt

SEQ ID NO: 206157 - DNA, 23 bp, Mus musculus
cctgtgtgcacatatgtgtgtgc

SEQ ID NO: 206158 - DNA, 23 bp, Mus musculus
tgcctctgtgtgtgcctctgtgt

SEQ ID NO: 206159 - DNA, 23 bp, Mus musculus
gtgtttttcttgttgtccctcag

SEQ ID NO: 206160 - DNA, 21 bp, Mus musculus
agcctgttgatgttgctgggt

SEQ ID NO: 206161 - DNA, 23 bp, Mus musculus
aacctcaggctgctttgatctgg

SEQ ID NO: 206162 - DNA, 20 bp, Mus musculus
tgcaagtgcacatgcatgtg

SEQ ID NO: 206163 - DNA, 20 bp, Mus musculus
gtgcatatgtatgtgtcagt

SEQ ID NO: 206164 - DNA, 23 bp, Mus musculus
tctctccctctgtgtctgccata

SEQ ID NO: 206165 - DNA, 20 bp, Mus musculus
ccccagtctctgtctctctc

SEQ ID NO: 206166 - DNA, 23 bp, Mus musculus
tgtgtctgtatgtgtgtctctgt

SEQ ID NO: 206167 - DNA, 18 bp, Mus musculus
gactggagagatggctca

SEQ ID NO: 206168 - DNA, 23 bp, Mus musculus
tcaaaggtaatcaaatggccatg

SEQ ID NO: 206169 - DNA, 23 bp, Mus musculus
ctgtgtctctgtgtctgccattc

SEQ ID NO: 206170 - DNA, 23 bp, Mus musculus
tgtatgtggagtgcctgcagaga

SEQ ID NO: 206171 - DNA, 19 bp, Mus musculus
ggtcaacagcagctgctct

SEQ ID NO: 206172 - DNA, 23 bp, Mus musculus
tagacagagcacagtctgctcac

SEQ ID NO: 206173 - DNA, 23 bp, Mus musculus
gagaagagtctgtttggggtccg

SEQ ID NO: 206174 - DNA, 23 bp, Mus musculus
tgagccaagactctgagcagtgt

SEQ ID NO: 206175 - DNA, 23 bp, Mus musculus
tggagctatgtctctctctctgt

SEQ ID NO: 206176 - DNA, 23 bp, Mus musculus
agtgcctgcctgcctgcctgcct

SEQ ID NO: 206177 - DNA, 23 bp, Mus musculus
tcactcagtctgttattgttggc

SEQ ID NO: 206178 - DNA, 23 bp, Mus musculus
tgtgagaacagtgtgagatacct

SEQ ID NO: 206179 - DNA, 23 bp, Mus musculus
tctctgcgtatctctgtctctct

SEQ ID NO: 206180 - DNA, 21 bp, Mus musculus
tatgtatgtatgtatgtatgt

SEQ ID NO: 206181 - DNA, 23 bp, Mus musculus
tgatgtgttgtcagaatgctgta

SEQ ID NO: 206182 - DNA, 22 bp, Mus musculus
tatcagcatcatttgggaggtg

SEQ ID NO: 206183 - DNA, 22 bp, Mus musculus
aggtgaagcaggccaggtggaa

SEQ ID NO: 206184 - DNA, 23 bp, Mus musculus
tgtctgcctgtctgtctgtctga

SEQ ID NO: 206185 - DNA, 20 bp, Mus musculus
accctcaccagaagccagtc

SEQ ID NO: 206186 - DNA, 23 bp, Mus musculus
tgtgtctgcctctgtgtgtgtct

SEQ ID NO: 206187 - DNA, 23 bp, Mus musculus
tcagtcagtcagtcaataaagtg

SEQ ID NO: 206188 - DNA, 19 bp, Mus musculus
agtggagtagcagatacca

SEQ ID NO: 206189 - DNA, 23 bp, Mus musculus
tgtgtctgtctgtctgtctgtgc

SEQ ID NO: 206190 - DNA, 22 bp, Mus musculus
tgttagatcaaatgctgctgct

SEQ ID NO: 206191 - DNA, 23 bp, Mus musculus
tcacacactgagaggcagcatac

SEQ ID NO: 206192 - DNA, 21 bp, Mus musculus
aggcagtgtggatagatcgtt

SEQ ID NO: 206193 - DNA, 23 bp, Mus musculus
tgtctgtctctgtgtctccctca

SEQ ID NO: 206194 - DNA, 20 bp, Mus musculus
aggagcttaacatttggtgt

SEQ ID NO: 206195 - DNA, 22 bp, Mus musculus
tagagttgaggccaatgtagtg

SEQ ID NO: 206196 - DNA, 23 bp, Mus musculus
ttaagagcactgactgctcttcc

SEQ ID NO: 206197 - DNA, 23 bp, Mus musculus
tgtgcatttgtgtgtgtatgctt

SEQ ID NO: 206198 - DNA, 23 bp, Mus musculus
ttcttctgatcagtggggttctg

SEQ ID NO: 206199 - DNA, 23 bp, Mus musculus
tgcctcgctgtgtgcctgtgtct

SEQ ID NO: 206200 - DNA, 22 bp, Mus musculus
agacagagatgggagatgcaaa

SEQ ID NO: 206201 - DNA, 23 bp, Mus musculus
tgagttaaattctatgtcacagt

SEQ ID NO: 206202 - DNA, 21 bp, Mus musculus
cttagtgcttggggtacagaa

SEQ ID NO: 206203 - DNA, 22 bp, Mus musculus
tgcacagagttctaggtagtga

SEQ ID NO: 206204 - DNA, 23 bp, Mus musculus
gggagactgtgactctgtctata

SEQ ID NO: 206205 - DNA, 23 bp, Mus musculus
gcagagtggctgactcacagggt

SEQ ID NO: 206206 - DNA, 23 bp, Mus musculus
aggtcagtctctgtgagtctctg

SEQ ID NO: 206207 - DNA, 23 bp, Mus musculus
cgcatcccctagggcattggtgt

SEQ ID NO: 206208 - DNA, 22 bp, Mus musculus
ccactgccccaggtgctgctgg

SEQ ID NO: 206209 - DNA, 23 bp, Mus musculus
gtgtctctgtgtgtctgtatatt

SEQ ID NO: 206210 - DNA, 23 bp, Mus musculus
agatacagagaccagaagctgtg

SEQ ID NO: 206211 - DNA, 23 bp, Mus musculus
gaccactccctgactcactgagt

SEQ ID NO: 206212 - DNA, 22 bp, Mus musculus
gtatgtgtatatgcatgtgttt

SEQ ID NO: 206213 - DNA, 23 bp, Mus musculus
catatatagatttggtggagttg

SEQ ID NO: 206214 - DNA, 23 bp, Mus musculus
aaatactgtgcattctgtcactg

SEQ ID NO: 206215 - DNA, 23 bp, Mus musculus
gtgtcagactcagactctgcaga

SEQ ID NO: 206216 - DNA, 23 bp, Mus musculus
acctgtctctgtcagtcaccctt

SEQ ID NO: 206217 - DNA, 23 bp, Mus musculus
cagtactccgtcccagtgttctc

SEQ ID NO: 206218 - DNA, 23 bp, Mus musculus
ttgacatttggttagttctgctt

SEQ ID NO: 206219 - DNA, 23 bp, Mus musculus
actgtctgtctgactgtaagctg

SEQ ID NO: 206220 - DNA, 23 bp, Mus musculus
agtaggagctctgattttctttt

SEQ ID NO: 206221 - DNA, 23 bp, Mus musculus
ttgctacaacttgggctggtgag

SEQ ID NO: 206222 - DNA, 23 bp, Mus musculus
tctgtggctctgcctgactagac

SEQ ID NO: 206223 - DNA, 23 bp, Mus musculus
tccacttgagtgtgtcctcttgc

SEQ ID NO: 206224 - DNA, 23 bp, Mus musculus
gtgtgtgtgtgcgtgtgtatgtg

SEQ ID NO: 206225 - DNA, 19 bp, Mus musculus
tgcatgtatgtatgtatgt

SEQ ID NO: 206226 - DNA, 23 bp, Mus musculus
aacactctagagactgagctaag

SEQ ID NO: 206227 - DNA, 19 bp, Mus musculus
ggcagagtgctgtggtggt

SEQ ID NO: 206228 - DNA, 22 bp, Mus musculus
tgttttgtgaccaattatatgg

SEQ ID NO: 206229 - DNA, 23 bp, Mus musculus
tcactgtttctgtgtctggtgat

SEQ ID NO: 206230 - DNA, 22 bp, Mus musculus
tgttttgtgaccaattatatgg

SEQ ID NO: 206231 - DNA, 21 bp, Mus musculus
tgggagtgtgagaggttgatg

SEQ ID NO: 206232 - DNA, 23 bp, Mus musculus
aaaggtggctgtgaatgggcagt

SEQ ID NO: 206233 - DNA, 23 bp, Mus musculus
tgtctctgggtctctgtctgccc

SEQ ID NO: 206234 - DNA, 23 bp, Mus musculus
ctggctgtgtctctgtatgtggt

SEQ ID NO: 206235 - DNA, 22 bp, Mus musculus
aagagacatgatatgaggcatg

SEQ ID NO: 206236 - DNA, 23 bp, Mus musculus
tttttcaaagtttatgaaatgaa

SEQ ID NO: 206237 - DNA, 23 bp, Mus musculus
ctgtgtcactcgctctattctgg

SEQ ID NO: 206238 - DNA, 23 bp, Mus musculus
ctatctgcctctgcttgacttgg

SEQ ID NO: 206239 - DNA, 18 bp, Mus musculus
agaggactgactgctctt

SEQ ID NO: 206240 - DNA, 23 bp, Mus musculus
ctcagcctctggctcagtgatac

SEQ ID NO: 206241 - DNA, 23 bp, Mus musculus
cgtatgtatgtatgtatgtatgt

SEQ ID NO: 206242 - DNA, 23 bp, Mus musculus
agacagtctctgtatatagtcct

SEQ ID NO: 206243 - DNA, 23 bp, Mus musculus
tctgtctctgtctgtctgtctgt

SEQ ID NO: 206244 - DNA, 23 bp, Mus musculus
atctgtctgtctgtctgtctgtc

SEQ ID NO: 206245 - DNA, 23 bp, Mus musculus
tatatgtgtgtgtgtatatacac

SEQ ID NO: 206246 - DNA, 23 bp, Mus musculus
tatatgtatgtatatatgtgtgt

SEQ ID NO: 206247 - DNA, 23 bp, Mus musculus
gtgtgtgtgcatatgcatgtact

SEQ ID NO: 206248 - DNA, 23 bp, Mus musculus
gcgagtgtgtgtctgtgtgtgtg

SEQ ID NO: 206249 - DNA, 23 bp, Mus musculus
gagggtcactctgtgcctcagtc

SEQ ID NO: 206250 - DNA, 23 bp, Mus musculus
ctgcctctgtctatggctctgca

SEQ ID NO: 206251 - DNA, 23 bp, Mus musculus
tttcctcctgatcactgtgtgcc

SEQ ID NO: 206252 - DNA, 23 bp, Mus musculus
ctgagagagagaaaaaaagcact

SEQ ID NO: 206253 - DNA, 20 bp, Mus musculus
tgagagtttgtttttctctt

SEQ ID NO: 206254 - DNA, 23 bp, Mus musculus
ctgtgtctctctgtctctcttgt

SEQ ID NO: 206255 - DNA, 23 bp, Mus musculus
tcattcagtctctgtgagtccct

SEQ ID NO: 206256 - DNA, 22 bp, Mus musculus
tgttttgtgaccaattatatgg

SEQ ID NO: 206257 - DNA, 23 bp, Mus musculus
ttctctgtgatattaaatcgatt

SEQ ID NO: 206258 - DNA, 22 bp, Mus musculus
tgttttgtgaccaattatatgg

SEQ ID NO: 206259 - DNA, 23 bp, Mus musculus
ttagtctctgtctctttattggg

SEQ ID NO: 206260 - DNA, 19 bp, Mus musculus
gtccattgatattgagaga

SEQ ID NO: 206261 - DNA, 19 bp, Mus musculus
tagctggttctgttgctgt

SEQ ID NO: 206262 - DNA, 23 bp, Mus musculus
tagggacagaagacagacagtag

SEQ ID NO: 206263 - DNA, 22 bp, Mus musculus
tgttttgtgaccaattatatgg

SEQ ID NO: 206264 - DNA, 23 bp, Mus musculus
tctcagtgtctgtataacatctg

SEQ ID NO: 206265 - DNA, 23 bp, Mus musculus
tctcagtgtctgtataacatctg

SEQ ID NO: 206266 - DNA, 21 bp, Mus musculus
aaaggttttctagatatttct

SEQ ID NO: 206267 - DNA, 23 bp, Mus musculus
agccagggtgatatggtggactt

SEQ ID NO: 206268 - DNA, 20 bp, Mus musculus
cagtagaagtggttgaccac

SEQ ID NO: 206269 - DNA, 23 bp, Mus musculus
tgccactgtgtgagtcagagcat

SEQ ID NO: 206270 - DNA, 23 bp, Mus musculus
catctctgtctctctccctggct

SEQ ID NO: 206271 - DNA, 19 bp, Mus musculus
tgtgggtctgtgtgtgtgt

SEQ ID NO: 206272 - DNA, 23 bp, Mus musculus
tgtctgtccatctgtctgtctgt

SEQ ID NO: 206273 - DNA, 22 bp, Mus musculus
acaactctctctgtgtctgtgg

SEQ ID NO: 206274 - DNA, 23 bp, Mus musculus
gcctgtctgcctgcctgcctgcc

SEQ ID NO: 206275 - DNA, 18 bp, Mus musculus
gtgaggctgtctctgaag

SEQ ID NO: 206276 - DNA, 23 bp, Mus musculus
aatggatggatgaatgtatgtat

SEQ ID NO: 206277 - DNA, 22 bp, Mus musculus
acaagcctgagtctcaggcact

SEQ ID NO: 206278 - DNA, 23 bp, Mus musculus
ttgcagacagatatgtgtgtgca

SEQ ID NO: 206279 - DNA, 18 bp, Mus musculus
tgcacacacacatatggg

SEQ ID NO: 206280 - DNA, 23 bp, Mus musculus
tctcagaggatagttatgctagg

SEQ ID NO: 206281 - DNA, 23 bp, Mus musculus
ttacagacatttgtgagctgcca

SEQ ID NO: 206282 - DNA, 21 bp, Mus musculus
taacagtctccagtcacggcc

SEQ ID NO: 206283 - DNA, 23 bp, Mus musculus
acagagctaggagactcttgtca

SEQ ID NO: 206284 - DNA, 22 bp, Mus musculus
tgagccgcagtagttcttcagt

SEQ ID NO: 206285 - DNA, 23 bp, Mus musculus
aagctgccagttgaagaactgtt

SEQ ID NO: 206286 - DNA, 18 bp, Mus musculus
acagaggctggagagatg

SEQ ID NO: 206287 - DNA, 22 bp, Mus musculus
acactgcatgttctacactgca

SEQ ID NO: 206288 - DNA, 23 bp, Mus musculus
tgtctgtctgtctgtctatatgg

SEQ ID NO: 206289 - DNA, 23 bp, Mus musculus
acgggcatctgtctctcagacac

SEQ ID NO: 206290 - DNA, 23 bp, Mus musculus
tgtctgtctgtctgtctgtctat

SEQ ID NO: 206291 - DNA, 23 bp, Mus musculus
ggcactgactgctcttccagagg

SEQ ID NO: 206292 - DNA, 21 bp, Mus musculus
gtgcatgtgtgtatatatata

SEQ ID NO: 206293 - DNA, 19 bp, Mus musculus
tgtgtgtgaacgtgtgtgc

SEQ ID NO: 206294 - DNA, 23 bp, Mus musculus
atgtttgtatatgtatatgtgtg

SEQ ID NO: 206295 - DNA, 23 bp, Mus musculus
ctggacatgtcacactctctctg

SEQ ID NO: 206296 - DNA, 21 bp, Mus musculus
gcactcacacagtctgtctcc

SEQ ID NO: 206297 - DNA, 23 bp, Mus musculus
cagagtagtcagtctgaggttac

SEQ ID NO: 206298 - DNA, 22 bp, Mus musculus
atgcactggagtctgctgaggg

SEQ ID NO: 206299 - DNA, 23 bp, Mus musculus
acacagatgacactctgcagtga

SEQ ID NO: 206300 - DNA, 23 bp, Mus musculus
cctgcctgcctgcctgcctgcct

SEQ ID NO: 206301 - DNA, 23 bp, Mus musculus
cttgagttctgattttcatgcac

SEQ ID NO: 206302 - DNA, 22 bp, Mus musculus
tggcactctcttgccttgaggt

SEQ ID NO: 206303 - DNA, 23 bp, Mus musculus
tatgtctctctcacagatccagg

SEQ ID NO: 206304 - DNA, 23 bp, Mus musculus
catcacagacattagccttcaca

SEQ ID NO: 206305 - DNA, 23 bp, Mus musculus
aggctgtggctctgtggctctga

SEQ ID NO: 206306 - DNA, 23 bp, Mus musculus
agctcttgttctggggctggaga

SEQ ID NO: 206307 - DNA, 23 bp, Mus musculus
ttaaatctctcctgccaggtgag

SEQ ID NO: 206308 - DNA, 23 bp, Mus musculus
ctgtctctgactgtgacttgcct

SEQ ID NO: 206309 - DNA, 23 bp, Mus musculus
aacaacaagcagaattctaacta

SEQ ID NO: 206310 - DNA, 18 bp, Mus musculus
agccttggttcagcaccc

SEQ ID NO: 206311 - DNA, 22 bp, Mus musculus
ccagagtttattgcacagtgga

SEQ ID NO: 206312 - DNA, 23 bp, Mus musculus
ctgactgctcttccagaggtcct

SEQ ID NO: 206313 - DNA, 19 bp, Mus musculus
tttctatttttctgctgag

SEQ ID NO: 206314 - DNA, 22 bp, Mus musculus
gctttgatgtggggctggagag

SEQ ID NO: 206315 - DNA, 23 bp, Mus musculus
tatgtgtatatatacatatgtgt

SEQ ID NO: 206316 - DNA, 18 bp, Mus musculus
agacatgtgccaccactg

SEQ ID NO: 206317 - DNA, 23 bp, Mus musculus
actaagcatggtggtgtaagcct

SEQ ID NO: 206318 - DNA, 23 bp, Mus musculus
tgctgaatgagcatctggaagtc

SEQ ID NO: 206319 - DNA, 20 bp, Mus musculus
ttataggtgaagaagtgggg

SEQ ID NO: 206320 - DNA, 23 bp, Mus musculus
tatatgtgtgtatacatatgtat

SEQ ID NO: 206321 - DNA, 23 bp, Mus musculus
atgtgtgtatatatatatgtgtg

SEQ ID NO: 206322 - DNA, 23 bp, Mus musculus
aagagcactgactgctcttccag

SEQ ID NO: 206323 - DNA, 21 bp, Mus musculus
ttaagagcactgtctgctctt

SEQ ID NO: 206324 - DNA, 23 bp, Mus musculus
ctacagtatagatgatgtactag

SEQ ID NO: 206325 - DNA, 23 bp, Mus musculus
gctaatcagaggaaaagtgagct

SEQ ID NO: 206326 - DNA, 23 bp, Mus musculus
tgactggctgagtgactggctga

SEQ ID NO: 206327 - DNA, 23 bp, Mus musculus
ttctctgcaagagcaactgatgt

SEQ ID NO: 206328 - DNA, 22 bp, Mus musculus
ctggtcagtcagtgagtcagtg

SEQ ID NO: 206329 - DNA, 23 bp, Mus musculus
tgaggttggagagacagttcagt

SEQ ID NO: 206330 - DNA, 19 bp, Mus musculus
aggaggtgagtgtgagaag

SEQ ID NO: 206331 - DNA, 23 bp, Mus musculus
tctctcacaggctcactgtcact

SEQ ID NO: 206332 - DNA, 19 bp, Mus musculus
tgagagagccacaaatatc

SEQ ID NO: 206333 - DNA, 23 bp, Mus musculus
tgtgtgtgcatgttcatatgcat

SEQ ID NO: 206334 - DNA, 19 bp, Mus musculus
ggctcagtggttaggagca

SEQ ID NO: 206335 - DNA, 23 bp, Mus musculus
ttcttagtttatttttatgctct

SEQ ID NO: 206336 - DNA, 21 bp, Mus musculus
tgtgtaggtattggtatgtat

SEQ ID NO: 206337 - DNA, 23 bp, Mus musculus
tatgtgtatatataggtatgtgt

SEQ ID NO: 206338 - DNA, 21 bp, Mus musculus
tatagtgctcagtctgtcatt

SEQ ID NO: 206339 - DNA, 23 bp, Mus musculus
tgagtacactgtacagatggttg

SEQ ID NO: 206340 - DNA, 23 bp, Mus musculus
tctgtgtcaccctgactgtccca

SEQ ID NO: 206341 - DNA, 19 bp, Mus musculus
tctcagtgttcctgctaat

SEQ ID NO: 206342 - DNA, 21 bp, Mus musculus
tgtgtctgaagacagacagct

SEQ ID NO: 206343 - DNA, 21 bp, Mus musculus
caggcccagtctctgtctctc

SEQ ID NO: 206344 - DNA, 22 bp, Mus musculus
gtccctcacactgactctgacc

SEQ ID NO: 206345 - DNA, 23 bp, Mus musculus
aaaggtactggtattcttggctt

SEQ ID NO: 206346 - DNA, 23 bp, Mus musculus
tttgtgtggaagctgcttgtttt

SEQ ID NO: 206347 - DNA, 23 bp, Mus musculus
gaacactagtgtttttccacaag

SEQ ID NO: 206348 - DNA, 21 bp, Mus musculus
actatgtatatgtatatcttt

SEQ ID NO: 206349 - DNA, 23 bp, Mus musculus
agagcctgtgagatcatggtttt

SEQ ID NO: 206350 - DNA, 21 bp, Mus musculus
aggctgtgtgtacatgcaggg

SEQ ID NO: 206351 - DNA, 20 bp, Mus musculus
tgtctctgtatgtgttaacc

SEQ ID NO: 206352 - DNA, 21 bp, Mus musculus
atatatgtgtatgtatatgaa

SEQ ID NO: 206353 - DNA, 23 bp, Mus musculus
gttcacacatttagaacttgtgt

SEQ ID NO: 206354 - DNA, 21 bp, Mus musculus
tgggtctgaaaagatggctca

SEQ ID NO: 206355 - DNA, 23 bp, Mus musculus
gtctgtctgtctgtctgtctgtg

SEQ ID NO: 206356 - DNA, 23 bp, Mus musculus
gaaagtactgactgagctgtctc

SEQ ID NO: 206357 - DNA, 18 bp, Mus musculus
atagtcagtcctttatat

SEQ ID NO: 206358 - DNA, 23 bp, Mus musculus
tgtctgtccgtctgtctgtccgt

SEQ ID NO: 206359 - DNA, 20 bp, Mus musculus
actgctttataatttttgta

SEQ ID NO: 206360 - DNA, 23 bp, Mus musculus
aggtgacagtgattgaaatgagc

SEQ ID NO: 206361 - DNA, 23 bp, Mus musculus
tgtcactcagggtctgtctagat

SEQ ID NO: 206362 - DNA, 22 bp, Mus musculus
ttatgtgactggttgtcatggc

SEQ ID NO: 206363 - DNA, 23 bp, Mus musculus
aagaacactgactgctcttccag

SEQ ID NO: 206364 - DNA, 21 bp, Mus musculus
tctctagttggttgaattgtt

SEQ ID NO: 206365 - DNA, 20 bp, Mus musculus
actgactgctcttccagagg

SEQ ID NO: 206366 - DNA, 23 bp, Mus musculus
tgtatgtgtggtgtgaatgtata

SEQ ID NO: 206367 - DNA, 23 bp, Mus musculus
tgacttgacacagaatcacctag

SEQ ID NO: 206368 - DNA, 23 bp, Mus musculus
atgagatcgctctgtgtgtctgt

SEQ ID NO: 206369 - DNA, 19 bp, Mus musculus
tgtgtgtgtgtgtgtgtgt

SEQ ID NO: 206370 - DNA, 23 bp, Mus musculus
ttctgtagtctgatcattgggaa

SEQ ID NO: 206371 - DNA, 22 bp, Mus musculus
acacagaagtttgtgtgcatat

SEQ ID NO: 206372 - DNA, 23 bp, Mus musculus
taaatgtgcacgcatatgtgtct

SEQ ID NO: 206373 - DNA, 20 bp, Mus musculus
gtgtgggtgggtgggtgggt

SEQ ID NO: 206374 - DNA, 18 bp, Mus musculus
gtgtgtgtgtgtgcacgc

SEQ ID NO: 206375 - DNA, 23 bp, Mus musculus
tctgtctatctgtgtgtgtgtgc

SEQ ID NO: 206376 - DNA, 21 bp, Mus musculus
tgtgtatgtatgtgtatgtct

SEQ ID NO: 206377 - DNA, 20 bp, Mus musculus
tgtgtgtatatatatatgtg

SEQ ID NO: 206378 - DNA, 21 bp, Mus musculus
gctctcagtatctgtctgttt

SEQ ID NO: 206379 - DNA, 18 bp, Mus musculus
gtatgtaaacctatgtgt

SEQ ID NO: 206380 - DNA, 22 bp, Mus musculus
tgttttgtgaccaattatatgg

SEQ ID NO: 206381 - DNA, 23 bp, Mus musculus
tgtgtgtgtgcatgtgtatgtgc

SEQ ID NO: 206382 - DNA, 19 bp, Mus musculus
tgtgtacatgcacatgtgt

SEQ ID NO: 206383 - DNA, 23 bp, Mus musculus
ctctgtctgactgtgtgtaccct

SEQ ID NO: 206384 - DNA, 23 bp, Mus musculus
tagtgcatggtgatctgatagga

SEQ ID NO: 206385 - DNA, 22 bp, Mus musculus
tgttttgtgacctattatgtgg

SEQ ID NO: 206386 - DNA, 19 bp, Mus musculus
tgagactgtgagtgttcag

SEQ ID NO: 206387 - DNA, 23 bp, Mus musculus
tgagcctctttgaactgagtcag

SEQ ID NO: 206388 - DNA, 20 bp, Mus musculus
tgaaaaactgacagtccagt

SEQ ID NO: 206389 - DNA, 22 bp, Mus musculus
acagagtggtcagagtggtgga

SEQ ID NO: 206390 - DNA, 21 bp, Mus musculus
ctcttgctgactgacagtcac

SEQ ID NO: 206391 - DNA, 22 bp, Mus musculus
ttgaacttttcctattctgaga

SEQ ID NO: 206392 - DNA, 19 bp, Mus musculus
tatttctcatagtgggggc

SEQ ID NO: 206393 - DNA, 23 bp, Mus musculus
gtgtgtgtgtgtgtgtgtaaatg

SEQ ID NO: 206394 - DNA, 23 bp, Mus musculus
agctgtgcatctgtgtgtgtgtg

SEQ ID NO: 206395 - DNA, 23 bp, Mus musculus
tgtgtctgtctgtgtgcatgtgt

SEQ ID NO: 206396 - DNA, 22 bp, Mus musculus
agtctccttacctttttggagc

SEQ ID NO: 206397 - DNA, 23 bp, Mus musculus
tatatgtgtatatgtagacgtgt

SEQ ID NO: 206398 - DNA, 20 bp, Mus musculus
atgtgtgtgtatatgtatat

SEQ ID NO: 206399 - DNA, 23 bp, Mus musculus
tgtgtgtgtatgtgcatgtgcat

SEQ ID NO: 206400 - DNA, 23 bp, Mus musculus
tgtctgtctgtctgtctgtctac

SEQ ID NO: 206401 - DNA, 23 bp, Mus musculus
cacagacagttgtgagtcaccag

SEQ ID NO: 206402 - DNA, 20 bp, Mus musculus
agatgagcagtcaatgctct

SEQ ID NO: 206403 - DNA, 20 bp, Mus musculus
gtcagtctgtctgtgtcgaa

SEQ ID NO: 206404 - DNA, 23 bp, Mus musculus
gtgcgtgtgtgcgtgcgtgtgtg

SEQ ID NO: 206405 - DNA, 22 bp, Mus musculus
ttgtactagaactagctcagta

SEQ ID NO: 206406 - DNA, 23 bp, Mus musculus
gattcctcttctacggtatgtca

SEQ ID NO: 206407 - DNA, 20 bp, Mus musculus
atggagcagagcctgcttca

SEQ ID NO: 206408 - DNA, 23 bp, Mus musculus
ctttgtgtagctatggctgtcct

SEQ ID NO: 206409 - DNA, 21 bp, Mus musculus
aggctggctgcctgtaactca

SEQ ID NO: 206410 - DNA, 18 bp, Mus musculus
tacctccaagtcagcaac

SEQ ID NO: 206411 - DNA, 23 bp, Mus musculus
ctgtctcactgtctccttgtctg

SEQ ID NO: 206412 - DNA, 23 bp, Mus musculus
tctcttgtctctgggtgagtgtg

SEQ ID NO: 206413 - DNA, 19 bp, Mus musculus
ctcagtactgatgcaggag

SEQ ID NO: 206414 - DNA, 23 bp, Mus musculus
agtctgtgtgtgtgtgtgtcact

SEQ ID NO: 206415 - DNA, 23 bp, Mus musculus
tctgtctgtctgtctgtgcgtgt

SEQ ID NO: 206416 - DNA, 23 bp, Mus musculus
gtaaggtttgattgctgggtttg

SEQ ID NO: 206417 - DNA, 21 bp, Mus musculus
aatatatgtatatgtatatgt

SEQ ID NO: 206418 - DNA, 18 bp, Mus musculus
tgtgtgtgtgtgtacata

SEQ ID NO: 206419 - DNA, 23 bp, Mus musculus
ctttattgatggtggaggtgggg

SEQ ID NO: 206420 - DNA, 23 bp, Mus musculus
ttcttggctgtccttgaatttag

SEQ ID NO: 206421 - DNA, 23 bp, Mus musculus
acacaactgttttacatggtata

SEQ ID NO: 206422 - DNA, 19 bp, Mus musculus
aagagtgcttactatcggg

SEQ ID NO: 206423 - DNA, 22 bp, Mus musculus
ttcaaatctcagcaaccacatg

SEQ ID NO: 206424 - DNA, 22 bp, Mus musculus
atgtgtgttgtctctgtcactt

SEQ ID NO: 206425 - DNA, 23 bp, Mus musculus
ttagatgtgattatgatgatcta

SEQ ID NO: 206426 - DNA, 23 bp, Mus musculus
ggttgtgtgtgtgtatgtgcatg

SEQ ID NO: 206427 - DNA, 23 bp, Mus musculus
agtgtctctgtcacacttggagg

SEQ ID NO: 206428 - DNA, 21 bp, Mus musculus
atactctctcagaatatgtgc

SEQ ID NO: 206429 - DNA, 23 bp, Mus musculus
aatatgcatcatgtttagagggt

SEQ ID NO: 206430 - DNA, 23 bp, Mus musculus
ctctctgtctgtctcactttttc

SEQ ID NO: 206431 - DNA, 21 bp, Mus musculus
tcactcggtgtcactgtgcct

SEQ ID NO: 206432 - DNA, 23 bp, Mus musculus
actggtattctatgacactgatg

SEQ ID NO: 206433 - DNA, 21 bp, Mus musculus
attgttgtcttcagttcatgg

SEQ ID NO: 206434 - DNA, 22 bp, Mus musculus
acactgcctctgtcgctgctta

SEQ ID NO: 206435 - DNA, 21 bp, Mus musculus
atttcagagacagagaagtga

SEQ ID NO: 206436 - DNA, 23 bp, Mus musculus
tgagatacagtctggagatgctg

SEQ ID NO: 206437 - DNA, 22 bp, Mus musculus
acatgactgtaggtgtttgtgg

SEQ ID NO: 206438 - DNA, 23 bp, Mus musculus
agctagacttaagtagtagtatc

SEQ ID NO: 206439 - DNA, 22 bp, Mus musculus
ttactcagacagcctttctcca

SEQ ID NO: 206440 - DNA, 23 bp, Mus musculus
ttaaatgcttttgttttgccttg

SEQ ID NO: 206441 - DNA, 23 bp, Mus musculus
tttagtattacagcatgacttcc

SEQ ID NO: 206442 - DNA, 21 bp, Mus musculus
ttcaattcccagccacctaca

SEQ ID NO: 206443 - DNA, 20 bp, Mus musculus
tgtctgtgtgtatctatgcc

SEQ ID NO: 206444 - DNA, 19 bp, Mus musculus
atggagtttttgttgtact

SEQ ID NO: 206445 - DNA, 23 bp, Mus musculus
tctctgtgtctgtctgcagtctc

SEQ ID NO: 206446 - DNA, 21 bp, Mus musculus
atagcagagggactggagaga

SEQ ID NO: 206447 - DNA, 23 bp, Mus musculus
cagaagtgacagacctcacaggg

SEQ ID NO: 206448 - DNA, 23 bp, Mus musculus
taagacctttgtgtgacctcatg

SEQ ID NO: 206449 - DNA, 19 bp, Mus musculus
gtgagcctgtgagtcggtc

SEQ ID NO: 206450 - DNA, 23 bp, Mus musculus
tgtctgtctgtcggtgcctgtct

SEQ ID NO: 206451 - DNA, 23 bp, Mus musculus
cctgtgtctctgtgagatagggc

SEQ ID NO: 206452 - DNA, 21 bp, Mus musculus
tctcccactctctgagcctca

SEQ ID NO: 206453 - DNA, 21 bp, Mus musculus
cataaagtagaaagcactact

SEQ ID NO: 206454 - DNA, 23 bp, Mus musculus
tgtagtgtttcctactttatgga

SEQ ID NO: 206455 - DNA, 21 bp, Mus musculus
ccagtgctctcactttgtctt

SEQ ID NO: 206456 - DNA, 23 bp, Mus musculus
tgagagtctcattttcaactgta

SEQ ID NO: 206457 - DNA, 23 bp, Mus musculus
tctggctgtcctagaactcactc

SEQ ID NO: 206458 - DNA, 20 bp, Mus musculus
tcagcccctgtgtcttggct

SEQ ID NO: 206459 - DNA, 23 bp, Mus musculus
tcagtcagggtctctgagccctt

SEQ ID NO: 206460 - DNA, 23 bp, Mus musculus
atgtggctgccttactctgtctg

SEQ ID NO: 206461 - DNA, 23 bp, Mus musculus
ggctcactctctcactgggttgg

SEQ ID NO: 206462 - DNA, 20 bp, Mus musculus
gtgtgtgtgtgtgtatgggg

SEQ ID NO: 206463 - DNA, 23 bp, Mus musculus
atgtagtatgtatgtatgtatgt

SEQ ID NO: 206464 - DNA, 23 bp, Mus musculus
aagacaggatttttctgtgtagc

SEQ ID NO: 206465 - DNA, 20 bp, Mus musculus
tcaggttttacagtaaccag

SEQ ID NO: 206466 - DNA, 23 bp, Mus musculus
ggaaaataaagaagtgctattag

SEQ ID NO: 206467 - DNA, 21 bp, Mus musculus
ttctatggggtgtgtgtctct

SEQ ID NO: 206468 - DNA, 23 bp, Mus musculus
aacagtgcacagctctgtgacag

SEQ ID NO: 206469 - DNA, 18 bp, Mus musculus
agggggaggatgtgttct

SEQ ID NO: 206470 - DNA, 23 bp, Mus musculus
tgttcacacaccctctctgtcag

SEQ ID NO: 206471 - DNA, 23 bp, Mus musculus
gaacaagatggaagagactggca

SEQ ID NO: 206472 - DNA, 18 bp, Mus musculus
atactacttctagccttg

SEQ ID NO: 206473 - DNA, 23 bp, Mus musculus
tcacactgattctgtctcttgca

SEQ ID NO: 206474 - DNA, 22 bp, Mus musculus
gggctgtctgtgtggatgttct

SEQ ID NO: 206475 - DNA, 18 bp, Mus musculus
cactgccttatagtttaa

SEQ ID NO: 206476 - DNA, 22 bp, Mus musculus
gtatgagtcagatgtatgctgg

SEQ ID NO: 206477 - DNA, 22 bp, Mus musculus
tctgtctgtctgtcttgcatat

SEQ ID NO: 206478 - DNA, 22 bp, Mus musculus
gctgtgaacctggaagtcagag

SEQ ID NO: 206479 - DNA, 23 bp, Mus musculus
caaaactagctgtaactctctct

SEQ ID NO: 206480 - DNA, 23 bp, Mus musculus
ggcagaggtagatggatcttctg

SEQ ID NO: 206481 - DNA, 23 bp, Mus musculus
tgtgtgtatgcatgtgcatgtgt

SEQ ID NO: 206482 - DNA, 23 bp, Mus musculus
gcatgcatatgtgtatgtatgtg

SEQ ID NO: 206483 - DNA, 23 bp, Mus musculus
tgtgtgtgtgtgtgtgtgtacat

SEQ ID NO: 206484 - DNA, 23 bp, Mus musculus
tgtatgtatgcatatatgtgtgt

SEQ ID NO: 206485 - DNA, 19 bp, Mus musculus
agacttacaatccttttag

SEQ ID NO: 206486 - DNA, 23 bp, Mus musculus
aacattttcttgattggtgatgg

SEQ ID NO: 206487 - DNA, 23 bp, Mus musculus
agatcactgtgggtgatgttatt

SEQ ID NO: 206488 - DNA, 23 bp, Mus musculus
tatgtgcatatatatgtatatct

SEQ ID NO: 206489 - DNA, 20 bp, Mus musculus
tatgtgtatatatatatatg

SEQ ID NO: 206490 - DNA, 22 bp, Mus musculus
ttttgagtgacaggaagactgg

SEQ ID NO: 206491 - DNA, 22 bp, Mus musculus
tcagacttgagacactgcactt

SEQ ID NO: 206492 - DNA, 23 bp, Mus musculus
gtgtgtgtgtgtataatatatgt

SEQ ID NO: 206493 - DNA, 23 bp, Mus musculus
atgtgtgtgcatatgtatgcata

SEQ ID NO: 206494 - DNA, 23 bp, Mus musculus
tgtgtgtgcatgtgtatgtgtat

SEQ ID NO: 206495 - DNA, 23 bp, Mus musculus
acacactgtcacacacttccact

SEQ ID NO: 206496 - DNA, 22 bp, Mus musculus
atacacacgcgtatacatgtat

SEQ ID NO: 206497 - DNA, 22 bp, Mus musculus
tatatgtatgtatatgtataca

SEQ ID NO: 206498 - DNA, 23 bp, Mus musculus
tctgtctctctgaaccactgttt

SEQ ID NO: 206499 - DNA, 21 bp, Mus musculus
atccctggcagagagagaggc

SEQ ID NO: 206500 - DNA, 22 bp, Mus musculus
tttatgtatgtgtatatatgta

SEQ ID NO: 206501 - DNA, 19 bp, Mus musculus
aatgcatatatatacatgt

SEQ ID NO: 206502 - DNA, 22 bp, Mus musculus
catataatgtgacatatgtgta

SEQ ID NO: 206503 - DNA, 23 bp, Mus musculus
tctgtctctgtgagtgctagtgt

SEQ ID NO: 206504 - DNA, 22 bp, Mus musculus
tgttttgtgaccaattatatgg

SEQ ID NO: 206505 - DNA, 21 bp, Mus musculus
aggagctggagaaacggctca

SEQ ID NO: 206506 - DNA, 23 bp, Mus musculus
aacactgactgctcttccagagg

SEQ ID NO: 206507 - DNA, 22 bp, Mus musculus
tgttttgtgaccaattatatgg

SEQ ID NO: 206508 - DNA, 22 bp, Mus musculus
atatatgtatatatatatgtgt

SEQ ID NO: 206509 - DNA, 18 bp, Mus musculus
gttgtgtggctggtgttc

SEQ ID NO: 206510 - DNA, 18 bp, Mus musculus
tctgtgcctaactagtaa

SEQ ID NO: 206511 - DNA, 22 bp, Mus musculus
gtatagtttgatctttatgtga

SEQ ID NO: 206512 - DNA, 21 bp, Mus musculus
atgtatgcatacatgtgtatg

SEQ ID NO: 206513 - DNA, 23 bp, Mus musculus
tgtggaatatatacatatgtgtg

SEQ ID NO: 206514 - DNA, 23 bp, Mus musculus
tatatatgtacatacacacacac

SEQ ID NO: 206515 - DNA, 23 bp, Mus musculus
tgagtgtgcatttgtatgtgtgt

SEQ ID NO: 206516 - DNA, 23 bp, Mus musculus
aggtagtacttttcagtctgcct

SEQ ID NO: 206517 - DNA, 21 bp, Mus musculus
tccatggtggtctgataggat

SEQ ID NO: 206518 - DNA, 22 bp, Mus musculus
tgttttgtgaccaattatatgg

SEQ ID NO: 206519 - DNA, 23 bp, Mus musculus
tcttgcagagactctgttccttt

SEQ ID NO: 206520 - DNA, 18 bp, Mus musculus
tatgtatatatgtatgta

SEQ ID NO: 206521 - DNA, 22 bp, Mus musculus
gtatgtatgtatgtatgtatgt

SEQ ID NO: 206522 - DNA, 18 bp, Mus musculus
ggtagaagaaagcattag

SEQ ID NO: 206523 - DNA, 22 bp, Mus musculus
tgttttgagaccaattatatgg

SEQ ID NO: 206524 - DNA, 23 bp, Mus musculus
caattgagactctctctctctcc

SEQ ID NO: 206525 - DNA, 22 bp, Mus musculus
acaaatgcttcttgtaacgttt

SEQ ID NO: 206526 - DNA, 23 bp, Mus musculus
cttagaactcactctgcagacca

SEQ ID NO: 206527 - DNA, 22 bp, Mus musculus
aaaggcagtcagaatgctgtct

SEQ ID NO: 206528 - DNA, 23 bp, Mus musculus
gtcatctgagtgtccacacacag

SEQ ID NO: 206529 - DNA, 23 bp, Mus musculus
tgtgtgcctgtgtgcctctgtgt

SEQ ID NO: 206530 - DNA, 23 bp, Mus musculus
tgtgtgtgcctgtgtgcgtgcct

SEQ ID NO: 206531 - DNA, 23 bp, Mus musculus
tgtctgtgagtgtgtgtgtctgt

SEQ ID NO: 206532 - DNA, 23 bp, Mus musculus
gaggtagctcagtggttaggagc

SEQ ID NO: 206533 - DNA, 19 bp, Mus musculus
ctcccccatgatgatgagt

SEQ ID NO: 206534 - DNA, 18 bp, Mus musculus
aacatgcacactgtctat

SEQ ID NO: 206535 - DNA, 23 bp, Mus musculus
atatgtatgtatgtatatgtatg

SEQ ID NO: 206536 - DNA, 23 bp, Mus musculus
atatatatatgtatacacacaca

SEQ ID NO: 206537 - DNA, 23 bp, Mus musculus
gtcacactctgcctgtgaggctg

SEQ ID NO: 206538 - DNA, 23 bp, Mus musculus
agagcagacagacagcagacggg

SEQ ID NO: 206539 - DNA, 22 bp, Mus musculus
cagtctctgtctgtcaggctgg

SEQ ID NO: 206540 - DNA, 22 bp, Mus musculus
agtgtgtcagatttccctgaag

SEQ ID NO: 206541 - DNA, 19 bp, Mus musculus
gcacagactgactgtctca

SEQ ID NO: 206542 - DNA, 23 bp, Mus musculus
ttcaaatctcagcaaccacatgg

SEQ ID NO: 206543 - DNA, 20 bp, Mus musculus
atgtatgtgtacatgtgtat

SEQ ID NO: 206544 - DNA, 21 bp, Mus musculus
ttgtgtgtgtgcatatgcatg

SEQ ID NO: 206545 - DNA, 22 bp, Mus musculus
tacagattccactcagtgagtc

SEQ ID NO: 206546 - DNA, 23 bp, Mus musculus
tctgtgtgtgagtgtgtgtgtgc

SEQ ID NO: 206547 - DNA, 23 bp, Mus musculus
actgacttgctctgtgactgcca

SEQ ID NO: 206548 - DNA, 22 bp, Mus musculus
atgagtgttcttgatttcttga

SEQ ID NO: 206549 - DNA, 21 bp, Mus musculus
gagtctcaagagagtcagcag

SEQ ID NO: 206550 - DNA, 22 bp, Mus musculus
tctcaggctgtggctctgcaag

SEQ ID NO: 206551 - DNA, 23 bp, Mus musculus
aagacagtgacagtgtattcaca

SEQ ID NO: 206552 - DNA, 23 bp, Mus musculus
agagtcattggttttgtaggtgt

SEQ ID NO: 206553 - DNA, 23 bp, Mus musculus
tatgtactttgagacagtgtctc

SEQ ID NO: 206554 - DNA, 22 bp, Mus musculus
tatatatatgtgtatatgtata

SEQ ID NO: 206555 - DNA, 23 bp, Mus musculus
gggtagagtgtagcaggagttca

SEQ ID NO: 206556 - DNA, 23 bp, Mus musculus
ttggtgaggaagtagcttgtttt

SEQ ID NO: 206557 - DNA, 23 bp, Mus musculus
ctctgtgtctgtcgctcagtgtc

SEQ ID NO: 206558 - DNA, 23 bp, Mus musculus
tgtgatgacagatgagtgctacc

SEQ ID NO: 206559 - DNA, 23 bp, Mus musculus
cagcctctgtctgtctgtctgtc

SEQ ID NO: 206560 - DNA, 22 bp, Mus musculus
gatcacatacattacggatggt

SEQ ID NO: 206561 - DNA, 23 bp, Mus musculus
agcctacagaaggagctggagag

SEQ ID NO: 206562 - DNA, 23 bp, Mus musculus
cacccacactgtggctcactaga

SEQ ID NO: 206563 - DNA, 23 bp, Mus musculus
aataaggatgttcttgaattgct

SEQ ID NO: 206564 - DNA, 21 bp, Mus musculus
tctaagcctcagtctgtgtct

SEQ ID NO: 206565 - DNA, 21 bp, Mus musculus
taggtagtttcatgttgttgg

SEQ ID NO: 206566 - DNA, 23 bp, Mus musculus
aacacaacgacatcaaaccacct

SEQ ID NO: 206567 - DNA, 22 bp, Mus musculus
tcatggcagttactgcttcttg

SEQ ID NO: 206568 - DNA, 23 bp, Mus musculus
taccctgtagatccgaatttgtg

SEQ ID NO: 206569 - DNA, 22 bp, Mus musculus
tatctaggggaatatgtagttg

SEQ ID NO: 206570 - DNA, 23 bp, Mus musculus
tatgtatgtgtatatgcatgtgt

SEQ ID NO: 206571 - DNA, 21 bp, Mus musculus
tatgcatgtatatatgtgtgt

SEQ ID NO: 206572 - DNA, 23 bp, Mus musculus
tgtctctgcctctgtctctcact

SEQ ID NO: 206573 - DNA, 23 bp, Mus musculus
cagactcagtggtatatgccatg

SEQ ID NO: 206574 - DNA, 23 bp, Mus musculus
ctctctgtctgtctgtgtctgtc

SEQ ID NO: 206575 - DNA, 23 bp, Mus musculus
acgtttggaatgaagaatgttct

SEQ ID NO: 206576 - DNA, 23 bp, Mus musculus
gttattgctaatgtatatcttac

SEQ ID NO: 206577 - DNA, 19 bp, Mus musculus
tgtagagcatatatttagt

SEQ ID NO: 206578 - DNA, 22 bp, Mus musculus
actctccttctgtgtggctgct

SEQ ID NO: 206579 - DNA, 23 bp, Mus musculus
accagcaggttaagttttgggtg

SEQ ID NO: 206580 - DNA, 23 bp, Mus musculus
agtcagtgcatgacagaacttgg

SEQ ID NO: 206581 - DNA, 23 bp, Mus musculus
atctctctctgggtctctgcttc

SEQ ID NO: 206582 - DNA, 22 bp, Mus musculus
ttctctgtgtgtgaggtgccat

SEQ ID NO: 206583 - DNA, 23 bp, Mus musculus
gctcgctcgctcgctcgctcgct

SEQ ID NO: 206584 - DNA, 23 bp, Mus musculus
agcgggcactctgagtctctgag

SEQ ID NO: 206585 - DNA, 20 bp, Mus musculus
aagagcactgactgctcttc

SEQ ID NO: 206586 - DNA, 22 bp, Mus musculus
ctgtggcaggattttcagtgtg

SEQ ID NO: 206587 - DNA, 23 bp, Mus musculus
gtctgtctgtctgtctctgcatt

SEQ ID NO: 206588 - DNA, 23 bp, Mus musculus
aaggaagagtaccagcactcagg

SEQ ID NO: 206589 - DNA, 23 bp, Mus musculus
ctaactgcatgtacatctgtgtg

SEQ ID NO: 206590 - DNA, 23 bp, Mus musculus
tcacctcactgactctctgcccc

SEQ ID NO: 206591 - DNA, 21 bp, Mus musculus
tgaagagcacagagtcctgaa

SEQ ID NO: 206592 - DNA, 23 bp, Mus musculus
ctgctcagtgtgtgtctgtcacc

SEQ ID NO: 206593 - DNA, 23 bp, Mus musculus
cctttctctctctcagtttcccc

SEQ ID NO: 206594 - DNA, 18 bp, Mus musculus
tcactgacagcttagggg

SEQ ID NO: 206595 - DNA, 23 bp, Mus musculus
actgactgactgcttaagagtga

SEQ ID NO: 206596 - DNA, 23 bp, Mus musculus
tctctcgctctgtcactggcacg

SEQ ID NO: 206597 - DNA, 18 bp, Mus musculus
ttgtctctgtcttaggtc

SEQ ID NO: 206598 - DNA, 23 bp, Mus musculus
gttggtccatagaaaataagtat

SEQ ID NO: 206599 - DNA, 21 bp, Mus musculus
tgctgactgctcttccagagg

SEQ ID NO: 206600 - DNA, 21 bp, Mus musculus
gtgtgtgtgtatgtatatatg

SEQ ID NO: 206601 - DNA, 23 bp, Mus musculus
tatacaaatgtgtgtgtacatac

SEQ ID NO: 206602 - DNA, 21 bp, Mus musculus
tgcctggcaccctgtaggcca

SEQ ID NO: 206603 - DNA, 23 bp, Mus musculus
aagcatgttgtaaccattgtttg

SEQ ID NO: 206604 - DNA, 21 bp, Mus musculus
tgagcttattcagcagcaagt

SEQ ID NO: 206605 - DNA, 23 bp, Mus musculus
agtgctttgaggctctcttggca

SEQ ID NO: 206606 - DNA, 23 bp, Mus musculus
tgtctgtctgtctgtctgtgcct

SEQ ID NO: 206607 - DNA, 23 bp, Mus musculus
gggtgtgtctctgtgtgcctgtg

SEQ ID NO: 206608 - DNA, 22 bp, Mus musculus
tttctgagagcctcagttgaga

SEQ ID NO: 206609 - DNA, 22 bp, Mus musculus
tgagtgtgcaagtccatgtgga

SEQ ID NO: 206610 - DNA, 23 bp, Mus musculus
tgagttcaaattccagagatcct

SEQ ID NO: 206611 - DNA, 19 bp, Mus musculus
tgtacatatacttatgtgt

SEQ ID NO: 206612 - DNA, 22 bp, Mus musculus
atgtgtgtatgtatatgtgtgt

SEQ ID NO: 206613 - DNA, 21 bp, Mus musculus
tgtgtgtatatgtatgtgtgt

SEQ ID NO: 206614 - DNA, 22 bp, Mus musculus
tatgtatgtgtatggtgtatgt

SEQ ID NO: 206615 - DNA, 23 bp, Mus musculus
tgagtctgtctctgcctgtgaga

SEQ ID NO: 206616 - DNA, 20 bp, Mus musculus
tgagtgagtgaggtgtattt

SEQ ID NO: 206617 - DNA, 20 bp, Mus musculus
actgggtgttcttgagctct

SEQ ID NO: 206618 - DNA, 23 bp, Mus musculus
tagctagtataatgacttacggt

SEQ ID NO: 206619 - DNA, 23 bp, Mus musculus
gacactcactggctgtgtaagtt

SEQ ID NO: 206620 - DNA, 23 bp, Mus musculus
tgtgtgtctgtgtctctccatgt

SEQ ID NO: 206621 - DNA, 23 bp, Mus musculus
acagtgtgcatgaggaggtcaaa

SEQ ID NO: 206622 - DNA, 23 bp, Mus musculus
tctgtctgtctgcatgtattatg

SEQ ID NO: 206623 - DNA, 23 bp, Mus musculus
ctgggatggaaatgagagctttg

SEQ ID NO: 206624 - DNA, 22 bp, Mus musculus
cagaatcaggttttctttagtc

SEQ ID NO: 206625 - DNA, 23 bp, Mus musculus
tgtctgtctgtctgcctgcctat

SEQ ID NO: 206626 - DNA, 23 bp, Mus musculus
ccttactgtgcaaagcttcctct

SEQ ID NO: 206627 - DNA, 22 bp, Mus musculus
tgctgtaattgtgaacttgtgg

SEQ ID NO: 206628 - DNA, 23 bp, Mus musculus
atgcatatgtatgtgcatgtgca

SEQ ID NO: 206629 - DNA, 23 bp, Mus musculus
tgtatgtatgtatgtatgtatgt

SEQ ID NO: 206630 - DNA, 19 bp, Mus musculus
gacaaagatgagggagctg

SEQ ID NO: 206631 - DNA, 22 bp, Mus musculus
tgttttgtgaccaattatatgg

SEQ ID NO: 206632 - DNA, 22 bp, Mus musculus
tgtgtgtgtgtctctatttctc

SEQ ID NO: 206633 - DNA, 23 bp, Mus musculus
tgtctgtctgtctgtctgtctgt

SEQ ID NO: 206634 - DNA, 22 bp, Mus musculus
tatgtgtgtatatatgtatgtg

SEQ ID NO: 206635 - DNA, 23 bp, Mus musculus
acactctggctccctgtctattt

SEQ ID NO: 206636 - DNA, 23 bp, Mus musculus
cacctctgacagacactgaggcc

SEQ ID NO: 206637 - DNA, 23 bp, Mus musculus
tgcgtgcgtgcgtgcgtgcgtgt

SEQ ID NO: 206638 - DNA, 18 bp, Mus musculus
aaacactgcaaacccatt

SEQ ID NO: 206639 - DNA, 23 bp, Mus musculus
tgactcagaggttaagagcactg

SEQ ID NO: 206640 - DNA, 22 bp, Mus musculus
tgcagtgtatacatgtgtgtgc

SEQ ID NO: 206641 - DNA, 23 bp, Mus musculus
tgtgactccgaagtgacagggta

SEQ ID NO: 206642 - DNA, 23 bp, Mus musculus
tctgtcactcgaagtcttttgat

SEQ ID NO: 206643 - DNA, 23 bp, Mus musculus
gcctgtctgtctgtctgtctcaa

SEQ ID NO: 206644 - DNA, 23 bp, Mus musculus
agtgcaggcacacacagatctag

SEQ ID NO: 206645 - DNA, 18 bp, Mus musculus
agagcagggcgtatgctg

SEQ ID NO: 206646 - DNA, 23 bp, Mus musculus
ttttggggacttctaggttttga

SEQ ID NO: 206647 - DNA, 23 bp, Mus musculus
ggcactgactgctcttccagagg

SEQ ID NO: 206648 - DNA, 23 bp, Mus musculus
tgtctcaaagattttgaaaagtg

SEQ ID NO: 206649 - DNA, 18 bp, Mus musculus
aaagacgtgagccaccac

SEQ ID NO: 206650 - DNA, 22 bp, Mus musculus
gtcagaagagtgggagctcagg

SEQ ID NO: 206651 - DNA, 23 bp, Mus musculus
ccacactgtctgtctctgtccat

SEQ ID NO: 206652 - DNA, 23 bp, Mus musculus
tgagtacactgtagctgtacaga

SEQ ID NO: 206653 - DNA, 23 bp, Mus musculus
ttcagaggaatgttgtgtcattc

SEQ ID NO: 206654 - DNA, 23 bp, Mus musculus
cataattctccttctccaggcag

SEQ ID NO: 206655 - DNA, 23 bp, Mus musculus
atttcagaggacagagagctcta

SEQ ID NO: 206656 - DNA, 23 bp, Mus musculus
tgctacttgcttgtattgtagtt

SEQ ID NO: 206657 - DNA, 18 bp, Mus musculus
tagagattctgttttgtt

SEQ ID NO: 206658 - DNA, 22 bp, Mus musculus
tctctcagtgagattgagctga

SEQ ID NO: 206659 - DNA, 20 bp, Mus musculus
agtcactttctgtctcagta

SEQ ID NO: 206660 - DNA, 21 bp, Mus musculus
agtagactctttgttgttgtt

SEQ ID NO: 206661 - DNA, 22 bp, Mus musculus
tagtctagtaattttgttctgt

SEQ ID NO: 206662 - DNA, 23 bp, Mus musculus
gtatgtatgtatgtatgtgtgtg

SEQ ID NO: 206663 - DNA, 23 bp, Mus musculus
gatctactgcaactggatgtgca

SEQ ID NO: 206664 - DNA, 23 bp, Mus musculus
tgtgtgtgtgcatgtgtatgcac

SEQ ID NO: 206665 - DNA, 23 bp, Mus musculus
tatgtatgtatgtatgtatacac

SEQ ID NO: 206666 - DNA, 23 bp, Mus musculus
gtgtgtgtatatatatgtgtgtg

SEQ ID NO: 206667 - DNA, 22 bp, Mus musculus
gagagatctgtgtgagctgagg

SEQ ID NO: 206668 - DNA, 22 bp, Mus musculus
tgtgtagagacttgtgggtgtg

SEQ ID NO: 206669 - DNA, 22 bp, Mus musculus
aatggctgagaataagtagggt

SEQ ID NO: 206670 - DNA, 23 bp, Mus musculus
atgtgtgtatatgtatatgtgtg

SEQ ID NO: 206671 - DNA, 23 bp, Mus musculus
tatgtgtgtatatatatgtgtgt

SEQ ID NO: 206672 - DNA, 23 bp, Mus musculus
tcagtgtcactttctgaaaagac

SEQ ID NO: 206673 - DNA, 23 bp, Mus musculus
tgagctcacactgcacccactgt

SEQ ID NO: 206674 - DNA, 23 bp, Mus musculus
tctctgtctcagttacttctgtc

SEQ ID NO: 206675 - DNA, 23 bp, Mus musculus
gtctgcctctgcctctgagtgct

SEQ ID NO: 206676 - DNA, 19 bp, Mus musculus
agggggagaatactgggag

SEQ ID NO: 206677 - DNA, 23 bp, Mus musculus
tctctcacgttcactctgtcaat

SEQ ID NO: 206678 - DNA, 19 bp, Mus musculus
tatatatatgtgtatgcat

SEQ ID NO: 206679 - DNA, 21 bp, Mus musculus
tatatgcatatatatacatat

SEQ ID NO: 206680 - DNA, 23 bp, Mus musculus
ctctttgactcagtgcttctcct

SEQ ID NO: 206681 - DNA, 23 bp, Mus musculus
tgtctctgtcactgtgttgtttg

SEQ ID NO: 206682 - DNA, 23 bp, Mus musculus
gacgtgagaggtcacacagctcg

SEQ ID NO: 206683 - DNA, 19 bp, Mus musculus
gtaaagcctgttcagttgg

SEQ ID NO: 206684 - DNA, 23 bp, Mus musculus
gtcacacacacagactgcctctc

SEQ ID NO: 206685 - DNA, 23 bp, Mus musculus
tgactgattgactgtctggttta

SEQ ID NO: 206686 - DNA, 23 bp, Mus musculus
tacccactggcagaattgagcag

SEQ ID NO: 206687 - DNA, 23 bp, Mus musculus
attctcagcctgtgggcagttgc

SEQ ID NO: 206688 - DNA, 23 bp, Mus musculus
tgcatgtgagcacatgtgtatgt

SEQ ID NO: 206689 - DNA, 21 bp, Mus musculus
agaggttagagaatggctcag

SEQ ID NO: 206690 - DNA, 23 bp, Mus musculus
ttaacagcacaaaatttttggag

SEQ ID NO: 206691 - DNA, 23 bp, Mus musculus
gtctctgtatctctctgtctctg

SEQ ID NO: 206692 - DNA, 22 bp, Mus musculus
tgttttgtgaccaattatatgg

SEQ ID NO: 206693 - DNA, 23 bp, Mus musculus
tgctgagagttgtcacagagctg

SEQ ID NO: 206694 - DNA, 23 bp, Mus musculus
tgtagtgtatgcatgtatatagt

SEQ ID NO: 206695 - DNA, 23 bp, Mus musculus
tgtatgtatgtagtatatgcatg

SEQ ID NO: 206696 - DNA, 23 bp, Mus musculus
atggttgtgagtttcttgatgtg

SEQ ID NO: 206697 - DNA, 20 bp, Mus musculus
tctcctgaaagagcaaccag

SEQ ID NO: 206698 - DNA, 23 bp, Mus musculus
ttgtgcatatgtatgcatgtttg

SEQ ID NO: 206699 - DNA, 18 bp, Mus musculus
acacaggtacctatgttg

SEQ ID NO: 206700 - DNA, 23 bp, Mus musculus
ctgtctgtctgtctgtctgtctg

SEQ ID NO: 206701 - DNA, 19 bp, Mus musculus
agcaaatgggagttttgta

SEQ ID NO: 206702 - DNA, 23 bp, Mus musculus
actgtgagagagaagacagtgag

SEQ ID NO: 206703 - DNA, 23 bp, Mus musculus
tctgcgtgtgtctgtgtgttcat

SEQ ID NO: 206704 - DNA, 18 bp, Mus musculus
atgtatatgcaagtatgt

SEQ ID NO: 206705 - DNA, 22 bp, Mus musculus
tcacagcacgataatggtacca

SEQ ID NO: 206706 - DNA, 22 bp, Mus musculus
acacacacacacgcacacatat

SEQ ID NO: 206707 - DNA, 23 bp, Mus musculus
ctctgatcactgtctctgtcacc

SEQ ID NO: 206708 - DNA, 19 bp, Mus musculus
aaagcactgactgctcttc

SEQ ID NO: 206709 - DNA, 23 bp, Mus musculus
atgtgtatatatatgtatgtgct

SEQ ID NO: 206710 - DNA, 19 bp, Mus musculus
aattctcagcacccatatg

SEQ ID NO: 206711 - DNA, 23 bp, Mus musculus
tgcttgaccaagtactgctggca

SEQ ID NO: 206712 - DNA, 23 bp, Mus musculus
tgagtgatcagactgatgggtct

SEQ ID NO: 206713 - DNA, 23 bp, Mus musculus
tgccagggtcactctgtccatct

SEQ ID NO: 206714 - DNA, 22 bp, Mus musculus
ctaggaagttctgaaaacatct

SEQ ID NO: 206715 - DNA, 18 bp, Mus musculus
tgggtattgtttctggtg

SEQ ID NO: 206716 - DNA, 23 bp, Mus musculus
cacctactgtgcgtctgtctccc

SEQ ID NO: 206717 - DNA, 23 bp, Mus musculus
gttctgagccagcattgttcagg

SEQ ID NO: 206718 - DNA, 22 bp, Mus musculus
tcctggaactcactctgtagag

SEQ ID NO: 206719 - DNA, 23 bp, Mus musculus
tctctgcctctgcctttgtagtg

SEQ ID NO: 206720 - DNA, 23 bp, Mus musculus
tgtctgtctgtcaagcctgactg

SEQ ID NO: 206721 - DNA, 23 bp, Mus musculus
tctcactcagtgtttttcttgtg

SEQ ID NO: 206722 - DNA, 23 bp, Mus musculus
tcggtcactctctggctcactca

SEQ ID NO: 206723 - DNA, 19 bp, Mus musculus
ttaggaagacatatgatgt

SEQ ID NO: 206724 - DNA, 22 bp, Mus musculus
tctgactgctcttccagaggtc

SEQ ID NO: 206725 - DNA, 23 bp, Mus musculus
gtctgtctgtctatgtgagggtg

SEQ ID NO: 206726 - DNA, 23 bp, Mus musculus
tgtctgtgtgtatgtctgtgagg

SEQ ID NO: 206727 - DNA, 21 bp, Mus musculus
ttagagacagttgcgagctgc

SEQ ID NO: 206728 - DNA, 23 bp, Mus musculus
tggatcaggggcaggagagatgg

SEQ ID NO: 206729 - DNA, 23 bp, Mus musculus
tcactgggtcactggctgcctct

SEQ ID NO: 206730 - DNA, 21 bp, Mus musculus
tagagtagtgggtttcattat

SEQ ID NO: 206731 - DNA, 22 bp, Mus musculus
atacttgcttgtcatagtctct

SEQ ID NO: 206732 - DNA, 22 bp, Mus musculus
agtgagactggttttcaactga

SEQ ID NO: 206733 - DNA, 23 bp, Mus musculus
tcccagtgagagaaattagtgtg

SEQ ID NO: 206734 - DNA, 23 bp, Mus musculus
gtctctgtctgtgaaaactgtgt

SEQ ID NO: 206735 - DNA, 23 bp, Mus musculus
tccctcactgtctctctctgctt

SEQ ID NO: 206736 - DNA, 22 bp, Mus musculus
atgtatgtatgtatgtatgtac

SEQ ID NO: 206737 - DNA, 22 bp, Mus musculus
tgtatgcatgtatatatgtatg

SEQ ID NO: 206738 - DNA, 23 bp, Mus musculus
acatatgtatgcatgcatgtata

SEQ ID NO: 206739 - DNA, 22 bp, Mus musculus
tatgcatgtatgtatatatgta

SEQ ID NO: 206740 - DNA, 23 bp, Mus musculus
atatatgtatgtatgcatgtgtg

SEQ ID NO: 206741 - DNA, 21 bp, Mus musculus
atatgtatgtatgtatgtatg

SEQ ID NO: 206742 - DNA, 23 bp, Mus musculus
tgtgtgtctgtgtatgtgtctgt

SEQ ID NO: 206743 - DNA, 23 bp, Mus musculus
accaccttttgtatacatgttgc

SEQ ID NO: 206744 - DNA, 22 bp, Mus musculus
tgtgtgtgtgtgtgcacattca

SEQ ID NO: 206745 - DNA, 21 bp, Mus musculus
tggtatgtatacatgtgtgta

SEQ ID NO: 206746 - DNA, 23 bp, Mus musculus
agacttgtggctctgtctgtctg

SEQ ID NO: 206747 - DNA, 22 bp, Mus musculus
tgttttggatttcctcagaatc

SEQ ID NO: 206748 - DNA, 23 bp, Mus musculus
atttgtttcattttaaaggtact

SEQ ID NO: 206749 - DNA, 21 bp, Mus musculus
acagggtgctggttatgtgag

SEQ ID NO: 206750 - DNA, 23 bp, Mus musculus
acagacagggaatgcagtatatg

SEQ ID NO: 206751 - DNA, 20 bp, Mus musculus
tgtgaaggtgcaggactgta

SEQ ID NO: 206752 - DNA, 23 bp, Mus musculus
tgggagactgcctgcctgcctga

SEQ ID NO: 206753 - DNA, 23 bp, Mus musculus
ggaaagtatagaaggaagtgtgc

SEQ ID NO: 206754 - DNA, 23 bp, Mus musculus
tgtgtgagtgcatgtgcatgtgt

SEQ ID NO: 206755 - DNA, 22 bp, Mus musculus
caatgtgcatgtgtatgtttga

SEQ ID NO: 206756 - DNA, 21 bp, Mus musculus
ctctgttctgtggctgcaggt

SEQ ID NO: 206757 - DNA, 19 bp, Mus musculus
tgcatatgtatgtgtatgt

SEQ ID NO: 206758 - DNA, 23 bp, Mus musculus
tagtctctgtgtctctgtgtctc

SEQ ID NO: 206759 - DNA, 23 bp, Mus musculus
tcacttgacagacagacagacag

SEQ ID NO: 206760 - DNA, 20 bp, Mus musculus
tacagaagtgagacagagca

SEQ ID NO: 206761 - DNA, 23 bp, Mus musculus
atgaccatctggtaggattttgt

SEQ ID NO: 206762 - DNA, 23 bp, Mus musculus
tgcctgcctgcctgcctgaaatc

SEQ ID NO: 206763 - DNA, 18 bp, Mus musculus
agagttcaagggcagagg

SEQ ID NO: 206764 - DNA, 23 bp, Mus musculus
gtgtgtacatatgtatgtgtgtg

SEQ ID NO: 206765 - DNA, 23 bp, Mus musculus
atagtgtgtgcatatgcatatgt

SEQ ID NO: 206766 - DNA, 22 bp, Mus musculus
atgtatgtatgcatgtctgtgt

SEQ ID NO: 206767 - DNA, 23 bp, Mus musculus
caactgtctgtgactcctgcttc

SEQ ID NO: 206768 - DNA, 18 bp, Mus musculus
tgtgtgtatatatatatg

SEQ ID NO: 206769 - DNA, 23 bp, Mus musculus
tatgtgtatatatatatgtgtgt

SEQ ID NO: 206770 - DNA, 23 bp, Mus musculus
acatctgtcactctcaatgtgtt

SEQ ID NO: 206771 - DNA, 22 bp, Mus musculus
acagacacatgagtgtgcacac

SEQ ID NO: 206772 - DNA, 23 bp, Mus musculus
cagtctgtctgtctgaggtggcc

SEQ ID NO: 206773 - DNA, 21 bp, Mus musculus
atccaccacatccagctgctc

SEQ ID NO: 206774 - DNA, 23 bp, Mus musculus
ttaacagtaagaattgtttccct

SEQ ID NO: 206775 - DNA, 23 bp, Mus musculus
tttcacacgtgtctgtcacacac

SEQ ID NO: 206776 - DNA, 18 bp, Mus musculus
atacacatatgtatatgt

SEQ ID NO: 206777 - DNA, 18 bp, Mus musculus
acacatgtcatgttcttc

SEQ ID NO: 206778 - DNA, 23 bp, Mus musculus
actagagagtagaaaccagccat

SEQ ID NO: 206779 - DNA, 20 bp, Mus musculus
tatgcatatatatactgaat

SEQ ID NO: 206780 - DNA, 23 bp, Mus musculus
tgtgtcactgactctgtgccaac

SEQ ID NO: 206781 - DNA, 23 bp, Mus musculus
tcttgagcagagaattcagagag

SEQ ID NO: 206782 - DNA, 22 bp, Mus musculus
agggagctagagagatggctca

SEQ ID NO: 206783 - DNA, 23 bp, Mus musculus
tctctggctcagtctctggctca

SEQ ID NO: 206784 - DNA, 22 bp, Mus musculus
tgtcagttctctgaaagagatg

SEQ ID NO: 206785 - DNA, 23 bp, Mus musculus
aacagagagactttctccttgca

SEQ ID NO: 206786 - DNA, 21 bp, Mus musculus
aaatggacccatggaaatgtc

SEQ ID NO: 206787 - DNA, 22 bp, Mus musculus
tgttttgtgaccaattatatgg

SEQ ID NO: 206788 - DNA, 22 bp, Mus musculus
tgttttgtgaccaattatatgg

SEQ ID NO: 206789 - DNA, 20 bp, Mus musculus
ttctgctctgaatgcagtat

SEQ ID NO: 206790 - DNA, 23 bp, Mus musculus
caggtaagaagtgattgtgttgt

SEQ ID NO: 206791 - DNA, 23 bp, Mus musculus
tgtacatgatgcacatatgtgtg

SEQ ID NO: 206792 - DNA, 21 bp, Mus musculus
atgtatgtatgtatgtatata

SEQ ID NO: 206793 - DNA, 22 bp, Mus musculus
atgtatgcatgtatgtgtatgt

SEQ ID NO: 206794 - DNA, 19 bp, Mus musculus
tgtgtatgtatgtgtgtgt

SEQ ID NO: 206795 - DNA, 23 bp, Mus musculus
gtttctgtgctggtattttgtgt

SEQ ID NO: 206796 - DNA, 23 bp, Mus musculus
tgcatagattttgcgtatagtct

SEQ ID NO: 206797 - DNA, 23 bp, Mus musculus
tatttaacagtctgcagttgtag

SEQ ID NO: 206798 - DNA, 23 bp, Mus musculus
tttcagtgtctggttaaggattg

SEQ ID NO: 206799 - DNA, 18 bp, Mus musculus
taggaagccaatagcagg

SEQ ID NO: 206800 - DNA, 23 bp, Mus musculus
atgtctatgtgcatgtgtattgg

SEQ ID NO: 206801 - DNA, 20 bp, Mus musculus
tatacaggtacatatacata

SEQ ID NO: 206802 - DNA, 23 bp, Mus musculus
atgagtgtgtgcaagtgcatgtg

SEQ ID NO: 206803 - DNA, 23 bp, Mus musculus
ttgtatatgtgtatgtgtatata

SEQ ID NO: 206804 - DNA, 22 bp, Mus musculus
tatatgatgtatataaatgtgt

SEQ ID NO: 206805 - DNA, 22 bp, Mus musculus
atgtgcaatgtatatgtgcata

SEQ ID NO: 206806 - DNA, 23 bp, Mus musculus
tgaactatcttgttgatcattgt

SEQ ID NO: 206807 - DNA, 23 bp, Mus musculus
cctgctctctgagtgtgtgtgaa

SEQ ID NO: 206808 - DNA, 22 bp, Mus musculus
tgttttgtgaccaattatatgg

SEQ ID NO: 206809 - DNA, 22 bp, Mus musculus
tgtgtgtgtgtttaaaacatgt

SEQ ID NO: 206810 - DNA, 19 bp, Mus musculus
atgtacatatgaatgtatg

SEQ ID NO: 206811 - DNA, 22 bp, Mus musculus
actgatgattgaaagctctgtg

SEQ ID NO: 206812 - DNA, 23 bp, Mus musculus
actctgaaagcatctcttgccta

SEQ ID NO: 206813 - DNA, 23 bp, Mus musculus
tttatgtttgatttgctaggagt

SEQ ID NO: 206814 - DNA, 23 bp, Mus musculus
atgagtatgtatatgtatgtgta

SEQ ID NO: 206815 - DNA, 23 bp, Mus musculus
atagagacagcctggtattattg

SEQ ID NO: 206816 - DNA, 22 bp, Mus musculus
agacaggaatgagagcacagat

SEQ ID NO: 206817 - DNA, 23 bp, Mus musculus
tgactcagaggttaagagcactg

SEQ ID NO: 206818 - DNA, 23 bp, Mus musculus
tctgtctatctgtctctctctct

SEQ ID NO: 206819 - DNA, 21 bp, Mus musculus
taactctggaatagcatccct

SEQ ID NO: 206820 - DNA, 23 bp, Mus musculus
atcatctgtgtccatgaagagag

SEQ ID NO: 206821 - DNA, 23 bp, Mus musculus
ctgtctgtaactttgttccaggg

SEQ ID NO: 206822 - DNA, 23 bp, Mus musculus
gcttgcatatgtaagcttacgca

SEQ ID NO: 206823 - DNA, 22 bp, Mus musculus
tgtggatgaatatatatttgtg

SEQ ID NO: 206824 - DNA, 18 bp, Mus musculus
aggtcaccttttgttggg

SEQ ID NO: 206825 - DNA, 23 bp, Mus musculus
tgaaatcatgctagactctgccc

SEQ ID NO: 206826 - DNA, 21 bp, Mus musculus
agacaggaggcaagtgactga

SEQ ID NO: 206827 - DNA, 19 bp, Mus musculus
tgtgtgtgtgtgtgtgtgc

SEQ ID NO: 206828 - DNA, 23 bp, Mus musculus
catgtgcctgtctggctgaatgg

SEQ ID NO: 206829 - DNA, 23 bp, Mus musculus
tttatttcaggtgagtgtgcaca

SEQ ID NO: 206830 - DNA, 19 bp, Mus musculus
agtcagtgactcattgtcc

SEQ ID NO: 206831 - DNA, 23 bp, Mus musculus
atatgtgtgtgtatatgtatatg

SEQ ID NO: 206832 - DNA, 23 bp, Mus musculus
aagatcactgactgctcttccag

SEQ ID NO: 206833 - DNA, 23 bp, Mus musculus
tatgtatgtatatatgtgtgtgt

SEQ ID NO: 206834 - DNA, 18 bp, Mus musculus
tgagaccaacagcttggc

SEQ ID NO: 206835 - DNA, 22 bp, Mus musculus
ctctgtgtctgtgtccgtgcct

SEQ ID NO: 206836 - DNA, 23 bp, Mus musculus
ttccagatcagagtgagctaact

SEQ ID NO: 206837 - DNA, 19 bp, Mus musculus
taggaagtagaggcaggct

SEQ ID NO: 206838 - DNA, 23 bp, Mus musculus
tgtctttgtcagtctctcaccat

SEQ ID NO: 206839 - DNA, 23 bp, Mus musculus
gtgtatgtgcatgtgcatgtgca

SEQ ID NO: 206840 - DNA, 23 bp, Mus musculus
tgtatatgcatgtgcatgtgtat

SEQ ID NO: 206841 - DNA, 23 bp, Mus musculus
tgttcatatgtatgtatgtatgt

SEQ ID NO: 206842 - DNA, 20 bp, Mus musculus
ctatatgtacataatgcatg

SEQ ID NO: 206843 - DNA, 22 bp, Mus musculus
ctctagtgggcagacactctct

SEQ ID NO: 206844 - DNA, 23 bp, Mus musculus
tgttcatgtgccaggcactgtgc

SEQ ID NO: 206845 - DNA, 23 bp, Mus musculus
atcacagtggctatgttgtgcta

SEQ ID NO: 206846 - DNA, 21 bp, Mus musculus
tgtgtgtgcatgtgcatgcac

SEQ ID NO: 206847 - DNA, 23 bp, Mus musculus
tgtatgtgtgcatgagcatgtgt

SEQ ID NO: 206848 - DNA, 23 bp, Mus musculus
catgtgtgtgttcatgtgtgtgc

SEQ ID NO: 206849 - DNA, 23 bp, Mus musculus
atgtgtgtgtgtgtgcatgtgta

SEQ ID NO: 206850 - DNA, 23 bp, Mus musculus
tgtgtgtgtgtctgtctgtctgt

SEQ ID NO: 206851 - DNA, 20 bp, Mus musculus
tagatctgatgctggacttg

SEQ ID NO: 206852 - DNA, 20 bp, Mus musculus
aggcagttgtgagtcaccac

SEQ ID NO: 206853 - DNA, 18 bp, Mus musculus
aaaggttctgagttcaaa

SEQ ID NO: 206854 - DNA, 20 bp, Mus musculus
tatgtagaccaggctgtcct

SEQ ID NO: 206855 - DNA, 21 bp, Mus musculus
tcggacactggctccctctgt

SEQ ID NO: 206856 - DNA, 22 bp, Mus musculus
aagggcagtgttgactttctgt

SEQ ID NO: 206857 - DNA, 23 bp, Mus musculus
tgacaggacacactgagtgactc

SEQ ID NO: 206858 - DNA, 19 bp, Mus musculus
acagtgcctgtgacagtgc

SEQ ID NO: 206859 - DNA, 23 bp, Mus musculus
ccagtgtcccaaaatgtttccaa

SEQ ID NO: 206860 - DNA, 21 bp, Mus musculus
tgcagagtcctattgctgtgt

SEQ ID NO: 206861 - DNA, 23 bp, Mus musculus
tataagcatgcatatgtgtgtgt

SEQ ID NO: 206862 - DNA, 22 bp, Mus musculus
atacatgtatatatcatatgca

SEQ ID NO: 206863 - DNA, 19 bp, Mus musculus
aagagattagagggagggt

SEQ ID NO: 206864 - DNA, 23 bp, Mus musculus
tcagtgcctccacactgtctgtc

SEQ ID NO: 206865 - DNA, 23 bp, Mus musculus
tgtatgtgattgtgtatatgtgt

SEQ ID NO: 206866 - DNA, 23 bp, Mus musculus
tatgtatgtatgtacgtgtacat

SEQ ID NO: 206867 - DNA, 23 bp, Mus musculus
acacttggagaccctctcttgtg

SEQ ID NO: 206868 - DNA, 23 bp, Mus musculus
aagatgtctggaactgctaagga

SEQ ID NO: 206869 - DNA, 22 bp, Mus musculus
ctcttgatcttccacaccttgt

SEQ ID NO: 206870 - DNA, 22 bp, Mus musculus
aagggagtgtggtaaggtggtt

SEQ ID NO: 206871 - DNA, 23 bp, Mus musculus
agatcagagagctcagtgaggcc

SEQ ID NO: 206872 - DNA, 22 bp, Mus musculus
acacacagtgtcatagtgtata

SEQ ID NO: 206873 - DNA, 23 bp, Mus musculus
tttgtattcaaaagagagtgtag

SEQ ID NO: 206874 - DNA, 23 bp, Mus musculus
atgagagtacacagtgtgcaggt

SEQ ID NO: 206875 - DNA, 23 bp, Mus musculus
tgtctgtctgtctgtctgtctgc

SEQ ID NO: 206876 - DNA, 23 bp, Mus musculus
tcacactctcagcctaagccact

SEQ ID NO: 206877 - DNA, 22 bp, Mus musculus
tagacagttgtgaggcaccact

SEQ ID NO: 206878 - DNA, 23 bp, Mus musculus
tgctctggtccttctggtggctc

SEQ ID NO: 206879 - DNA, 23 bp, Mus musculus
tgtctgtctgtttgctttgggta

SEQ ID NO: 206880 - DNA, 21 bp, Mus musculus
tgtgtgcctgtgtgcgtgtgt

SEQ ID NO: 206881 - DNA, 19 bp, Mus musculus
cattaagattggtgtatgt

SEQ ID NO: 206882 - DNA, 23 bp, Mus musculus
tctgtctgtctgtgtaccatgta

SEQ ID NO: 206883 - DNA, 23 bp, Mus musculus
tctctgacactggctcagtgcag

SEQ ID NO: 206884 - DNA, 23 bp, Mus musculus
tctgtcacacactcccaggtcat

SEQ ID NO: 206885 - DNA, 23 bp, Mus musculus
tgtgtctgtgtctgtctatgtgc

SEQ ID NO: 206886 - DNA, 18 bp, Mus musculus
ttagatcgtcgtgtggta

SEQ ID NO: 206887 - DNA, 23 bp, Mus musculus
tgtgtgtgtgtgcatgtgcatgt

SEQ ID NO: 206888 - DNA, 23 bp, Mus musculus
gggtgtgtctgtctgtctgtctg

SEQ ID NO: 206889 - DNA, 23 bp, Mus musculus
tgagtgtctccctcagtcactct

SEQ ID NO: 206890 - DNA, 23 bp, Mus musculus
tatctgtctgtgtccgtgtgtgt

SEQ ID NO: 206891 - DNA, 23 bp, Mus musculus
ttatgtgtttgggcattgtgact

SEQ ID NO: 206892 - DNA, 19 bp, Mus musculus
acctgaggcacagttcttg

SEQ ID NO: 206893 - DNA, 23 bp, Mus musculus
gacagctctgtctgtgtctctgc

SEQ ID NO: 206894 - DNA, 23 bp, Mus musculus
ctctgggctctgagtcactgtca

SEQ ID NO: 206895 - DNA, 19 bp, Mus musculus
tgccagagtgcctgtctcc

SEQ ID NO: 206896 - DNA, 23 bp, Mus musculus
agctctgtagtagggtttctgtg

SEQ ID NO: 206897 - DNA, 23 bp, Mus musculus
ccctggctctgtgtgtgtgtgcg

SEQ ID NO: 206898 - DNA, 23 bp, Mus musculus
ttgttctcactgggtctgttctg

SEQ ID NO: 206899 - DNA, 23 bp, Mus musculus
ctctgcctcagtccctgcctgtg

SEQ ID NO: 206900 - DNA, 22 bp, Mus musculus
tcagaaccagcagtactgagag

SEQ ID NO: 206901 - DNA, 23 bp, Mus musculus
gacaccctcactcactgtttctt

SEQ ID NO: 206902 - DNA, 23 bp, Mus musculus
catgtgtgtgcatgtgcatgtgg

SEQ ID NO: 206903 - DNA, 19 bp, Mus musculus
acatgtgtgccatacatgt

SEQ ID NO: 206904 - DNA, 23 bp, Mus musculus
cagtctctctttgtctctgtggt

SEQ ID NO: 206905 - DNA, 23 bp, Mus musculus
tgtcactctctctgcctgggata

SEQ ID NO: 206906 - DNA, 23 bp, Mus musculus
ggcacaggcagtcacagtctgtc

SEQ ID NO: 206907 - DNA, 22 bp, Mus musculus
catcctgtgtccctccctctca

SEQ ID NO: 206908 - DNA, 23 bp, Mus musculus
aggctcgctctgtctctgtctct

SEQ ID NO: 206909 - DNA, 23 bp, Mus musculus
gtacagactgcctcacttcaggc

SEQ ID NO: 206910 - DNA, 23 bp, Mus musculus
tatatgcatatatatatgtatgt

SEQ ID NO: 206911 - DNA, 21 bp, Mus musculus
cagtcagtagacagtgaggac

SEQ ID NO: 206912 - DNA, 23 bp, Mus musculus
gctcgctcgctcgctcgctcaga

SEQ ID NO: 206913 - DNA, 18 bp, Mus musculus
gctacatagtcagactct

SEQ ID NO: 206914 - DNA, 18 bp, Mus musculus
tctcaaagtcaggcctgt

SEQ ID NO: 206915 - DNA, 23 bp, Mus musculus
actcacacactgccaatgtcagg

SEQ ID NO: 206916 - DNA, 22 bp, Mus musculus
gtgtgtgtgtgtgtgtgcatgc

SEQ ID NO: 206917 - DNA, 20 bp, Mus musculus
catgtgcatgtatacatgtg

SEQ ID NO: 206918 - DNA, 23 bp, Mus musculus
tgtctgtctgtctgtctgcctgt

SEQ ID NO: 206919 - DNA, 22 bp, Mus musculus
taacagtgaatatgctcggtca

SEQ ID NO: 206920 - DNA, 23 bp, Mus musculus
tctgtccgtctgtccgtgtggct

SEQ ID NO: 206921 - DNA, 18 bp, Mus musculus
tgtgtagaccaggctgac

SEQ ID NO: 206922 - DNA, 20 bp, Mus musculus
agtcacagcatttccaagag

SEQ ID NO: 206923 - DNA, 23 bp, Mus musculus
aggctcagtcaggctgtcagagc

SEQ ID NO: 206924 - DNA, 19 bp, Mus musculus
ttaaggaatcattacaaag

SEQ ID NO: 206925 - DNA, 20 bp, Mus musculus
agactgcttcctaattctct

SEQ ID NO: 206926 - DNA, 23 bp, Mus musculus
cagatctgtctctctgtgaggta

SEQ ID NO: 206927 - DNA, 23 bp, Mus musculus
gagtctgtctgtctgtctaggtt

SEQ ID NO: 206928 - DNA, 22 bp, Mus musculus
tagtggtttctttatcctgtac

SEQ ID NO: 206929 - DNA, 23 bp, Mus musculus
aggagagagtggacagtgagcac

SEQ ID NO: 206930 - DNA, 23 bp, Mus musculus
agtttgtgactacagaccccgtg

SEQ ID NO: 206931 - DNA, 22 bp, Mus musculus
ttagcttgcacatacacatata

SEQ ID NO: 206932 - DNA, 23 bp, Mus musculus
tcagcaaagctatgtactgtgta

SEQ ID NO: 206933 - DNA, 20 bp, Mus musculus
tgactgtagacagagaccac

SEQ ID NO: 206934 - DNA, 19 bp, Mus musculus
tctgtgcctttgtctcagt

SEQ ID NO: 206935 - DNA, 22 bp, Mus musculus
cagttacctgactgagcacaca

SEQ ID NO: 206936 - DNA, 21 bp, Mus musculus
ttcaggctggcagttatatct

SEQ ID NO: 206937 - DNA, 23 bp, Mus musculus
tgccactgagtcactgagtctct

SEQ ID NO: 206938 - DNA, 23 bp, Mus musculus
tccgagcagtgagtgctgacaca

SEQ ID NO: 206939 - DNA, 19 bp, Mus musculus
ctcagatgacagggagcag

SEQ ID NO: 206940 - DNA, 23 bp, Mus musculus
tttttcttgagactgggtttctt

SEQ ID NO: 206941 - DNA, 22 bp, Mus musculus
tgtgcatgcattatacatgtat

SEQ ID NO: 206942 - DNA, 23 bp, Mus musculus
atgtatatatatgtatatgtgtg

SEQ ID NO: 206943 - DNA, 22 bp, Mus musculus
ttggaccttctatcccagctct

SEQ ID NO: 206944 - DNA, 23 bp, Mus musculus
tcctgttcagtcacactgactcc

SEQ ID NO: 206945 - DNA, 23 bp, Mus musculus
tcagcctctcactccctccatgc

SEQ ID NO: 206946 - DNA, 21 bp, Mus musculus
tgcctgcctgcctgcctgcca

SEQ ID NO: 206947 - DNA, 20 bp, Mus musculus
atacatcatgggctggagag

SEQ ID NO: 206948 - DNA, 23 bp, Mus musculus
agcctgagtcctgatgtgtccct

SEQ ID NO: 206949 - DNA, 23 bp, Mus musculus
tcaagacacagacagacactctg

SEQ ID NO: 206950 - DNA, 21 bp, Mus musculus
tcacagtcaccctaggtttac

SEQ ID NO: 206951 - DNA, 22 bp, Mus musculus
atctcacccagctttgtagagc

SEQ ID NO: 206952 - DNA, 23 bp, Mus musculus
acaccttatgaataggagcagta

SEQ ID NO: 206953 - DNA, 23 bp, Mus musculus
tgtctgtctgtctgtctatctgt

SEQ ID NO: 206954 - DNA, 20 bp, Mus musculus
tgacttgatattgaaatgct

SEQ ID NO: 206955 - DNA, 23 bp, Mus musculus
gaacagactgctcttccagaggt

SEQ ID NO: 206956 - DNA, 21 bp, Mus musculus
taagagcactgactgctcttc

SEQ ID NO: 206957 - DNA, 23 bp, Mus musculus
atgttgactacatgatgtgtgaa

SEQ ID NO: 206958 - DNA, 23 bp, Mus musculus
taagagcactgactgctcttcca

SEQ ID NO: 206959 - DNA, 21 bp, Mus musculus
tcagtgcctgtctcagtgcct

SEQ ID NO: 206960 - DNA, 23 bp, Mus musculus
atgtctattgttcttgttcagct

SEQ ID NO: 206961 - DNA, 21 bp, Mus musculus
tggctatcttttgtgaatgtt

SEQ ID NO: 206962 - DNA, 23 bp, Mus musculus
ttacagacagttgtgagccacca

SEQ ID NO: 206963 - DNA, 23 bp, Mus musculus
tcagtctgtgactcacttgtccc

SEQ ID NO: 206964 - DNA, 23 bp, Mus musculus
gtagttatgtttctaaaggtatg

SEQ ID NO: 206965 - DNA, 23 bp, Mus musculus
agtctgtctgcttctctctgtgt

SEQ ID NO: 206966 - DNA, 23 bp, Mus musculus
acatatacatatgtgtgtctata

SEQ ID NO: 206967 - DNA, 23 bp, Mus musculus
tagcatttcaagaagtatctgtc

SEQ ID NO: 206968 - DNA, 20 bp, Mus musculus
tggctcagtggttaggagca

SEQ ID NO: 206969 - DNA, 21 bp, Mus musculus
tcaggtgcttcctgcttctct

SEQ ID NO: 206970 - DNA, 22 bp, Mus musculus
tgctggctcagtcactcacagt

SEQ ID NO: 206971 - DNA, 21 bp, Mus musculus
tgtcttgaacttcatccctag

SEQ ID NO: 206972 - DNA, 19 bp, Mus musculus
aaaagtcctttcattggag

SEQ ID NO: 206973 - DNA, 22 bp, Mus musculus
gttatcaaaagctgctgtagag

SEQ ID NO: 206974 - DNA, 23 bp, Mus musculus
atatgaatgctctctctctgtgt

SEQ ID NO: 206975 - DNA, 19 bp, Mus musculus
tatagtgtgtgtgtacatg

SEQ ID NO: 206976 - DNA, 21 bp, Mus musculus
tgacagcacttagtgacctca

SEQ ID NO: 206977 - DNA, 22 bp, Mus musculus
agtgagaagacagtctggggac

SEQ ID NO: 206978 - DNA, 20 bp, Mus musculus
gcatgcatgcatgtgtgtgt

SEQ ID NO: 206979 - DNA, 23 bp, Mus musculus
acagacagcagtgttctgactgg

SEQ ID NO: 206980 - DNA, 18 bp, Mus musculus
tagtccttgtagggctgg

SEQ ID NO: 206981 - DNA, 21 bp, Mus musculus
cccggtgactctgtgactctg

SEQ ID NO: 206982 - DNA, 23 bp, Mus musculus
tccagcatcagtgattttgttga

SEQ ID NO: 206983 - DNA, 23 bp, Mus musculus
aacagcactgactgctcttccag

SEQ ID NO: 206984 - DNA, 23 bp, Mus musculus
tgcacagcatcttctgcagcagc

SEQ ID NO: 206985 - DNA, 18 bp, Mus musculus
ctgtctctgcctccctgt

SEQ ID NO: 206986 - DNA, 23 bp, Mus musculus
ctggctgcctgcctgcctgcctg

SEQ ID NO: 206987 - DNA, 23 bp, Mus musculus
agctcactgtgagcttacagctg

SEQ ID NO: 206988 - DNA, 23 bp, Mus musculus
ctctgtgtctctgtctctgtctg

SEQ ID NO: 206989 - DNA, 23 bp, Mus musculus
gagcctgtctcgctcagactcac

SEQ ID NO: 206990 - DNA, 23 bp, Mus musculus
caccacagtgtctgtgtcactca

SEQ ID NO: 206991 - DNA, 23 bp, Mus musculus
tctctgtctgtctgtctgtttcc

SEQ ID NO: 206992 - DNA, 21 bp, Mus musculus
actgtgagtctctgtttctgc

SEQ ID NO: 206993 - DNA, 22 bp, Mus musculus
tgtgactgagtgtatgtcgtgt

SEQ ID NO: 206994 - DNA, 19 bp, Mus musculus
gggtctctctctctctcat

SEQ ID NO: 206995 - DNA, 22 bp, Mus musculus
atgtatgtgtatacgtatacgt

SEQ ID NO: 206996 - DNA, 22 bp, Mus musculus
tatatgatgtatatgtatatgt

SEQ ID NO: 206997 - DNA, 21 bp, Mus musculus
ttctgcatgtgcatgtgtatg

SEQ ID NO: 206998 - DNA, 22 bp, Mus musculus
ttcacctttacatcagttctga

SEQ ID NO: 206999 - DNA, 20 bp, Mus musculus
tgaggaattttttatttttg

SEQ ID NO: 207000 - DNA, 23 bp, Mus musculus
tgtgtgcctgtgtgcttgtatgc

SEQ ID NO: 207001 - DNA, 23 bp, Mus musculus
tgcctgtgtgcctgtgtgcctgg

SEQ ID NO: 207002 - DNA, 21 bp, Mus musculus
tgtgtgagtctactggtatgt

SEQ ID NO: 207003 - DNA, 23 bp, Mus musculus
tgcctgtgtgcctgtgtccctgt

SEQ ID NO: 207004 - DNA, 23 bp, Mus musculus
tctgcctgtcactgaatctagag

SEQ ID NO: 207005 - DNA, 23 bp, Mus musculus
atgtatgtatatttgtatgtatg

SEQ ID NO: 207006 - DNA, 23 bp, Mus musculus
tctgagaagcctgtgtggtcagg

SEQ ID NO: 207007 - DNA, 19 bp, Mus musculus
cagggactgagtcaggccc

SEQ ID NO: 207008 - DNA, 23 bp, Mus musculus
acaagagcctctgagagcctcag

SEQ ID NO: 207009 - DNA, 23 bp, Mus musculus
ctgggatacactgtcagtctcat

SEQ ID NO: 207010 - DNA, 23 bp, Mus musculus
acaagtgagtctgttgttccaag

SEQ ID NO: 207011 - DNA, 23 bp, Mus musculus
cagtggagttcagagtgagcaca

SEQ ID NO: 207012 - DNA, 23 bp, Mus musculus
tggctggctggctgactggctgt

SEQ ID NO: 207013 - DNA, 23 bp, Mus musculus
cacctgctgtgtctctgcctgtc

SEQ ID NO: 207014 - DNA, 21 bp, Mus musculus
tttcagtttgatgtttgcttc

SEQ ID NO: 207015 - DNA, 23 bp, Mus musculus
aggaggagctctgagatgagtgt

SEQ ID NO: 207016 - DNA, 19 bp, Mus musculus
gacagcctctctgtctgat

SEQ ID NO: 207017 - DNA, 23 bp, Mus musculus
catgtatggctctgtgtgtgtgt

SEQ ID NO: 207018 - DNA, 23 bp, Mus musculus
tggtgactgaagacagggtccag

SEQ ID NO: 207019 - DNA, 23 bp, Mus musculus
tcaggttggctctgaactctggt

SEQ ID NO: 207020 - DNA, 23 bp, Mus musculus
tttcacagcctgcttccagctgc

SEQ ID NO: 207021 - DNA, 21 bp, Mus musculus
tttaggactccgagaaaggag

SEQ ID NO: 207022 - DNA, 23 bp, Mus musculus
gggactagagagacagctcagca

SEQ ID NO: 207023 - DNA, 23 bp, Mus musculus
tatatgcatgtatttatatctat

SEQ ID NO: 207024 - DNA, 23 bp, Mus musculus
ttctagtgagtctttctgtctcc

SEQ ID NO: 207025 - DNA, 23 bp, Mus musculus
cactgtctctccctctggctggg

SEQ ID NO: 207026 - DNA, 20 bp, Mus musculus
tgactcccagctaaggaggt

SEQ ID NO: 207027 - DNA, 19 bp, Mus musculus
gtgtcatgtctgggtggag

SEQ ID NO: 207028 - DNA, 23 bp, Mus musculus
ctcaagctctggggctggagaga

SEQ ID NO: 207029 - DNA, 23 bp, Mus musculus
aagagcactgactgctcttccag

SEQ ID NO: 207030 - DNA, 23 bp, Mus musculus
tgttgagacaagacactcacctg

SEQ ID NO: 207031 - DNA, 23 bp, Mus musculus
tctgtctctgtctctatctctct

SEQ ID NO: 207032 - DNA, 23 bp, Mus musculus
cagtccctgtctcggtctcatga

SEQ ID NO: 207033 - DNA, 23 bp, Mus musculus
ctctctcactcactccctaggtc

SEQ ID NO: 207034 - DNA, 20 bp, Mus musculus
tgcccctggaagagatcagt

SEQ ID NO: 207035 - DNA, 23 bp, Mus musculus
ctataactgtgaggtatagccct

SEQ ID NO: 207036 - DNA, 23 bp, Mus musculus
tgacagacccttttttttgagtt

SEQ ID NO: 207037 - DNA, 23 bp, Mus musculus
agacagggtttctctgtgtatcc

SEQ ID NO: 207038 - DNA, 22 bp, Mus musculus
cactctgtgggtgctcaggtgc

SEQ ID NO: 207039 - DNA, 22 bp, Mus musculus
taaaacttcccttttcttttct

SEQ ID NO: 207040 - DNA, 23 bp, Mus musculus
tctgtctctctctctgagctgcc

SEQ ID NO: 207041 - DNA, 20 bp, Mus musculus
tgagagcagacagtgagctc

SEQ ID NO: 207042 - DNA, 21 bp, Mus musculus
ttagaactgcccactgtggtg

SEQ ID NO: 207043 - DNA, 23 bp, Mus musculus
ctcagcatctccaagtggtagtc

SEQ ID NO: 207044 - DNA, 23 bp, Mus musculus
gaggctgactctgtgtctcgacc

SEQ ID NO: 207045 - DNA, 23 bp, Mus musculus
tggcagcttgtgacgctcgcaca

SEQ ID NO: 207046 - DNA, 23 bp, Mus musculus
tctgagcctgtgtgtgtgtctgt

SEQ ID NO: 207047 - DNA, 23 bp, Mus musculus
tgctcagactctgtctcaaaatc

SEQ ID NO: 207048 - DNA, 19 bp, Mus musculus
gtatgtaagcatgtgtgtg

SEQ ID NO: 207049 - DNA, 23 bp, Mus musculus
acggtgcacagacagatatgtgg

SEQ ID NO: 207050 - DNA, 23 bp, Mus musculus
tgctctgtcactctgtcactctc

SEQ ID NO: 207051 - DNA, 18 bp, Mus musculus
tgcttgaatcaagttctt

SEQ ID NO: 207052 - DNA, 23 bp, Mus musculus
tacacacacatatgcatgcttat

SEQ ID NO: 207053 - DNA, 23 bp, Mus musculus
tatgtatgtctaaagggttgtgt

SEQ ID NO: 207054 - DNA, 20 bp, Mus musculus
tctcaggtgcacacatacat

SEQ ID NO: 207055 - DNA, 23 bp, Mus musculus
tcagagagtaatgagacagtaca

SEQ ID NO: 207056 - DNA, 23 bp, Mus musculus
ttgtctctccgtgtgtgtgcacg

SEQ ID NO: 207057 - DNA, 22 bp, Mus musculus
tcaggtgcacacatacatgtgg

SEQ ID NO: 207058 - DNA, 23 bp, Mus musculus
tcagagagtaatgagacagtaca

SEQ ID NO: 207059 - DNA, 23 bp, Mus musculus
ttgtctctccgtgtgtgtgcacg

SEQ ID NO: 207060 - DNA, 22 bp, Mus musculus
tcaggtgcacacatacatgtgg

SEQ ID NO: 207061 - DNA, 23 bp, Mus musculus
tcagagagtaatgagacagtaca

SEQ ID NO: 207062 - DNA, 23 bp, Mus musculus
ttgtctctccgtgtgtgtgcacg

SEQ ID NO: 207063 - DNA, 22 bp, Mus musculus
tcaggtgcacacatacatgtgg

SEQ ID NO: 207064 - DNA, 23 bp, Mus musculus
ttgcctcactgtctatcactctg

SEQ ID NO: 207065 - DNA, 23 bp, Mus musculus
tctcagtttctgtttgaccctca

SEQ ID NO: 207066 - DNA, 23 bp, Mus musculus
tgaccctctctgagtgggtctca

SEQ ID NO: 207067 - DNA, 23 bp, Mus musculus
ttctgacacactcagattcataa

SEQ ID NO: 207068 - DNA, 22 bp, Mus musculus
agaggaactttgtgtgtggaga

SEQ ID NO: 207069 - DNA, 21 bp, Mus musculus
atctgtctatctatctgtctg

SEQ ID NO: 207070 - DNA, 21 bp, Mus musculus
agagttctaccacaaagcaga

SEQ ID NO: 207071 - DNA, 18 bp, Mus musculus
tagcaagggactgcgtga

SEQ ID NO: 207072 - DNA, 23 bp, Mus musculus
gtgtctctgagtgggtctgtgcc

SEQ ID NO: 207073 - DNA, 22 bp, Mus musculus
aatgttatcacagaaacctgat

SEQ ID NO: 207074 - DNA, 23 bp, Mus musculus
agacagaagacagacagcaacag

SEQ ID NO: 207075 - DNA, 18 bp, Mus musculus
gtatgtatagatgtctgt

SEQ ID NO: 207076 - DNA, 22 bp, Mus musculus
tgtatgtgtagatgtatgtgca

SEQ ID NO: 207077 - DNA, 23 bp, Mus musculus
tgagtctctctctctaacgggta

SEQ ID NO: 207078 - DNA, 23 bp, Mus musculus
atgtatgtatatatgtatgtatg

SEQ ID NO: 207079 - DNA, 23 bp, Mus musculus
tctctctgtatctctctctctgt

SEQ ID NO: 207080 - DNA, 23 bp, Mus musculus
gtgacagatacttttgagtctgt

SEQ ID NO: 207081 - DNA, 22 bp, Mus musculus
tctctgtgagtttatctgtgag

SEQ ID NO: 207082 - DNA, 23 bp, Mus musculus
ttaagagcactgactgctcttcc

SEQ ID NO: 207083 - DNA, 23 bp, Mus musculus
gagtctcactctgggtcagtctg

SEQ ID NO: 207084 - DNA, 23 bp, Mus musculus
agtgagtatgtgtgtgtgtatct

SEQ ID NO: 207085 - DNA, 20 bp, Mus musculus
acagcttcttggtgagggtg

SEQ ID NO: 207086 - DNA, 23 bp, Mus musculus
tgtgtatatatgcatatgtgatg

SEQ ID NO: 207087 - DNA, 23 bp, Mus musculus
tgatgttaatgatgaatggacaa

SEQ ID NO: 207088 - DNA, 23 bp, Mus musculus
cgttttgagtggaatcctgtctg

SEQ ID NO: 207089 - DNA, 19 bp, Mus musculus
aggcagagaggttttgact

SEQ ID NO: 207090 - DNA, 21 bp, Mus musculus
aaggacttgttagcagtgtga

SEQ ID NO: 207091 - DNA, 23 bp, Mus musculus
gagtggatagtcactgcctgtcc

SEQ ID NO: 207092 - DNA, 23 bp, Mus musculus
tacatgtatgtatgcacgtgtgt

SEQ ID NO: 207093 - DNA, 23 bp, Mus musculus
atgtgtgtgtgtgcatgtgcatg

SEQ ID NO: 207094 - DNA, 22 bp, Mus musculus
ccatccttgattcctgccctgt

SEQ ID NO: 207095 - DNA, 23 bp, Mus musculus
gtctgtgtagtatgtatgtatgt

SEQ ID NO: 207096 - DNA, 23 bp, Mus musculus
gtattgcatgtgaatgccatagc

SEQ ID NO: 207097 - DNA, 19 bp, Mus musculus
tgtgtgcctgtgtgtatac

SEQ ID NO: 207098 - DNA, 23 bp, Mus musculus
gtctgtgtctgtgtctgtgtatg

SEQ ID NO: 207099 - DNA, 22 bp, Mus musculus
tacatatctatgtctatatctg

SEQ ID NO: 207100 - DNA, 21 bp, Mus musculus
tttgtgtggctgcatgtgtac

SEQ ID NO: 207101 - DNA, 23 bp, Mus musculus
tgcatgtgtgtgtctctgtgtgt

SEQ ID NO: 207102 - DNA, 19 bp, Mus musculus
tgcatgttcctctcaaact

SEQ ID NO: 207103 - DNA, 18 bp, Mus musculus
gagtcaaagatgaggaac

SEQ ID NO: 207104 - DNA, 23 bp, Mus musculus
ttgaagaaaaagcagtttgagtt

SEQ ID NO: 207105 - DNA, 23 bp, Mus musculus
caagccactgcctgtctgtttgg

SEQ ID NO: 207106 - DNA, 23 bp, Mus musculus
tgtctgtctgtctgtctgtctct

SEQ ID NO: 207107 - DNA, 19 bp, Mus musculus
tttacagactagatcctga

SEQ ID NO: 207108 - DNA, 23 bp, Mus musculus
tatgtgtatatatatatgtgtgt

SEQ ID NO: 207109 - DNA, 23 bp, Mus musculus
tgtgtatatatgtatatgtatac

SEQ ID NO: 207110 - DNA, 23 bp, Mus musculus
atatatgtatatgtacctgtata

SEQ ID NO: 207111 - DNA, 23 bp, Mus musculus
taagttgaggagtccctgacata

SEQ ID NO: 207112 - DNA, 23 bp, Mus musculus
ctttttcctagtgattgtgttgt

SEQ ID NO: 207113 - DNA, 20 bp, Mus musculus
ttcatttctgattttgctga

SEQ ID NO: 207114 - DNA, 21 bp, Mus musculus
aaatacatactggttaccatg

SEQ ID NO: 207115 - DNA, 23 bp, Mus musculus
tgtgcctgtgtgtgtgcctgtgt

SEQ ID NO: 207116 - DNA, 23 bp, Mus musculus
actagtgtgcaggtacatgtgtg

SEQ ID NO: 207117 - DNA, 20 bp, Mus musculus
acagtgtgcctgtgtacagt

SEQ ID NO: 207118 - DNA, 23 bp, Mus musculus
gtctctctgtgtgtatccctggc

SEQ ID NO: 207119 - DNA, 23 bp, Mus musculus
agagatttcacagagttcttaca

SEQ ID NO: 207120 - DNA, 20 bp, Mus musculus
ctgagactatggcgggtcta

SEQ ID NO: 207121 - DNA, 23 bp, Mus musculus
atgataatggactgaatctctga

SEQ ID NO: 207122 - DNA, 20 bp, Mus musculus
cagaggtcctgagttcaatt

SEQ ID NO: 207123 - DNA, 23 bp, Mus musculus
tctgtctgtctgtctctgtctct

SEQ ID NO: 207124 - DNA, 21 bp, Mus musculus
tgcatatgtatgcatatgtgt

SEQ ID NO: 207125 - DNA, 23 bp, Mus musculus
agagctgtcttatgtctgagata

SEQ ID NO: 207126 - DNA, 23 bp, Mus musculus
atatgtatgtatatttgtgtgta

SEQ ID NO: 207127 - DNA, 23 bp, Mus musculus
gtatgtatatatgtatatgtatg

SEQ ID NO: 207128 - DNA, 23 bp, Mus musculus
atatatgtgtatatttatgtgtg

SEQ ID NO: 207129 - DNA, 23 bp, Mus musculus
tgtgtatatatgtatatatgtgt

SEQ ID NO: 207130 - DNA, 23 bp, Mus musculus
attggacaactgtgtgtatctgt

SEQ ID NO: 207131 - DNA, 23 bp, Mus musculus
gactgctcttccagaggtcctga

SEQ ID NO: 207132 - DNA, 23 bp, Mus musculus
ctcacaaccatctgtaatgagat

SEQ ID NO: 207133 - DNA, 23 bp, Mus musculus
tgcctgagtgtctgtctgtgtgt

SEQ ID NO: 207134 - DNA, 21 bp, Mus musculus
gagctggagagatggttcagt

SEQ ID NO: 207135 - DNA, 19 bp, Mus musculus
gagactagatgacgaccag

SEQ ID NO: 207136 - DNA, 19 bp, Mus musculus
tcacccaccctctctgcaa

SEQ ID NO: 207137 - DNA, 23 bp, Mus musculus
tctgtgtgtctgtgagtgtgtgt

SEQ ID NO: 207138 - DNA, 23 bp, Mus musculus
gtatgcatgtatgtatgtatgta

SEQ ID NO: 207139 - DNA, 23 bp, Mus musculus
agactatgtgtatgtgtctctct

SEQ ID NO: 207140 - DNA, 19 bp, Mus musculus
atcacacttgtgcagcagt

SEQ ID NO: 207141 - DNA, 22 bp, Mus musculus
ttagtcacaggtagtagttttt

SEQ ID NO: 207142 - DNA, 20 bp, Mus musculus
tgcatgtatgtatatatgta

SEQ ID NO: 207143 - DNA, 23 bp, Mus musculus
taggaccactaagtggtttgaag

SEQ ID NO: 207144 - DNA, 23 bp, Mus musculus
cactgcgtcactgtgtcactgtg

SEQ ID NO: 207145 - DNA, 19 bp, Mus musculus
tgaccagagtgtccacaga

SEQ ID NO: 207146 - DNA, 21 bp, Mus musculus
tctctgtggccttttcatctg

SEQ ID NO: 207147 - DNA, 23 bp, Mus musculus
cagagactgtgtgtctctcagcc

SEQ ID NO: 207148 - DNA, 20 bp, Mus musculus
tgggatacctgtctgtctgt

SEQ ID NO: 207149 - DNA, 22 bp, Mus musculus
catgacagtatccattcgcaga

SEQ ID NO: 207150 - DNA, 22 bp, Mus musculus
atctgagcacgttgaatcctgc

SEQ ID NO: 207151 - DNA, 19 bp, Mus musculus
tggtgtgtagacatgcaca

SEQ ID NO: 207152 - DNA, 20 bp, Mus musculus
tttgcagatttctttcttcc

SEQ ID NO: 207153 - DNA, 19 bp, Mus musculus
taagagatgtgtgtccaca

SEQ ID NO: 207154 - DNA, 23 bp, Mus musculus
atatgtgtatatgtatatatgtg

SEQ ID NO: 207155 - DNA, 20 bp, Mus musculus
atacacacactcctggctca

SEQ ID NO: 207156 - DNA, 23 bp, Mus musculus
cactgcctcagtctctgcctccc

SEQ ID NO: 207157 - DNA, 23 bp, Mus musculus
agtggcactcagtatccagtgtg

SEQ ID NO: 207158 - DNA, 21 bp, Mus musculus
tggccttgctctgactgagtg

SEQ ID NO: 207159 - DNA, 23 bp, Mus musculus
ttctgtctgtctgtctggggctg

SEQ ID NO: 207160 - DNA, 23 bp, Mus musculus
catgacagacagcacacagtctg

SEQ ID NO: 207161 - DNA, 20 bp, Mus musculus
cttcttgtggagctggagag

SEQ ID NO: 207162 - DNA, 19 bp, Mus musculus
ttcaattcacagcaaccac

SEQ ID NO: 207163 - DNA, 23 bp, Mus musculus
gagtctgcctgtgtctgtgtctg

SEQ ID NO: 207164 - DNA, 21 bp, Mus musculus
aataggttgtttatctttgtt

SEQ ID NO: 207165 - DNA, 18 bp, Mus musculus
tctgttttgtccatgtgg

SEQ ID NO: 207166 - DNA, 19 bp, Mus musculus
cattgagcagttgcagccg

SEQ ID NO: 207167 - DNA, 19 bp, Mus musculus
gtgagtagtctgggaggag

SEQ ID NO: 207168 - DNA, 23 bp, Mus musculus
tctgtgcctcagtttctccttct

SEQ ID NO: 207169 - DNA, 23 bp, Mus musculus
aagtctgtgccctagatgctgct

SEQ ID NO: 207170 - DNA, 23 bp, Mus musculus
tcagagccagtaactctctctct

SEQ ID NO: 207171 - DNA, 23 bp, Mus musculus
tatgctctctgtctctctggccc

SEQ ID NO: 207172 - DNA, 23 bp, Mus musculus
tcacactagatggaaggcaagaa

SEQ ID NO: 207173 - DNA, 23 bp, Mus musculus
gtgatgagctactgttgtgctct

SEQ ID NO: 207174 - DNA, 20 bp, Mus musculus
tgtgtgtgtgtgactagtag

SEQ ID NO: 207175 - DNA, 23 bp, Mus musculus
tgtgtgtctgtgtgcctgtgcat

SEQ ID NO: 207176 - DNA, 21 bp, Mus musculus
tatgcatatatatgtatatca

SEQ ID NO: 207177 - DNA, 23 bp, Mus musculus
taagagcactgactgctcttcca

SEQ ID NO: 207178 - DNA, 23 bp, Mus musculus
gactcagacacactctcatctga

SEQ ID NO: 207179 - DNA, 22 bp, Mus musculus
tgtgaagtactccaagacttgt

SEQ ID NO: 207180 - DNA, 23 bp, Mus musculus
tgtatgcatgtatatatgtgtgt

SEQ ID NO: 207181 - DNA, 23 bp, Mus musculus
aacgtgactgtgtctgtgtgtct

SEQ ID NO: 207182 - DNA, 21 bp, Mus musculus
aaaggtactgagttcaaatct

SEQ ID NO: 207183 - DNA, 23 bp, Mus musculus
tctccaaaaattttgtgctgtta

SEQ ID NO: 207184 - DNA, 23 bp, Mus musculus
tagagtagtgattttctacttga

SEQ ID NO: 207185 - DNA, 23 bp, Mus musculus
gtctgaggtttgtgattcagacg

SEQ ID NO: 207186 - DNA, 20 bp, Mus musculus
atatgtatatatgtatgtgt

SEQ ID NO: 207187 - DNA, 21 bp, Mus musculus
ttatttccagacagtccagaa

SEQ ID NO: 207188 - DNA, 21 bp, Mus musculus
atctgagaagaaagacagcac

SEQ ID NO: 207189 - DNA, 23 bp, Mus musculus
ggctgagaacacactgcctctcc

SEQ ID NO: 207190 - DNA, 22 bp, Mus musculus
agtgttacacagctagctgtac

SEQ ID NO: 207191 - DNA, 23 bp, Mus musculus
agactctgtgactgtaacaactc

SEQ ID NO: 207192 - DNA, 21 bp, Mus musculus
ctcaacatcaagctttgtgtg

SEQ ID NO: 207193 - DNA, 23 bp, Mus musculus
tgtatatatgtatgtctatctat

SEQ ID NO: 207194 - DNA, 22 bp, Mus musculus
tatatagatctctctctctctc

SEQ ID NO: 207195 - DNA, 19 bp, Mus musculus
ctgagttcagatccctcag

SEQ ID NO: 207196 - DNA, 23 bp, Mus musculus
gagactgtctgtgagtctgaaag

SEQ ID NO: 207197 - DNA, 21 bp, Mus musculus
ttgtgtgcacacagtggtgct

SEQ ID NO: 207198 - DNA, 21 bp, Mus musculus
gctctctctgtgactgactgc

SEQ ID NO: 207199 - DNA, 22 bp, Mus musculus
tcacagaacagagagtgggatt

SEQ ID NO: 207200 - DNA, 23 bp, Mus musculus
atatgtgtatatgtatatatatg

SEQ ID NO: 207201 - DNA, 19 bp, Mus musculus
tatgtacatatatatacac

SEQ ID NO: 207202 - DNA, 18 bp, Mus musculus
ggaagtatctggcattgg

SEQ ID NO: 207203 - DNA, 23 bp, Mus musculus
tctcactctctgtgtaaagtctg

SEQ ID NO: 207204 - DNA, 23 bp, Mus musculus
acgctgtctctgtgatcctgtga

SEQ ID NO: 207205 - DNA, 19 bp, Mus musculus
actgcataaattcctcttt

SEQ ID NO: 207206 - DNA, 23 bp, Mus musculus
aacagtagtgactctgaacttgt

SEQ ID NO: 207207 - DNA, 23 bp, Mus musculus
agaactgactgctcttccagagg

SEQ ID NO: 207208 - DNA, 23 bp, Mus musculus
cacactcactcactcactcactc

SEQ ID NO: 207209 - DNA, 20 bp, Mus musculus
atatgtgtataagtatatac

SEQ ID NO: 207210 - DNA, 21 bp, Mus musculus
tatgtgtatatgtatatatgt

SEQ ID NO: 207211 - DNA, 23 bp, Mus musculus
agactgtctgtcagtctcactct

SEQ ID NO: 207212 - DNA, 23 bp, Mus musculus
tgagtctctctcactaacaatcc

SEQ ID NO: 207213 - DNA, 23 bp, Mus musculus
ctctgtctctgtgtgtgcgctcg

SEQ ID NO: 207214 - DNA, 18 bp, Mus musculus
acacacacacgcatatat

SEQ ID NO: 207215 - DNA, 18 bp, Mus musculus
acgtatatatatgtgtgt

SEQ ID NO: 207216 - DNA, 23 bp, Mus musculus
tatatgtatgttcatgtatgtta

SEQ ID NO: 207217 - DNA, 23 bp, Mus musculus
ggctgtcactgactctgtggggt

SEQ ID NO: 207218 - DNA, 22 bp, Mus musculus
tgcctgagcctttagatttcgg

SEQ ID NO: 207219 - DNA, 20 bp, Mus musculus
tgacacaagctagagtcctc

SEQ ID NO: 207220 - DNA, 23 bp, Mus musculus
atttgagaggagagagagttctc

SEQ ID NO: 207221 - DNA, 23 bp, Mus musculus
aaagctgactgctcttccagagg

SEQ ID NO: 207222 - DNA, 23 bp, Mus musculus
tgagtgcatgcttgtgtgtgtgt

SEQ ID NO: 207223 - DNA, 23 bp, Mus musculus
tacagtctctgagattcaggaag

SEQ ID NO: 207224 - DNA, 23 bp, Mus musculus
ctgtctgcctctgtctcttgagt

SEQ ID NO: 207225 - DNA, 18 bp, Mus musculus
agtaatctttgcgggctg

SEQ ID NO: 207226 - DNA, 18 bp, Mus musculus
tgtgtttgtgtgtgtctg

SEQ ID NO: 207227 - DNA, 19 bp, Mus musculus
tcacatacatatacacaca

SEQ ID NO: 207228 - DNA, 23 bp, Mus musculus
catatgtaatgtgtgtgtatatg

SEQ ID NO: 207229 - DNA, 23 bp, Mus musculus
aagtgggtgcaggctgtcagtgt

SEQ ID NO: 207230 - DNA, 23 bp, Mus musculus
acactgaagagtgactggtcagg

SEQ ID NO: 207231 - DNA, 23 bp, Mus musculus
acaatagaatagtttgggttctg

SEQ ID NO: 207232 - DNA, 23 bp, Mus musculus
ttctctgtctgtctgtctgtctg

SEQ ID NO: 207233 - DNA, 23 bp, Mus musculus
tgtgtgtgtgtcagtcagttttc

SEQ ID NO: 207234 - DNA, 22 bp, Mus musculus
tgtagctgtgtagctgtggctg

SEQ ID NO: 207235 - DNA, 22 bp, Mus musculus
tgacagataatgaaaatagtaa

SEQ ID NO: 207236 - DNA, 21 bp, Mus musculus
tttctggttgaggttagtgct

SEQ ID NO: 207237 - DNA, 23 bp, Mus musculus
tacagacagttgtgagccaccac

SEQ ID NO: 207238 - DNA, 23 bp, Mus musculus
tccctgtgtggctgtctctggct

SEQ ID NO: 207239 - DNA, 23 bp, Mus musculus
gaagtacactgtcgctgtctctc

SEQ ID NO: 207240 - DNA, 18 bp, Mus musculus
agtgttgagactgtggac

SEQ ID NO: 207241 - DNA, 22 bp, Mus musculus
atctctctctgagaccctccct

SEQ ID NO: 207242 - DNA, 23 bp, Mus musculus
agctggtcagtgagaagacggtg

SEQ ID NO: 207243 - DNA, 23 bp, Mus musculus
ctcaggatgtgtttgtgtgtgca

SEQ ID NO: 207244 - DNA, 19 bp, Mus musculus
atgaatgtatttatgtaca

SEQ ID NO: 207245 - DNA, 22 bp, Mus musculus
ctatgtatgtatgtatgtatgt

SEQ ID NO: 207246 - DNA, 21 bp, Mus musculus
tatacctacataaatgtatgt

SEQ ID NO: 207247 - DNA, 23 bp, Mus musculus
tgtatgtatatatgcatgtgtgt

SEQ ID NO: 207248 - DNA, 23 bp, Mus musculus
tatatatgtatatgtgtatgtgt

SEQ ID NO: 207249 - DNA, 23 bp, Mus musculus
atgactcagtggttaagagcact

SEQ ID NO: 207250 - DNA, 22 bp, Mus musculus
gttttggtgattaacttcttga

SEQ ID NO: 207251 - DNA, 23 bp, Mus musculus
ctgtctctcactacactgttctt

SEQ ID NO: 207252 - DNA, 23 bp, Mus musculus
tgttgttgttgttgagacaagat

SEQ ID NO: 207253 - DNA, 20 bp, Mus musculus
aagagcactgactgctcttc

SEQ ID NO: 207254 - DNA, 23 bp, Mus musculus
tcagaactctgtctcagtcagtg

SEQ ID NO: 207255 - DNA, 23 bp, Mus musculus
gcatgtgtgtgtgcttgtgcatg

SEQ ID NO: 207256 - DNA, 21 bp, Mus musculus
acaaccagatggttcctgaat

SEQ ID NO: 207257 - DNA, 19 bp, Mus musculus
aaaagctagtgttgctagg

SEQ ID NO: 207258 - DNA, 18 bp, Mus musculus
cagcccttcaatcacatg

SEQ ID NO: 207259 - DNA, 23 bp, Mus musculus
tccttcatctccaaattctccag

SEQ ID NO: 207260 - DNA, 18 bp, Mus musculus
ctgcctctcagtctctct

SEQ ID NO: 207261 - DNA, 22 bp, Mus musculus
tctgagtcaacagagtgagctc

SEQ ID NO: 207262 - DNA, 21 bp, Mus musculus
cacagagaaactctgtctcga

SEQ ID NO: 207263 - DNA, 23 bp, Mus musculus
aaaagcactgactgctcttccag

SEQ ID NO: 207264 - DNA, 23 bp, Mus musculus
tgtgtgtgtgtgtttcatctgtg

SEQ ID NO: 207265 - DNA, 20 bp, Mus musculus
acagtgcagagagagagcac

SEQ ID NO: 207266 - DNA, 23 bp, Mus musculus
tgtctcagtcagcgtcttctgtg

SEQ ID NO: 207267 - DNA, 21 bp, Mus musculus
atttctcaggcactcacaggc

SEQ ID NO: 207268 - DNA, 20 bp, Mus musculus
gggtgtctctgtctctctgg

SEQ ID NO: 207269 - DNA, 23 bp, Mus musculus
ggctttggtagaacttagtggaa

SEQ ID NO: 207270 - DNA, 21 bp, Mus musculus
tagcactggcaaggccttggg

SEQ ID NO: 207271 - DNA, 23 bp, Mus musculus
gtctgtctgtctgtctgtctgtc

SEQ ID NO: 207272 - DNA, 23 bp, Mus musculus
ctgtctccgtgtgtgtctctgga

SEQ ID NO: 207273 - DNA, 23 bp, Mus musculus
tgtgtcccagtgtctctctggaa

SEQ ID NO: 207274 - DNA, 19 bp, Mus musculus
ttaagagcactgactgctc

SEQ ID NO: 207275 - DNA, 22 bp, Mus musculus
gctgagaagtggggctggagag

SEQ ID NO: 207276 - DNA, 23 bp, Mus musculus
aaagactgtgtggtattgtgagt

SEQ ID NO: 207277 - DNA, 23 bp, Mus musculus
tgtatgtatatctgtgtgtgtgt

SEQ ID NO: 207278 - DNA, 23 bp, Mus musculus
tgtgtgtctctgtgcctctgtgg

SEQ ID NO: 207279 - DNA, 23 bp, Mus musculus
ttgatgctgaggtagctagtgtg

SEQ ID NO: 207280 - DNA, 22 bp, Mus musculus
agcctcagttctccaggaacac

SEQ ID NO: 207281 - DNA, 23 bp, Mus musculus
tagacatggagctctggaggtca

SEQ ID NO: 207282 - DNA, 23 bp, Mus musculus
tagctctcagtgtgtctctgcca

SEQ ID NO: 207283 - DNA, 21 bp, Mus musculus
atatgtatgtatgtatgtatg

SEQ ID NO: 207284 - DNA, 23 bp, Mus musculus
tggatggatggatggatgtgttt

SEQ ID NO: 207285 - DNA, 22 bp, Mus musculus
acagttgtgtgacaccttcaga

SEQ ID NO: 207286 - DNA, 22 bp, Mus musculus
gtgtctctgtgtgtgtgcacgt

SEQ ID NO: 207287 - DNA, 22 bp, Mus musculus
agacagaaatctgtgaggtcaa

SEQ ID NO: 207288 - DNA, 19 bp, Mus musculus
acagctacagaaactctgt

SEQ ID NO: 207289 - DNA, 20 bp, Mus musculus
aaaaaatattatgaaagcag

SEQ ID NO: 207290 - DNA, 20 bp, Mus musculus
tacaggttattgaggtttat

SEQ ID NO: 207291 - DNA, 19 bp, Mus musculus
cccagtggcagagctgtgt

SEQ ID NO: 207292 - DNA, 23 bp, Mus musculus
ctgtgtgtgtgtccctgagtccg

SEQ ID NO: 207293 - DNA, 23 bp, Mus musculus
agtgctacatagtgagtctctgt

SEQ ID NO: 207294 - DNA, 18 bp, Mus musculus
ctctgtctgtcagtccct

SEQ ID NO: 207295 - DNA, 23 bp, Mus musculus
ccctgtcagtctgtgagactggc

SEQ ID NO: 207296 - DNA, 22 bp, Mus musculus
ctgtagactcactcacaggctc

SEQ ID NO: 207297 - DNA, 23 bp, Mus musculus
agaagagctacaccagctgacag

SEQ ID NO: 207298 - DNA, 23 bp, Mus musculus
gagagttgacagtgtgcagttct

SEQ ID NO: 207299 - DNA, 23 bp, Mus musculus
agacttctgagtctctgactcta

SEQ ID NO: 207300 - DNA, 20 bp, Mus musculus
agaggtgttctgtgccatag

SEQ ID NO: 207301 - DNA, 21 bp, Mus musculus
gaaagaactgactgtgcacag

SEQ ID NO: 207302 - DNA, 23 bp, Mus musculus
gtaacttctctagcaccacctct

SEQ ID NO: 207303 - DNA, 23 bp, Mus musculus
tcattctttctcagtcagtgtct

SEQ ID NO: 207304 - DNA, 23 bp, Mus musculus
taataggtcaaactgcagcctca

SEQ ID NO: 207305 - DNA, 19 bp, Mus musculus
tgaggcttagactcagtct

SEQ ID NO: 207306 - DNA, 23 bp, Mus musculus
accacactttcttttcagaagtt

SEQ ID NO: 207307 - DNA, 21 bp, Mus musculus
tatattaggaactgattctta

SEQ ID NO: 207308 - DNA, 23 bp, Mus musculus
gcagactgactggctctctgtgt

SEQ ID NO: 207309 - DNA, 19 bp, Mus musculus
acagtactgttttccctga

SEQ ID NO: 207310 - DNA, 23 bp, Mus musculus
gtctcagtgtcactgtgactagt

SEQ ID NO: 207311 - DNA, 21 bp, Mus musculus
tcacttctgagtcattcaggt

SEQ ID NO: 207312 - DNA, 23 bp, Mus musculus
gacatagctgagccagaagttga

SEQ ID NO: 207313 - DNA, 23 bp, Mus musculus
ctctccctctctgtgcctgtttc

SEQ ID NO: 207314 - DNA, 23 bp, Mus musculus
acacactgtgagtagtagctgct

SEQ ID NO: 207315 - DNA, 23 bp, Mus musculus
aggcagaggtagatgtatctcca

SEQ ID NO: 207316 - DNA, 22 bp, Mus musculus
aaatagctttacttgcaaatgt

SEQ ID NO: 207317 - DNA, 23 bp, Mus musculus
agaattattgctgaatttcaggg

SEQ ID NO: 207318 - DNA, 23 bp, Mus musculus
gagtgtctgttattctctctgat

SEQ ID NO: 207319 - DNA, 20 bp, Mus musculus
taagcaccatatgtatatat

SEQ ID NO: 207320 - DNA, 23 bp, Mus musculus
atagaagagagagagctgagttc

SEQ ID NO: 207321 - DNA, 23 bp, Mus musculus
ttctgggaagagtctgaggattg

SEQ ID NO: 207322 - DNA, 23 bp, Mus musculus
ctctctttgtctctctgactctc

SEQ ID NO: 207323 - DNA, 22 bp, Mus musculus
tgttttgtgaccaattatatgg

SEQ ID NO: 207324 - DNA, 20 bp, Mus musculus
tgatgctcacttcctgcctg

SEQ ID NO: 207325 - DNA, 23 bp, Mus musculus
gttaaatagtttaggtactctga

SEQ ID NO: 207326 - DNA, 23 bp, Mus musculus
aacatagtgtgtgtgtgtggggg

SEQ ID NO: 207327 - DNA, 23 bp, Mus musculus
aatgtgactatggtaattctgac

SEQ ID NO: 207328 - DNA, 23 bp, Mus musculus
tatgtgtatgtgtatatgctgtg

SEQ ID NO: 207329 - DNA, 23 bp, Mus musculus
tatttgtgcatgtgtatgcatat

SEQ ID NO: 207330 - DNA, 23 bp, Mus musculus
tatgtgtatatatatgtgtgtgt

SEQ ID NO: 207331 - DNA, 23 bp, Mus musculus
tctctgattctctgtgtttttca

SEQ ID NO: 207332 - DNA, 23 bp, Mus musculus
aacttttgagattttcttgatgg

SEQ ID NO: 207333 - DNA, 20 bp, Mus musculus
agcagaattttgttgtttgt

SEQ ID NO: 207334 - DNA, 22 bp, Mus musculus
tgttttgtgaccaattatatgg

SEQ ID NO: 207335 - DNA, 19 bp, Mus musculus
ttaggttttgtatctgtat

SEQ ID NO: 207336 - DNA, 23 bp, Mus musculus
atatactacatctctaatccaca

SEQ ID NO: 207337 - DNA, 22 bp, Mus musculus
tttgtgcttctatttatatgtg

SEQ ID NO: 207338 - DNA, 23 bp, Mus musculus
gtgtgaaaacaggagcagaaagc

SEQ ID NO: 207339 - DNA, 23 bp, Mus musculus
ttgagagagtagagtttatcatg

SEQ ID NO: 207340 - DNA, 21 bp, Mus musculus
tgtcacaacaaagagtggaga

SEQ ID NO: 207341 - DNA, 23 bp, Mus musculus
acatgtgtatgtatgtatatatg

SEQ ID NO: 207342 - DNA, 23 bp, Mus musculus
tatcatggtgttctgataggatg

SEQ ID NO: 207343 - DNA, 23 bp, Mus musculus
ttttgtgaccaattgtatggaca

SEQ ID NO: 207344 - DNA, 23 bp, Mus musculus
tctctgtcactgcctctctctgt

SEQ ID NO: 207345 - DNA, 23 bp, Mus musculus
cttactgcaacttgatatgctaa

SEQ ID NO: 207346 - DNA, 22 bp, Mus musculus
agtgaacatcctcaaagctgat

SEQ ID NO: 207347 - DNA, 23 bp, Mus musculus
tatgttatgtgtgtctgtctgta

SEQ ID NO: 207348 - DNA, 22 bp, Mus musculus
atctgtatatatatatgtgtgt

SEQ ID NO: 207349 - DNA, 18 bp, Mus musculus
gtatacttgtatatgtat

SEQ ID NO: 207350 - DNA, 19 bp, Mus musculus
tgtatacttgtatatgtat

SEQ ID NO: 207351 - DNA, 21 bp, Mus musculus
tatgcatatatatataattgt

SEQ ID NO: 207352 - DNA, 23 bp, Mus musculus
aacattgagcagacaggagtgtt

SEQ ID NO: 207353 - DNA, 22 bp, Mus musculus
atctaaactcaacttaatgtag

SEQ ID NO: 207354 - DNA, 18 bp, Mus musculus
acagggcctggagagatg

SEQ ID NO: 207355 - DNA, 20 bp, Mus musculus
aagagcactgactgctcttc

SEQ ID NO: 207356 - DNA, 23 bp, Mus musculus
tgaactactacattcagatttca

SEQ ID NO: 207357 - DNA, 23 bp, Mus musculus
ttgagagaagagagactgagctg

SEQ ID NO: 207358 - DNA, 23 bp, Mus musculus
tgccttgttcttggagaggagga

SEQ ID NO: 207359 - DNA, 18 bp, Mus musculus
cttgaagtagcttgttta

SEQ ID NO: 207360 - DNA, 23 bp, Mus musculus
ctgtcacagtctggctcactctt

SEQ ID NO: 207361 - DNA, 23 bp, Mus musculus
tgcatgtgtgcatgtgcatgtgt

SEQ ID NO: 207362 - DNA, 22 bp, Mus musculus
acagttgtgaggttctacttgc

SEQ ID NO: 207363 - DNA, 23 bp, Mus musculus
tgtgcatgtatgtatgtatgtgt

SEQ ID NO: 207364 - DNA, 23 bp, Mus musculus
tatgtgcatgtacatatgggtgt

SEQ ID NO: 207365 - DNA, 18 bp, Mus musculus
tctttattcatgtacatg

SEQ ID NO: 207366 - DNA, 22 bp, Mus musculus
actctgtgactctgaggacttg

SEQ ID NO: 207367 - DNA, 23 bp, Mus musculus
ttcttatgtgcagatggtgcagg

SEQ ID NO: 207368 - DNA, 23 bp, Mus musculus
tctctgtttgacctggtactgtt

SEQ ID NO: 207369 - DNA, 21 bp, Mus musculus
agtggtacttagtctccggga

SEQ ID NO: 207370 - DNA, 23 bp, Mus musculus
ggatgagagatgtcacagtggtc

SEQ ID NO: 207371 - DNA, 20 bp, Mus musculus
actcactgatgggaacttct

SEQ ID NO: 207372 - DNA, 23 bp, Mus musculus
agggtgagagctttggtgttcta

SEQ ID NO: 207373 - DNA, 21 bp, Mus musculus
agtgcttctatatcaaggcta

SEQ ID NO: 207374 - DNA, 22 bp, Mus musculus
tgttttgtgaccaattatatgg

SEQ ID NO: 207375 - DNA, 20 bp, Mus musculus
tcactggctgcctcactgtc

SEQ ID NO: 207376 - DNA, 23 bp, Mus musculus
tatgatgtatatgtatacaatgt

SEQ ID NO: 207377 - DNA, 21 bp, Mus musculus
tatatgtatatattaatgtgt

SEQ ID NO: 207378 - DNA, 21 bp, Mus musculus
tccaaagttgtgagtgaggag

SEQ ID NO: 207379 - DNA, 21 bp, Mus musculus
catgtgtgtgtgtacctatgt

SEQ ID NO: 207380 - DNA, 19 bp, Mus musculus
acagtgggacctctctcgg

SEQ ID NO: 207381 - DNA, 21 bp, Mus musculus
tcttcagaggacacttctgtc

SEQ ID NO: 207382 - DNA, 23 bp, Mus musculus
accctcactctctttcatcttgg

SEQ ID NO: 207383 - DNA, 22 bp, Mus musculus
gctgcctgcctgtctgcctgcc

SEQ ID NO: 207384 - DNA, 20 bp, Mus musculus
tgtatgtatgtatatgtgta

SEQ ID NO: 207385 - DNA, 18 bp, Mus musculus
tctcaggctccttgcttc

SEQ ID NO: 207386 - DNA, 23 bp, Mus musculus
ggcttcactgagtctctgtcatt

SEQ ID NO: 207387 - DNA, 23 bp, Mus musculus
ttaggtagaagacattggcagtg

SEQ ID NO: 207388 - DNA, 18 bp, Mus musculus
ctggttttggagagttgg

SEQ ID NO: 207389 - DNA, 23 bp, Mus musculus
atactgcatgtattcaaatgcat

SEQ ID NO: 207390 - DNA, 18 bp, Mus musculus
tatatgtgtatgtatatg

SEQ ID NO: 207391 - DNA, 23 bp, Mus musculus
tctgtgcctgtgtgtctctgtac

SEQ ID NO: 207392 - DNA, 23 bp, Mus musculus
ctgtgggtctcactcacttactt

SEQ ID NO: 207393 - DNA, 20 bp, Mus musculus
tgcctctggggctggagaga

SEQ ID NO: 207394 - DNA, 18 bp, Mus musculus
tgtgtgtgtgtgtctgtg

SEQ ID NO: 207395 - DNA, 22 bp, Mus musculus
tgactcagtggttaggagcact

SEQ ID NO: 207396 - DNA, 23 bp, Mus musculus
gagcactgactgctcttccagag

SEQ ID NO: 207397 - DNA, 23 bp, Mus musculus
cagcatttcactgggtctctctc

SEQ ID NO: 207398 - DNA, 19 bp, Mus musculus
agtctgtgagctctctgag

SEQ ID NO: 207399 - DNA, 23 bp, Mus musculus
agatctcattatgatgttgtgag

SEQ ID NO: 207400 - DNA, 23 bp, Mus musculus
tcaagttctagtacagtttcctt

SEQ ID NO: 207401 - DNA, 23 bp, Mus musculus
tgcctgtgagcctctgtgcgtgg

SEQ ID NO: 207402 - DNA, 22 bp, Mus musculus
actcacaggctcaccagctgca

SEQ ID NO: 207403 - DNA, 23 bp, Mus musculus
acaaccacatgaaggctcacaac

SEQ ID NO: 207404 - DNA, 23 bp, Mus musculus
acagactgcctgcctctctgcct

SEQ ID NO: 207405 - DNA, 21 bp, Mus musculus
acatttggagacgctcttttc

SEQ ID NO: 207406 - DNA, 23 bp, Mus musculus
aagagagaacagtgtgagtggag

SEQ ID NO: 207407 - DNA, 23 bp, Mus musculus
ttgtatctgtgcatgtgtgtgtg

SEQ ID NO: 207408 - DNA, 23 bp, Mus musculus
gggggagtctctgtctctgggtc

SEQ ID NO: 207409 - DNA, 23 bp, Mus musculus
ttggagcattggaattctcattg

SEQ ID NO: 207410 - DNA, 22 bp, Mus musculus
agaggtaactgggagttggaga

SEQ ID NO: 207411 - DNA, 23 bp, Mus musculus
tcacctctgtctgtcactggcaa

SEQ ID NO: 207412 - DNA, 23 bp, Mus musculus
ctctgtctgtgtgcctgtcttgt

SEQ ID NO: 207413 - DNA, 23 bp, Mus musculus
ggcactgactgctcttccagagg

SEQ ID NO: 207414 - DNA, 23 bp, Mus musculus
taagagcactgactgctcttcca

SEQ ID NO: 207415 - DNA, 23 bp, Mus musculus
tctgcctctccttctccacatgt

SEQ ID NO: 207416 - DNA, 23 bp, Mus musculus
acacaccctcgctgtctgtgtct

SEQ ID NO: 207417 - DNA, 22 bp, Mus musculus
tgagctctgtgtctctgtctgc

SEQ ID NO: 207418 - DNA, 23 bp, Mus musculus
gtatgtatgtatgtatgtgtgtg

SEQ ID NO: 207419 - DNA, 22 bp, Mus musculus
tgttttgtgaccaattatatgg

SEQ ID NO: 207420 - DNA, 23 bp, Mus musculus
ccagagtagtgaggactttgctt

SEQ ID NO: 207421 - DNA, 23 bp, Mus musculus
tcacttttactcagatctttgct

SEQ ID NO: 207422 - DNA, 20 bp, Mus musculus
ttgtcctcctactgcacaca

SEQ ID NO: 207423 - DNA, 23 bp, Mus musculus
tctctgcctctgcctctgcctct

SEQ ID NO: 207424 - DNA, 22 bp, Mus musculus
agacagcacacagtgaggagac

SEQ ID NO: 207425 - DNA, 23 bp, Mus musculus
cacactgacacagattcacttct

SEQ ID NO: 207426 - DNA, 19 bp, Mus musculus
tctctgatagaaaacagac

SEQ ID NO: 207427 - DNA, 19 bp, Mus musculus
tacagagcttaaagaacag

SEQ ID NO: 207428 - DNA, 23 bp, Mus musculus
tttgtgcttactctcctctgtct

SEQ ID NO: 207429 - DNA, 23 bp, Mus musculus
tgagactggagtcacagcagttg

SEQ ID NO: 207430 - DNA, 23 bp, Mus musculus
actgccattgttttgcattctta

SEQ ID NO: 207431 - DNA, 23 bp, Mus musculus
ctcagagagtccctcactcactc

SEQ ID NO: 207432 - DNA, 23 bp, Mus musculus
ccagacagtctctgcgtgtgtca

SEQ ID NO: 207433 - DNA, 19 bp, Mus musculus
atatgtgtgtgcattatat

SEQ ID NO: 207434 - DNA, 22 bp, Mus musculus
aagtttcaagctgggccactct

SEQ ID NO: 207435 - DNA, 22 bp, Mus musculus
atatacatacatatacatgtgt

SEQ ID NO: 207436 - DNA, 19 bp, Mus musculus
actggggaacatagttaga

SEQ ID NO: 207437 - DNA, 23 bp, Mus musculus
tccctgacagtctccctgattct

SEQ ID NO: 207438 - DNA, 20 bp, Mus musculus
gcgacagattttctgctctg

SEQ ID NO: 207439 - DNA, 23 bp, Mus musculus
agtgatggactgtctgtcttcat

SEQ ID NO: 207440 - DNA, 23 bp, Mus musculus
agctagagtagtctttgtgtagt

SEQ ID NO: 207441 - DNA, 23 bp, Mus musculus
atattaggagtaatactggttag

SEQ ID NO: 207442 - DNA, 22 bp, Mus musculus
tacagaagtcagggcattggat

SEQ ID NO: 207443 - DNA, 23 bp, Mus musculus
actctccttggatttcaagagac

SEQ ID NO: 207444 - DNA, 23 bp, Mus musculus
tcctgactgctcttccagaggtc

SEQ ID NO: 207445 - DNA, 19 bp, Mus musculus
agagcctttactgagagca

SEQ ID NO: 207446 - DNA, 22 bp, Mus musculus
caacagtatgccatatgtatgt

SEQ ID NO: 207447 - DNA, 19 bp, Mus musculus
tctctgagcctctgactct

SEQ ID NO: 207448 - DNA, 18 bp, Mus musculus
atgtcatttaggattctc

SEQ ID NO: 207449 - DNA, 22 bp, Mus musculus
tagctttctggagtggctcctg

SEQ ID NO: 207450 - DNA, 19 bp, Mus musculus
cccgtgaggtatgctctct

SEQ ID NO: 207451 - DNA, 19 bp, Mus musculus
tcagagggttacacacaca

SEQ ID NO: 207452 - DNA, 22 bp, Mus musculus
tgttttgtgaccaattatatgg

SEQ ID NO: 207453 - DNA, 23 bp, Mus musculus
ggctgtctctgtcactctggctt

SEQ ID NO: 207454 - DNA, 23 bp, Mus musculus
tgatgtcagatcagtgagtgcac

SEQ ID NO: 207455 - DNA, 22 bp, Mus musculus
tcactggctgtattttttgagt

SEQ ID NO: 207456 - DNA, 19 bp, Mus musculus
attaaatctttctgctcag

SEQ ID NO: 207457 - DNA, 23 bp, Mus musculus
ttgtgcgtgtgcatgtgcatgtg

SEQ ID NO: 207458 - DNA, 23 bp, Mus musculus
tcccagactggtttagaacttag

SEQ ID NO: 207459 - DNA, 23 bp, Mus musculus
gtctgtctctgtctgtctgccta

SEQ ID NO: 207460 - DNA, 23 bp, Mus musculus
tgtctgccagtctgtctgcatct

SEQ ID NO: 207461 - DNA, 18 bp, Mus musculus
actttgatcctcaggttg

SEQ ID NO: 207462 - DNA, 23 bp, Mus musculus
ctgtggctctctgaggctctgcc

SEQ ID NO: 207463 - DNA, 23 bp, Mus musculus
cttagtgcttcagtatccatttc

SEQ ID NO: 207464 - DNA, 22 bp, Mus musculus
tttaactgcattattttactta

SEQ ID NO: 207465 - DNA, 20 bp, Mus musculus
agcttgtatgtatgtatgta

SEQ ID NO: 207466 - DNA, 20 bp, Mus musculus
atcctcagtgcttgtagaga

SEQ ID NO: 207467 - DNA, 23 bp, Mus musculus
agaaatggagaagagtttgctgg

SEQ ID NO: 207468 - DNA, 23 bp, Mus musculus
gtgtgtgcaagtgcatgtgcctg

SEQ ID NO: 207469 - DNA, 20 bp, Mus musculus
gtaaggcactgaaggagcag

SEQ ID NO: 207470 - DNA, 19 bp, Mus musculus
ttcacatgtgtgtgagcac

SEQ ID NO: 207471 - DNA, 23 bp, Mus musculus
tctctcactgcctcttacctgac

SEQ ID NO: 207472 - DNA, 20 bp, Mus musculus
tcaggtgggacacagatttg

SEQ ID NO: 207473 - DNA, 23 bp, Mus musculus
attgatgggtcttgctgtcttgg

SEQ ID NO: 207474 - DNA, 23 bp, Mus musculus
gtctcagacagtgtgtctctcgt

SEQ ID NO: 207475 - DNA, 23 bp, Mus musculus
tatatgtgtgtatatgtatatgt

SEQ ID NO: 207476 - DNA, 23 bp, Mus musculus
ctgtctcagtcactgttctatat

SEQ ID NO: 207477 - DNA, 18 bp, Mus musculus
actccagcacctgcagtt

SEQ ID NO: 207478 - DNA, 23 bp, Mus musculus
tatgtatggtatctgtgtgagcc

SEQ ID NO: 207479 - DNA, 22 bp, Mus musculus
cagtgattcttcacttggggtc

SEQ ID NO: 207480 - DNA, 22 bp, Mus musculus
ctgaatcaggaaatactgagag

SEQ ID NO: 207481 - DNA, 19 bp, Mus musculus
tttttgcttgaatagtagt

SEQ ID NO: 207482 - DNA, 23 bp, Mus musculus
taagagcactgactgctcttcag

SEQ ID NO: 207483 - DNA, 23 bp, Mus musculus
aagatagagacagttgtgagctg

SEQ ID NO: 207484 - DNA, 23 bp, Mus musculus
aagctgctctctctctcactctg

SEQ ID NO: 207485 - DNA, 23 bp, Mus musculus
gatctgtctgtctgtctctgcct

SEQ ID NO: 207486 - DNA, 23 bp, Mus musculus
acatatgtgtgtatggtgtgtgt

SEQ ID NO: 207487 - DNA, 22 bp, Mus musculus
acataatatatatgtgtgtata

SEQ ID NO: 207488 - DNA, 23 bp, Mus musculus
gacagggtttctctgtgtatctc

SEQ ID NO: 207489 - DNA, 23 bp, Mus musculus
gacagatgtctcagtgattaaga

SEQ ID NO: 207490 - DNA, 23 bp, Mus musculus
gtatgtatgtatgtatgtgtatg

SEQ ID NO: 207491 - DNA, 23 bp, Mus musculus
tggtccttgtcagagtgaactat

SEQ ID NO: 207492 - DNA, 21 bp, Mus musculus
tgagtgggaaaatggactgca

SEQ ID NO: 207493 - DNA, 20 bp, Mus musculus
ctctgctgtctgcctctcca

SEQ ID NO: 207494 - DNA, 23 bp, Mus musculus
gtgtcactgtgtggctgtgttaa

SEQ ID NO: 207495 - DNA, 23 bp, Mus musculus
gaggcactcactggctggcttaa

SEQ ID NO: 207496 - DNA, 22 bp, Mus musculus
tttgtgtgtgcatgttctctct

SEQ ID NO: 207497 - DNA, 23 bp, Mus musculus
tgtctgtctgcctgtctgtctgg

SEQ ID NO: 207498 - DNA, 22 bp, Mus musculus
acaatctcattatggaagctgt

SEQ ID NO: 207499 - DNA, 23 bp, Mus musculus
tatgtgtgtatatatgtatgtgt

SEQ ID NO: 207500 - DNA, 22 bp, Mus musculus
tgaggccctgactatgtcctaa

SEQ ID NO: 207501 - DNA, 21 bp, Mus musculus
agagagagcagagtatggagg

SEQ ID NO: 207502 - DNA, 23 bp, Mus musculus
tctttcaaagtcaagctgtatgg

SEQ ID NO: 207503 - DNA, 23 bp, Mus musculus
gggctgactctgtggctcagttg

SEQ ID NO: 207504 - DNA, 23 bp, Mus musculus
tctcacaggctctctgtttttaa

SEQ ID NO: 207505 - DNA, 18 bp, Mus musculus
ggcgcggggtgaaaacag

SEQ ID NO: 207506 - DNA, 18 bp, Mus musculus
aaaggttctgagttcaaa

SEQ ID NO: 207507 - DNA, 23 bp, Mus musculus
agaaaggcagagggtgatttggg

SEQ ID NO: 207508 - DNA, 20 bp, Mus musculus
tctggctcactctttttttt

SEQ ID NO: 207509 - DNA, 21 bp, Mus musculus
ttcaccttgccttttatcttt

SEQ ID NO: 207510 - DNA, 23 bp, Mus musculus
ctctcagcatctctctgtccctc

SEQ ID NO: 207511 - DNA, 23 bp, Mus musculus
ttccactctgaatctctctcctt

SEQ ID NO: 207512 - DNA, 23 bp, Mus musculus
tatgtgtatatatatgtgtgtgt

SEQ ID NO: 207513 - DNA, 22 bp, Mus musculus
ccctctctctgtgaggcactgc

SEQ ID NO: 207514 - DNA, 23 bp, Mus musculus
taaagcttagtcagcatgttgaa

SEQ ID NO: 207515 - DNA, 23 bp, Mus musculus
tgcatgagcatgtgtatgtatgt

SEQ ID NO: 207516 - DNA, 22 bp, Mus musculus
agccaggatagcaaaagtgtca

SEQ ID NO: 207517 - DNA, 22 bp, Mus musculus
agagggcctcaacttctgctaa

SEQ ID NO: 207518 - DNA, 19 bp, Mus musculus
ttaagagcactgactgctc

SEQ ID NO: 207519 - DNA, 23 bp, Mus musculus
tgtctgtcacttcagtttcaggg

SEQ ID NO: 207520 - DNA, 23 bp, Mus musculus
taagaacactgactgctcttcca

SEQ ID NO: 207521 - DNA, 22 bp, Mus musculus
acaagctctggggctggagaga

SEQ ID NO: 207522 - DNA, 18 bp, Mus musculus
tgtgtctctgtatcaatt

SEQ ID NO: 207523 - DNA, 20 bp, Mus musculus
tcctctctgtctctctgatt

SEQ ID NO: 207524 - DNA, 20 bp, Mus musculus
atgcgccactactgtagggt

SEQ ID NO: 207525 - DNA, 21 bp, Mus musculus
tccatggtggtctgataggat

SEQ ID NO: 207526 - DNA, 22 bp, Mus musculus
tgttttgtgaccaattatatgg

SEQ ID NO: 207527 - DNA, 18 bp, Mus musculus
gagcactgactgctcttc

SEQ ID NO: 207528 - DNA, 19 bp, Mus musculus
cagagaacatacagagcag

SEQ ID NO: 207529 - DNA, 23 bp, Mus musculus
agggcagtgttgtgaggcaggag

SEQ ID NO: 207530 - DNA, 21 bp, Mus musculus
atgtatgtgtctatgtgcatg

SEQ ID NO: 207531 - DNA, 23 bp, Mus musculus
taaagagttctattctggggctg

SEQ ID NO: 207532 - DNA, 23 bp, Mus musculus
gcgtgtcactgtgggtgtgtcac

SEQ ID NO: 207533 - DNA, 23 bp, Mus musculus
aagacagatgttagggtccagct

SEQ ID NO: 207534 - DNA, 23 bp, Mus musculus
actctgtgcctgtctgtccgtct

SEQ ID NO: 207535 - DNA, 19 bp, Mus musculus
tctctgtctgtcgcagact

SEQ ID NO: 207536 - DNA, 23 bp, Mus musculus
gagagtgctgagtgtgctgagtg

SEQ ID NO: 207537 - DNA, 21 bp, Mus musculus
tttaagcttgtgaatatggct

SEQ ID NO: 207538 - DNA, 21 bp, Mus musculus
tgtatgtatgtacatgtgtgt

SEQ ID NO: 207539 - DNA, 23 bp, Mus musculus
atgtgcattgatgttttgcctgc

SEQ ID NO: 207540 - DNA, 23 bp, Mus musculus
acagtcactgtctctgttcctcc

SEQ ID NO: 207541 - DNA, 23 bp, Mus musculus
acacccaccctgtctctgtctgt

SEQ ID NO: 207542 - DNA, 23 bp, Mus musculus
ctgtgtggtgttggaggaggacc

SEQ ID NO: 207543 - DNA, 23 bp, Mus musculus
ccgagctcactctgtctgacacg

SEQ ID NO: 207544 - DNA, 20 bp, Mus musculus
tcacagaactgagtgacttg

SEQ ID NO: 207545 - DNA, 22 bp, Mus musculus
tgtatgtgtggatgtggatgtg

SEQ ID NO: 207546 - DNA, 20 bp, Mus musculus
atgcaatgtatacatgtgtg

SEQ ID NO: 207547 - DNA, 23 bp, Mus musculus
agacagagaggcagacagacaga

SEQ ID NO: 207548 - DNA, 22 bp, Mus musculus
acagggacacaaaatgctgtct

SEQ ID NO: 207549 - DNA, 23 bp, Mus musculus
gtcacagtgtagagagtgtgcag

SEQ ID NO: 207550 - DNA, 22 bp, Mus musculus
tatgagtgagtgagtgagtgag

SEQ ID NO: 207551 - DNA, 23 bp, Mus musculus
cgtccgtccgtccgtccgtccgt

SEQ ID NO: 207552 - DNA, 21 bp, Mus musculus
agtctgtctccctccctcagg

SEQ ID NO: 207553 - DNA, 23 bp, Mus musculus
gtctctctgactgtcagtgggtc

SEQ ID NO: 207554 - DNA, 20 bp, Mus musculus
tacatttccacattgctgtt

SEQ ID NO: 207555 - DNA, 22 bp, Mus musculus
tgttttgttttagaaaaggtct

SEQ ID NO: 207556 - DNA, 22 bp, Mus musculus
tgttttgtgaccaattatatgg

SEQ ID NO: 207557 - DNA, 19 bp, Mus musculus
agtggatattttgataggt

SEQ ID NO: 207558 - DNA, 22 bp, Mus musculus
tgtatgtatgtatgtatatgta

SEQ ID NO: 207559 - DNA, 23 bp, Mus musculus
taattgtttttcttcctgttatt

SEQ ID NO: 207560 - DNA, 23 bp, Mus musculus
tttgttgaagaattattttcttg

SEQ ID NO: 207561 - DNA, 23 bp, Mus musculus
tctctgagtctgattgatgccat

SEQ ID NO: 207562 - DNA, 23 bp, Mus musculus
ctgtctgcctgtctgcctgcctg

SEQ ID NO: 207563 - DNA, 20 bp, Mus musculus
cagacacagacagacaggca

SEQ ID NO: 207564 - DNA, 21 bp, Mus musculus
aatctagtgggtttttttgtt

SEQ ID NO: 207565 - DNA, 23 bp, Mus musculus
tgtgtatatatgtatatgtgtaa

SEQ ID NO: 207566 - DNA, 20 bp, Mus musculus
tgtctgtcatctcttggaag

SEQ ID NO: 207567 - DNA, 22 bp, Mus musculus
aatgtatgtatgtatgaatgta

SEQ ID NO: 207568 - DNA, 21 bp, Mus musculus
cagactccatagtgtgtgtgt

SEQ ID NO: 207569 - DNA, 23 bp, Mus musculus
tccctggctgcctgtgtgtgctg

SEQ ID NO: 207570 - DNA, 21 bp, Mus musculus
agtcttgaatgacattgaggt

SEQ ID NO: 207571 - DNA, 22 bp, Mus musculus
atgtgagtacagagatagctga

SEQ ID NO: 207572 - DNA, 22 bp, Mus musculus
gacacatagctatagtctcagc

SEQ ID NO: 207573 - DNA, 21 bp, Mus musculus
tgtgtatgtatgtatgtatgt

SEQ ID NO: 207574 - DNA, 23 bp, Mus musculus
tattcaggttgaatatgtattga

SEQ ID NO: 207575 - DNA, 22 bp, Mus musculus
tgcctgtgttctgtctggctca

SEQ ID NO: 207576 - DNA, 23 bp, Mus musculus
tctatcaccctctctgagtctct

SEQ ID NO: 207577 - DNA, 23 bp, Mus musculus
ttactggccctttaagttgggaa

SEQ ID NO: 207578 - DNA, 20 bp, Mus musculus
gtctgctaaggcttgtgtga

SEQ ID NO: 207579 - DNA, 23 bp, Mus musculus
tttcctattggtcttgcacactg

SEQ ID NO: 207580 - DNA, 23 bp, Mus musculus
aataggttctatcttaatctgct

SEQ ID NO: 207581 - DNA, 21 bp, Mus musculus
ctgccccactctgtctctctg

SEQ ID NO: 207582 - DNA, 23 bp, Mus musculus
acaggagctcagagtggatggtg

SEQ ID NO: 207583 - DNA, 23 bp, Mus musculus
agaacttagaaagcagtgggtgg

SEQ ID NO: 207584 - DNA, 21 bp, Mus musculus
tccatggtggtctgataggat

SEQ ID NO: 207585 - DNA, 22 bp, Mus musculus
tgttttgtgaccaattatatgg

SEQ ID NO: 207586 - DNA, 23 bp, Mus musculus
aacatgtccagggagtcttacct

SEQ ID NO: 207587 - DNA, 23 bp, Mus musculus
catttgagcatttgtatggtcct

SEQ ID NO: 207588 - DNA, 23 bp, Mus musculus
gagcacattctttgtacaaagcc

SEQ ID NO: 207589 - DNA, 23 bp, Mus musculus
caggtgtttgtttatctaaagcc

SEQ ID NO: 207590 - DNA, 18 bp, Mus musculus
tacaggtcgcagtggaga

SEQ ID NO: 207591 - DNA, 21 bp, Mus musculus
ctgtccgtctgtcaggctgtg

SEQ ID NO: 207592 - DNA, 22 bp, Mus musculus
gcaaacctggatgtgagtctgg

SEQ ID NO: 207593 - DNA, 23 bp, Mus musculus
cagaagatgaacaggccaaggga

SEQ ID NO: 207594 - DNA, 21 bp, Mus musculus
gatctctgtctctgtgtctct

SEQ ID NO: 207595 - DNA, 23 bp, Mus musculus
tgcatgagtgtacagtctgtctg

SEQ ID NO: 207596 - DNA, 23 bp, Mus musculus
tcaggttctctgtgtgtgtgtgt

SEQ ID NO: 207597 - DNA, 21 bp, Mus musculus
atatgtgtgtatatgtatatg

SEQ ID NO: 207598 - DNA, 22 bp, Mus musculus
tcactggctgtgtgtatctcca

SEQ ID NO: 207599 - DNA, 23 bp, Mus musculus
aattggtgatctgtctgtctgtc

SEQ ID NO: 207600 - DNA, 23 bp, Mus musculus
gacactctgcctcacagagaccc

SEQ ID NO: 207601 - DNA, 23 bp, Mus musculus
gacactctgcctcacagagaccc

SEQ ID NO: 207602 - DNA, 18 bp, Mus musculus
ctgcctccctcttagcct

SEQ ID NO: 207603 - DNA, 23 bp, Mus musculus
tctcactgactgccagacctcag

SEQ ID NO: 207604 - DNA, 23 bp, Mus musculus
cctctgtgtgtgtgtgcgtgcat

SEQ ID NO: 207605 - DNA, 20 bp, Mus musculus
tggctgcctccctgtgtcgg

SEQ ID NO: 207606 - DNA, 23 bp, Mus musculus
gaatctgtctctcactctgccag

SEQ ID NO: 207607 - DNA, 21 bp, Mus musculus
tgtatgtatgtatatatgtag

SEQ ID NO: 207608 - DNA, 21 bp, Mus musculus
acgtatgtatgtatgtgtgtg

SEQ ID NO: 207609 - DNA, 20 bp, Mus musculus
gggaccagccttctttgacc

SEQ ID NO: 207610 - DNA, 19 bp, Mus musculus
tgtgccagtgagttcaagg

SEQ ID NO: 207611 - DNA, 23 bp, Mus musculus
gttctgacttgttctttcctgca

SEQ ID NO: 207612 - DNA, 23 bp, Mus musculus
tgtcagtggctgaataacaacag

SEQ ID NO: 207613 - DNA, 23 bp, Mus musculus
ggagtgtgagtctctctgtgtgt

SEQ ID NO: 207614 - DNA, 18 bp, Mus musculus
gcctctgtgtgtgtgtgt

SEQ ID NO: 207615 - DNA, 23 bp, Mus musculus
gggtgtgacgctgcctgtcaccc

SEQ ID NO: 207616 - DNA, 23 bp, Mus musculus
tgtctgtctgtctgtctgtcttt

SEQ ID NO: 207617 - DNA, 20 bp, Mus musculus
ctctcttcactttctgactc

SEQ ID NO: 207618 - DNA, 23 bp, Mus musculus
ttttcctggagatttctttctgt

SEQ ID NO: 207619 - DNA, 23 bp, Mus musculus
gagacaggatttcactgtgtagt

SEQ ID NO: 207620 - DNA, 19 bp, Mus musculus
cttgaactcacagtctctc

SEQ ID NO: 207621 - DNA, 23 bp, Mus musculus
aggaaaggatagaagtgtgaact

SEQ ID NO: 207622 - DNA, 23 bp, Mus musculus
tatgcatgtatgtatgtatgtat

SEQ ID NO: 207623 - DNA, 23 bp, Mus musculus
gtgggtggctccctctctgcatt

SEQ ID NO: 207624 - DNA, 22 bp, Mus musculus
acacactggctcacttcagctg

SEQ ID NO: 207625 - DNA, 23 bp, Mus musculus
tcacatgacagactgtgtctctc

SEQ ID NO: 207626 - DNA, 23 bp, Mus musculus
ggtgagtgaggaaggactcacag

SEQ ID NO: 207627 - DNA, 23 bp, Mus musculus
tagttcttcagattgctaaggaa

SEQ ID NO: 207628 - DNA, 22 bp, Mus musculus
ctatgtctccctttctgcttgc

SEQ ID NO: 207629 - DNA, 23 bp, Mus musculus
tgtctctctgtgtatgtgtgtgt

SEQ ID NO: 207630 - DNA, 23 bp, Mus musculus
gtctctgcctctgtctgccgctg

SEQ ID NO: 207631 - DNA, 23 bp, Mus musculus
ttgagtgtgtgattgaaggttgt

SEQ ID NO: 207632 - DNA, 19 bp, Mus musculus
tgggtagaacgaggaaaag

SEQ ID NO: 207633 - DNA, 23 bp, Mus musculus
gtgtttgagcatgtgcatgtgta

SEQ ID NO: 207634 - DNA, 20 bp, Mus musculus
atacacacatgcacttttgt

SEQ ID NO: 207635 - DNA, 21 bp, Mus musculus
tgtgtgtgtgcatgtgcatgt

SEQ ID NO: 207636 - DNA, 22 bp, Mus musculus
ttgtccttgcagattgtgatgc

SEQ ID NO: 207637 - DNA, 21 bp, Mus musculus
tatgtatgtatttatgtgtga

SEQ ID NO: 207638 - DNA, 23 bp, Mus musculus
atatgtatgtgtgcatgtttgag

SEQ ID NO: 207639 - DNA, 23 bp, Mus musculus
tatgtttgtgcatctgtatcagt

SEQ ID NO: 207640 - DNA, 23 bp, Mus musculus
tcagagtaggtgtggctttgttg

SEQ ID NO: 207641 - DNA, 22 bp, Mus musculus
tgttttgtgaccaattatatgg

SEQ ID NO: 207642 - DNA, 23 bp, Mus musculus
tgtatagatatatgatgtataga

SEQ ID NO: 207643 - DNA, 20 bp, Mus musculus
tgtgtgtatgtatgtatgta

SEQ ID NO: 207644 - DNA, 21 bp, Mus musculus
actctcagtctgtgtatgttg

SEQ ID NO: 207645 - DNA, 19 bp, Mus musculus
tgacttctttcccactgtg

SEQ ID NO: 207646 - DNA, 19 bp, Mus musculus
cagacagatgagagagtgc

SEQ ID NO: 207647 - DNA, 23 bp, Mus musculus
tgatcacactggagtactctggc

SEQ ID NO: 207648 - DNA, 21 bp, Mus musculus
ggctctgtgactcagtgacag

SEQ ID NO: 207649 - DNA, 20 bp, Mus musculus
aatatgggtgtggctttgtt

SEQ ID NO: 207650 - DNA, 18 bp, Mus musculus
ttccctttgacaggctca

SEQ ID NO: 207651 - DNA, 23 bp, Mus musculus
ggtatccacttgtctctgtctct

SEQ ID NO: 207652 - DNA, 19 bp, Mus musculus
catggtggtctgataggat

SEQ ID NO: 207653 - DNA, 22 bp, Mus musculus
tgttttgtgaccaattatatgg

SEQ ID NO: 207654 - DNA, 19 bp, Mus musculus
taccgtgtggatggagctc

SEQ ID NO: 207655 - DNA, 22 bp, Mus musculus
gtttctgagtcaatggacttgc

SEQ ID NO: 207656 - DNA, 20 bp, Mus musculus
tgtgaatatatatatgtgtg

SEQ ID NO: 207657 - DNA, 23 bp, Mus musculus
tatgtatatatgtatgcatctgt

SEQ ID NO: 207658 - DNA, 23 bp, Mus musculus
ttactctggattatctagtgcag

SEQ ID NO: 207659 - DNA, 22 bp, Mus musculus
ctgagtacacagtgagctcatg

SEQ ID NO: 207660 - DNA, 23 bp, Mus musculus
tctgagtgtctctgtgttttggc

SEQ ID NO: 207661 - DNA, 21 bp, Mus musculus
attgtgtgtgtgtatgtatat

SEQ ID NO: 207662 - DNA, 22 bp, Mus musculus
atgtatatatacatatgtgtgt

SEQ ID NO: 207663 - DNA, 22 bp, Mus musculus
tctctctctctgtggcagaact

SEQ ID NO: 207664 - DNA, 23 bp, Mus musculus
actctgtatctctctgtcttatt

SEQ ID NO: 207665 - DNA, 22 bp, Mus musculus
aaatgtggcagtcatgatgcgg

SEQ ID NO: 207666 - DNA, 23 bp, Mus musculus
attggactgtagagagctctgtt

SEQ ID NO: 207667 - DNA, 23 bp, Mus musculus
gtcacagcaacaggaactgtaac

SEQ ID NO: 207668 - DNA, 20 bp, Mus musculus
ttggctcagagcaatggtgg

SEQ ID NO: 207669 - DNA, 20 bp, Mus musculus
aagatgggaatagaaggaca

SEQ ID NO: 207670 - DNA, 23 bp, Mus musculus
aagtcagtgactctcagagcatc

SEQ ID NO: 207671 - DNA, 23 bp, Mus musculus
catctgtgggtctgtccgactgt

SEQ ID NO: 207672 - DNA, 23 bp, Mus musculus
gttagcctctgtgcctgtctgag

SEQ ID NO: 207673 - DNA, 22 bp, Mus musculus
tatatgatgtatatgcatatga

SEQ ID NO: 207674 - DNA, 22 bp, Mus musculus
atatatatacgtatacatatat

SEQ ID NO: 207675 - DNA, 23 bp, Mus musculus
agtgctgactgctcttccagagg

SEQ ID NO: 207676 - DNA, 23 bp, Mus musculus
agagagaagtcagattgcacaag

SEQ ID NO: 207677 - DNA, 22 bp, Mus musculus
tgtgtatatgcatgtgtatgtg

SEQ ID NO: 207678 - DNA, 23 bp, Mus musculus
gtgtgcctctgtgtgtgtgcgcg

SEQ ID NO: 207679 - DNA, 19 bp, Mus musculus
tcacatgtgtgtgtgcaca

SEQ ID NO: 207680 - DNA, 18 bp, Mus musculus
tattgaggggaaagtctt

SEQ ID NO: 207681 - DNA, 23 bp, Mus musculus
ctgactctgcctgtctgtgatct

SEQ ID NO: 207682 - DNA, 20 bp, Mus musculus
tgcctagtgtgcacgaagct

SEQ ID NO: 207683 - DNA, 23 bp, Mus musculus
tgctggagtatatatattgtgta

SEQ ID NO: 207684 - DNA, 23 bp, Mus musculus
tgcatatatgtatgtatgtatgt

SEQ ID NO: 207685 - DNA, 23 bp, Mus musculus
aaagctatttttccatttgttga

SEQ ID NO: 207686 - DNA, 23 bp, Mus musculus
ctctctctgagtgtgactctgct

SEQ ID NO: 207687 - DNA, 23 bp, Mus musculus
tctacttcttgcaggctaagtga

SEQ ID NO: 207688 - DNA, 23 bp, Mus musculus
cagtctctctgtgtctctgctgg

SEQ ID NO: 207689 - DNA, 19 bp, Mus musculus
tatgtgtatatgtacatgc

SEQ ID NO: 207690 - DNA, 23 bp, Mus musculus
tctctgtgtccctgactgtctta

SEQ ID NO: 207691 - DNA, 23 bp, Mus musculus
tctgacaccttcctgtttccttc

SEQ ID NO: 207692 - DNA, 23 bp, Mus musculus
gactgagtctccctgactgtctc

SEQ ID NO: 207693 - DNA, 23 bp, Mus musculus
gtgtctgtgtgtatgcactatgt

SEQ ID NO: 207694 - DNA, 23 bp, Mus musculus
ccctcgctgtgtcccaaagattt

SEQ ID NO: 207695 - DNA, 21 bp, Mus musculus
tttctcagtgtgtttgttgtg

SEQ ID NO: 207696 - DNA, 23 bp, Mus musculus
ttgtaagttgattttgtactctg

SEQ ID NO: 207697 - DNA, 22 bp, Mus musculus
ctggtcacattcacactgtgtc

SEQ ID NO: 207698 - DNA, 23 bp, Mus musculus
acacatacatatagatgtgtgtg

SEQ ID NO: 207699 - DNA, 18 bp, Mus musculus
acactgtggttctgtcag

SEQ ID NO: 207700 - DNA, 22 bp, Mus musculus
aaatcattttggtcaggctgga

SEQ ID NO: 207701 - DNA, 23 bp, Mus musculus
gtatgagtgtggctgtgctcagt

SEQ ID NO: 207702 - DNA, 23 bp, Mus musculus
cttcactgctggtggttgcgtct

SEQ ID NO: 207703 - DNA, 21 bp, Mus musculus
aacagagaactctgtgagaac

SEQ ID NO: 207704 - DNA, 23 bp, Mus musculus
gtgagtgtgcatctctgtgtgtg

SEQ ID NO: 207705 - DNA, 19 bp, Mus musculus
tatctcagtgggaagcgag

SEQ ID NO: 207706 - DNA, 19 bp, Mus musculus
ttgcttcctctgcctgact

SEQ ID NO: 207707 - DNA, 19 bp, Mus musculus
tgtcagccactcggtctct

SEQ ID NO: 207708 - DNA, 20 bp, Mus musculus
aagattattttacatatgag

SEQ ID NO: 207709 - DNA, 23 bp, Mus musculus
tataaggtttgtgacaatagtga

SEQ ID NO: 207710 - DNA, 23 bp, Mus musculus
aagaggaacttggttgctaagtt

SEQ ID NO: 207711 - DNA, 23 bp, Mus musculus
ggaatggtatgatctacgcccat

SEQ ID NO: 207712 - DNA, 21 bp, Mus musculus
tgccagagatcaggaggtaga

SEQ ID NO: 207713 - DNA, 20 bp, Mus musculus
gcacgtctgtgtcattactg

SEQ ID NO: 207714 - DNA, 23 bp, Mus musculus
ttgtgcaccagtgaaatggctca

SEQ ID NO: 207715 - DNA, 19 bp, Mus musculus
ctgtgtctctctgtccctg

SEQ ID NO: 207716 - DNA, 23 bp, Mus musculus
tgtctcagtcactgttctacctc

SEQ ID NO: 207717 - DNA, 23 bp, Mus musculus
tgtgagtagtctgtgacaggtgt

SEQ ID NO: 207718 - DNA, 23 bp, Mus musculus
atgtgtgtgcaagtccatgtgga

SEQ ID NO: 207719 - DNA, 21 bp, Mus musculus
ctctctctggttattttgtct

SEQ ID NO: 207720 - DNA, 19 bp, Mus musculus
tgtgaacatgtatgcaagt

SEQ ID NO: 207721 - DNA, 23 bp, Mus musculus
tgtctgtctctgtgtgggtgtga

SEQ ID NO: 207722 - DNA, 23 bp, Mus musculus
ttggatgtctactgtatctgttg

SEQ ID NO: 207723 - DNA, 23 bp, Mus musculus
tcactctatgtccctaacttctg

SEQ ID NO: 207724 - DNA, 18 bp, Mus musculus
tgtggatgtaggtagcat

SEQ ID NO: 207725 - DNA, 23 bp, Mus musculus
tctctctgcctgtgtcagcccca

SEQ ID NO: 207726 - DNA, 23 bp, Mus musculus
attcctgggcacagacagtcagt

SEQ ID NO: 207727 - DNA, 22 bp, Mus musculus
tgttttgtgaccaattatatgg

SEQ ID NO: 207728 - DNA, 23 bp, Mus musculus
tgtctttctctgactctgtgcag

SEQ ID NO: 207729 - DNA, 23 bp, Mus musculus
tgtctctcactctggctatctgg

SEQ ID NO: 207730 - DNA, 20 bp, Mus musculus
tgaggctgggtatattctgt

SEQ ID NO: 207731 - DNA, 22 bp, Mus musculus
tctgaggctgagtaaattctgt

SEQ ID NO: 207732 - DNA, 22 bp, Mus musculus
tgacactgtttctcactctgct

SEQ ID NO: 207733 - DNA, 23 bp, Mus musculus
agactgggacggtatgaggtgag

SEQ ID NO: 207734 - DNA, 21 bp, Mus musculus
ctcagcactgtatctctgatg

SEQ ID NO: 207735 - DNA, 21 bp, Mus musculus
gtgtagacagtcctcggtgtc

SEQ ID NO: 207736 - DNA, 21 bp, Mus musculus
atgtgctgagtgtggaagaag

SEQ ID NO: 207737 - DNA, 23 bp, Mus musculus
ccctcacaggctgtgtgtctggg

SEQ ID NO: 207738 - DNA, 23 bp, Mus musculus
tgctgcgtgcattagttgtgttg

SEQ ID NO: 207739 - DNA, 23 bp, Mus musculus
catctactgcaactgcatgtgtt

SEQ ID NO: 207740 - DNA, 23 bp, Mus musculus
cctgtgtgggtgtgactgtgtgg

SEQ ID NO: 207741 - DNA, 23 bp, Mus musculus
ctgtgtgtgcatgtgtatctgct

SEQ ID NO: 207742 - DNA, 23 bp, Mus musculus
tctctgtgtctctgtttcctgtc

SEQ ID NO: 207743 - DNA, 23 bp, Mus musculus
aattccatttttaagctgtagga

SEQ ID NO: 207744 - DNA, 22 bp, Mus musculus
ggagtctctctctctctctctc

SEQ ID NO: 207745 - DNA, 19 bp, Mus musculus
aaggatcaaatccaggtca

SEQ ID NO: 207746 - DNA, 23 bp, Mus musculus
ctgtctgtctgtctgtctgtctg

SEQ ID NO: 207747 - DNA, 18 bp, Mus musculus
actcttggtgagtctctg

SEQ ID NO: 207748 - DNA, 23 bp, Mus musculus
agccctttgtaactgcagtcacc

SEQ ID NO: 207749 - DNA, 20 bp, Mus musculus
atagttattctagagaaggt

SEQ ID NO: 207750 - DNA, 22 bp, Mus musculus
tgtctgctaaactaatgcctta

SEQ ID NO: 207751 - DNA, 20 bp, Mus musculus
gacagttgtgaggcaccaca

SEQ ID NO: 207752 - DNA, 21 bp, Mus musculus
taaactgatcatagagaggag

SEQ ID NO: 207753 - DNA, 23 bp, Mus musculus
atatgtatgtataacatatgtgt

SEQ ID NO: 207754 - DNA, 19 bp, Mus musculus
atgtatgtatatatgtatg

SEQ ID NO: 207755 - DNA, 20 bp, Mus musculus
tagtgggcttcttggtagca

SEQ ID NO: 207756 - DNA, 20 bp, Mus musculus
atgtgtgtgtgtatctgtct

SEQ ID NO: 207757 - DNA, 23 bp, Mus musculus
tgtgtctctgtctctgatctctc

SEQ ID NO: 207758 - DNA, 22 bp, Mus musculus
tgttttgtgaccaattatatgg

SEQ ID NO: 207759 - DNA, 23 bp, Mus musculus
ctctctgtgtgtctctctgtctg

SEQ ID NO: 207760 - DNA, 23 bp, Mus musculus
tgcagtttgagatttgtgtgtct

SEQ ID NO: 207761 - DNA, 23 bp, Mus musculus
tggcacagactctggctgtcact

SEQ ID NO: 207762 - DNA, 23 bp, Mus musculus
cagttcctagttggtagaattgt

SEQ ID NO: 207763 - DNA, 23 bp, Mus musculus
tgttggaggtggtgtgtcactgg

SEQ ID NO: 207764 - DNA, 22 bp, Mus musculus
tgagctcactgaggatagcatc

SEQ ID NO: 207765 - DNA, 23 bp, Mus musculus
cacactgccttctttgtgtctct

SEQ ID NO: 207766 - DNA, 23 bp, Mus musculus
ttataggttgatatgttaagaga

SEQ ID NO: 207767 - DNA, 23 bp, Mus musculus
aaacagaatggtcagtcactctc

SEQ ID NO: 207768 - DNA, 20 bp, Mus musculus
agagagcagtgagtggggag

SEQ ID NO: 207769 - DNA, 23 bp, Mus musculus
tgccagccttatagttctctatg

SEQ ID NO: 207770 - DNA, 23 bp, Mus musculus
ctcagacataccagtgtgatgtt

SEQ ID NO: 207771 - DNA, 19 bp, Mus musculus
tgatcttatgtgtgcaagc

SEQ ID NO: 207772 - DNA, 20 bp, Mus musculus
tcataatttgaaaagctaag

SEQ ID NO: 207773 - DNA, 23 bp, Mus musculus
tctatctatctatctgtgtgttt

SEQ ID NO: 207774 - DNA, 23 bp, Mus musculus
tcatagtaaggagaagctgggtt

SEQ ID NO: 207775 - DNA, 18 bp, Mus musculus
ctctctttctgtctgatt

SEQ ID NO: 207776 - DNA, 23 bp, Mus musculus
agactctctctgtgtgtgtgtgt

SEQ ID NO: 207777 - DNA, 23 bp, Mus musculus
cagctgtctctctgtgtcccacc

SEQ ID NO: 207778 - DNA, 21 bp, Mus musculus
aaaaggtgcacagagtggtca

SEQ ID NO: 207779 - DNA, 23 bp, Mus musculus
tcattgtgaagtgtgtttcttgt

SEQ ID NO: 207780 - DNA, 23 bp, Mus musculus
gcctgacagtatcttgagtacat

SEQ ID NO: 207781 - DNA, 23 bp, Mus musculus
ctcactctgcctggttgtcttga

SEQ ID NO: 207782 - DNA, 23 bp, Mus musculus
gcatgttgagctgttacaacatg

SEQ ID NO: 207783 - DNA, 23 bp, Mus musculus
tattgagacagggtctcttgctg

SEQ ID NO: 207784 - DNA, 20 bp, Mus musculus
ctgtctcttccagtctctct

SEQ ID NO: 207785 - DNA, 23 bp, Mus musculus
gtatgtatatatgtgtgtatgta

SEQ ID NO: 207786 - DNA, 23 bp, Mus musculus
tacatgtccatatatatgcatgt

SEQ ID NO: 207787 - DNA, 23 bp, Mus musculus
gtctcactcactgtgacccacct

SEQ ID NO: 207788 - DNA, 23 bp, Mus musculus
actctctgactgattcaacacag

SEQ ID NO: 207789 - DNA, 21 bp, Mus musculus
agtgtgtccttgactaagcct

SEQ ID NO: 207790 - DNA, 23 bp, Mus musculus
cctgacaccctctctgagtgtat

SEQ ID NO: 207791 - DNA, 22 bp, Mus musculus
tagtttgtccttgactaagcct

SEQ ID NO: 207792 - DNA, 23 bp, Mus musculus
actctctggctgggacagttggg

SEQ ID NO: 207793 - DNA, 23 bp, Mus musculus
gtgtctgtgatgtgtgtgtgcac

SEQ ID NO: 207794 - DNA, 23 bp, Mus musculus
gaaagagcactgactgctcttcc

SEQ ID NO: 207795 - DNA, 23 bp, Mus musculus
atgtatgtatatgtatatatgtg

SEQ ID NO: 207796 - DNA, 19 bp, Mus musculus
atccttgtttctctcacag

SEQ ID NO: 207797 - DNA, 21 bp, Mus musculus
tctggaattcagtggtagagt

SEQ ID NO: 207798 - DNA, 20 bp, Mus musculus
tcagggggataaaaagctct

SEQ ID NO: 207799 - DNA, 19 bp, Mus musculus
gtgtgtgcatatgcatgtg

SEQ ID NO: 207800 - DNA, 23 bp, Mus musculus
tatgtgtgtgcatacgcatgtgt

SEQ ID NO: 207801 - DNA, 23 bp, Mus musculus
tagatgtgtgtgcatatgcatgt

SEQ ID NO: 207802 - DNA, 23 bp, Mus musculus
atatgtgtgcatatgcatgtgtg

SEQ ID NO: 207803 - DNA, 23 bp, Mus musculus
tgcatgtgcatatgcatgtgtgt

SEQ ID NO: 207804 - DNA, 23 bp, Mus musculus
agatgtgtgtgcatatgcatgtg

SEQ ID NO: 207805 - DNA, 22 bp, Mus musculus
tgtgtgtatagatgtgtgtgca

SEQ ID NO: 207806 - DNA, 21 bp, Mus musculus
taagacagggtttctctgtgt

SEQ ID NO: 207807 - DNA, 22 bp, Mus musculus
ttcaattctcagcaaccacatg

SEQ ID NO: 207808 - DNA, 18 bp, Mus musculus
atgaaggtcagaaggtca

SEQ ID NO: 207809 - DNA, 23 bp, Mus musculus
tagtctgtctgtctgtctgtctg

SEQ ID NO: 207810 - DNA, 22 bp, Mus musculus
tgactgcctcagtctctggagt

SEQ ID NO: 207811 - DNA, 20 bp, Mus musculus
aagtctgtccctgtctctgt

SEQ ID NO: 207812 - DNA, 20 bp, Mus musculus
tttgggtctggttcagattt

SEQ ID NO: 207813 - DNA, 23 bp, Mus musculus
ttgtcagttcagtctctgtgagc

SEQ ID NO: 207814 - DNA, 22 bp, Mus musculus
aaggaagctttgggtctgtaga

SEQ ID NO: 207815 - DNA, 23 bp, Mus musculus
tgtgactgtctcactcagccctt

SEQ ID NO: 207816 - DNA, 23 bp, Mus musculus
tactctctcaggtcctgagtgtg

SEQ ID NO: 207817 - DNA, 23 bp, Mus musculus
actctctgctactctctctctct

SEQ ID NO: 207818 - DNA, 23 bp, Mus musculus
agtggattcatgtgttggagcag

SEQ ID NO: 207819 - DNA, 23 bp, Mus musculus
tctgtgtgtgcctgtgtatgttg

SEQ ID NO: 207820 - DNA, 23 bp, Mus musculus
gtgtgtgagtgtgcacatgcatg

SEQ ID NO: 207821 - DNA, 18 bp, Mus musculus
acaggctggaaggatggt

SEQ ID NO: 207822 - DNA, 23 bp, Mus musculus
tatacatacacacacacatacat

SEQ ID NO: 207823 - DNA, 23 bp, Mus musculus
gcgtgcgtgcgtgtgtgcgtgcg

SEQ ID NO: 207824 - DNA, 23 bp, Mus musculus
agacaggttttctttgtttaaca

SEQ ID NO: 207825 - DNA, 23 bp, Mus musculus
aatctcagagatctacctgtctc

SEQ ID NO: 207826 - DNA, 23 bp, Mus musculus
tgtctgtctgtctgtctgtcttt

SEQ ID NO: 207827 - DNA, 21 bp, Mus musculus
aggtcagaggataacttctgt

SEQ ID NO: 207828 - DNA, 23 bp, Mus musculus
gaacactgactgctcttccagag

SEQ ID NO: 207829 - DNA, 19 bp, Mus musculus
tctagaccagcttcacctg

SEQ ID NO: 207830 - DNA, 23 bp, Mus musculus
cattcttgctcctctgtgtgtgt

SEQ ID NO: 207831 - DNA, 19 bp, Mus musculus
taagctatatatgggaacc

SEQ ID NO: 207832 - DNA, 19 bp, Mus musculus
ttactgttttgaaacccgg

SEQ ID NO: 207833 - DNA, 21 bp, Mus musculus
atcaaatctgtcaatcctcta

SEQ ID NO: 207834 - DNA, 22 bp, Mus musculus
gactgactgtgtgactgtggtg

SEQ ID NO: 207835 - DNA, 18 bp, Mus musculus
catgcatatggtatgtgt

SEQ ID NO: 207836 - DNA, 22 bp, Mus musculus
tgacagactctctcacggcctg

SEQ ID NO: 207837 - DNA, 23 bp, Mus musculus
taacttgttgcttgattacgata

SEQ ID NO: 207838 - DNA, 23 bp, Mus musculus
agtctcactggctgtgaacttcc

SEQ ID NO: 207839 - DNA, 23 bp, Mus musculus
ggttttcaatccagtttgtcttt

SEQ ID NO: 207840 - DNA, 23 bp, Mus musculus
tgtgtctgtttgtcactcattca

SEQ ID NO: 207841 - DNA, 18 bp, Mus musculus
agacagggtctcatgttg

SEQ ID NO: 207842 - DNA, 23 bp, Mus musculus
ttgtggtctgtctctttttacac

SEQ ID NO: 207843 - DNA, 23 bp, Mus musculus
caacatggatcaggaactgaggc

SEQ ID NO: 207844 - DNA, 23 bp, Mus musculus
agagcactgacagctcttccaga

SEQ ID NO: 207845 - DNA, 23 bp, Mus musculus
aaaggctgttgatgcgaatcttt

SEQ ID NO: 207846 - DNA, 18 bp, Mus musculus
tacacagtgggaatgctg

SEQ ID NO: 207847 - DNA, 23 bp, Mus musculus
tttctcctctaggctgagcctca

SEQ ID NO: 207848 - DNA, 23 bp, Mus musculus
agagtctggggctgaagagatgg

SEQ ID NO: 207849 - DNA, 22 bp, Mus musculus
tgtcccgtgtcagcactggggt

SEQ ID NO: 207850 - DNA, 23 bp, Mus musculus
gactgtgtggctctgtctccctg

SEQ ID NO: 207851 - DNA, 23 bp, Mus musculus
tgtcagcctctatctctgacttt

SEQ ID NO: 207852 - DNA, 22 bp, Mus musculus
taagccagtttggttaggtagt

SEQ ID NO: 207853 - DNA, 23 bp, Mus musculus
aatgtggttcgtgtacacagtgg

SEQ ID NO: 207854 - DNA, 21 bp, Mus musculus
gacttgagactctaccaggtt

SEQ ID NO: 207855 - DNA, 22 bp, Mus musculus
tgttttgtgaccaattatatgg

SEQ ID NO: 207856 - DNA, 23 bp, Mus musculus
tgtgtgtgtaaagccaaaggttg

SEQ ID NO: 207857 - DNA, 20 bp, Mus musculus
tgtgtgtgtgtgtgtattca

SEQ ID NO: 207858 - DNA, 23 bp, Mus musculus
tctcagactgattttgtttttct

SEQ ID NO: 207859 - DNA, 23 bp, Mus musculus
gtgagtcagtgagtgtgtctgtc

SEQ ID NO: 207860 - DNA, 23 bp, Mus musculus
gtgagtcagtgagtgtgtctgtc

SEQ ID NO: 207861 - DNA, 23 bp, Mus musculus
tgctgacgatctctctgtctctc

SEQ ID NO: 207862 - DNA, 23 bp, Mus musculus
tagtctacttgtcatttagttgt

SEQ ID NO: 207863 - DNA, 23 bp, Mus musculus
ctcagtgagtgagtgtctgcctc

SEQ ID NO: 207864 - DNA, 20 bp, Mus musculus
taatcctgctctctctctct

SEQ ID NO: 207865 - DNA, 23 bp, Mus musculus
tgagtctgcctgcctgcctgtct

SEQ ID NO: 207866 - DNA, 23 bp, Mus musculus
gactgcctctctgagtgtgagca

SEQ ID NO: 207867 - DNA, 23 bp, Mus musculus
actcagtgtgtctgagtaactgc

SEQ ID NO: 207868 - DNA, 18 bp, Mus musculus
ttctctgatgatttcagt

SEQ ID NO: 207869 - DNA, 20 bp, Mus musculus
tctagtgctattcctctgca

SEQ ID NO: 207870 - DNA, 20 bp, Mus musculus
acgaagttctagatcaggtg

SEQ ID NO: 207871 - DNA, 22 bp, Mus musculus
tgttttgtgaccaattatatgg

SEQ ID NO: 207872 - DNA, 22 bp, Mus musculus
tgttttgtgaccaattatatgg

SEQ ID NO: 207873 - DNA, 23 bp, Mus musculus
ctgtgagatcatctggatgtggt

SEQ ID NO: 207874 - DNA, 23 bp, Mus musculus
cgtgctccaaatgctcctgatcc

SEQ ID NO: 207875 - DNA, 22 bp, Mus musculus
tgttttgtgaccaattatatgg

SEQ ID NO: 207876 - DNA, 19 bp, Mus musculus
aggggctgcttgatttgtg

SEQ ID NO: 207877 - DNA, 23 bp, Mus musculus
acagtgtagacagacagcaaaca

SEQ ID NO: 207878 - DNA, 23 bp, Mus musculus
tagtccatggtgatctgatagga

SEQ ID NO: 207879 - DNA, 23 bp, Mus musculus
ttgttttgtgaccaattatgtgg

SEQ ID NO: 207880 - DNA, 23 bp, Mus musculus
agagtctgtctgtctctgtctgt

SEQ ID NO: 207881 - DNA, 23 bp, Mus musculus
cactcactcactcactcactcac

SEQ ID NO: 207882 - DNA, 21 bp, Mus musculus
agtttctggaattgcttgtga

SEQ ID NO: 207883 - DNA, 23 bp, Mus musculus
atctgtcagagagtgaaaattct

SEQ ID NO: 207884 - DNA, 19 bp, Mus musculus
gtatgtatgtatatgtgtg

SEQ ID NO: 207885 - DNA, 22 bp, Mus musculus
tgttttgtgaccaattatatgg

SEQ ID NO: 207886 - DNA, 21 bp, Mus musculus
ttcggtgtgcatttcctctgt

SEQ ID NO: 207887 - DNA, 21 bp, Mus musculus
tatatgtgtatatgtatatgt

SEQ ID NO: 207888 - DNA, 21 bp, Mus musculus
aagacagtgtgtttcatgtgt

SEQ ID NO: 207889 - DNA, 23 bp, Mus musculus
tctgattgtctcatgtgattccg

SEQ ID NO: 207890 - DNA, 23 bp, Mus musculus
gctgtgaactcttgagattgtgt

SEQ ID NO: 207891 - DNA, 22 bp, Mus musculus
tggcatatgaatgagatacatg

SEQ ID NO: 207892 - DNA, 23 bp, Mus musculus
atgtcacagtgactaagcatgtc

SEQ ID NO: 207893 - DNA, 23 bp, Mus musculus
actgtctctgagtcacatattcc

SEQ ID NO: 207894 - DNA, 23 bp, Mus musculus
catatgtattcatggaagtctct

SEQ ID NO: 207895 - DNA, 23 bp, Mus musculus
tctgagtggatgacagaattagg

SEQ ID NO: 207896 - DNA, 20 bp, Mus musculus
agagcagtgagagagcagag

SEQ ID NO: 207897 - DNA, 22 bp, Mus musculus
gtggagtagtagaggcagtctg

SEQ ID NO: 207898 - DNA, 22 bp, Mus musculus
ctggctctctctctggctctct

SEQ ID NO: 207899 - DNA, 23 bp, Mus musculus
tcagtctctgcctctgcctctgc

SEQ ID NO: 207900 - DNA, 22 bp, Mus musculus
atgtatgtatgaatgtgtgtgt

SEQ ID NO: 207901 - DNA, 23 bp, Mus musculus
gtggctctcttcagatggaggag

SEQ ID NO: 207902 - DNA, 18 bp, Mus musculus
tcagaacacagagagggc

SEQ ID NO: 207903 - DNA, 23 bp, Mus musculus
gtgagatgagtctgagcatacca

SEQ ID NO: 207904 - DNA, 23 bp, Mus musculus
agggtgagacagtcaggtaagaa

SEQ ID NO: 207905 - DNA, 22 bp, Mus musculus
gccctcatctgtctgcctgtct

SEQ ID NO: 207906 - DNA, 19 bp, Mus musculus
aatgggacttttgacaagc

SEQ ID NO: 207907 - DNA, 22 bp, Mus musculus
tgttttgtgaccaattatatgg

SEQ ID NO: 207908 - DNA, 23 bp, Mus musculus
agtcacagagacattgagttctg

SEQ ID NO: 207909 - DNA, 23 bp, Mus musculus
ttttgtatctgtggaggcctgtt

SEQ ID NO: 207910 - DNA, 19 bp, Mus musculus
aaactctctgtcttagtag

SEQ ID NO: 207911 - DNA, 23 bp, Mus musculus
ctgtctgtctgtctgtctgttca

SEQ ID NO: 207912 - DNA, 18 bp, Mus musculus
atgtgtgtgtgtacatgt

SEQ ID NO: 207913 - DNA, 18 bp, Mus musculus
tacacatacaagtataca

SEQ ID NO: 207914 - DNA, 18 bp, Mus musculus
ataagtacatgtatttga

SEQ ID NO: 207915 - DNA, 23 bp, Mus musculus
gtatatgtgtgtgcatgtacata

SEQ ID NO: 207916 - DNA, 23 bp, Mus musculus
acagagctggaggtgcagtgtca

SEQ ID NO: 207917 - DNA, 19 bp, Mus musculus
atgtatatacatcatgtac

SEQ ID NO: 207918 - DNA, 23 bp, Mus musculus
atctctggttctctgtgtctctc

SEQ ID NO: 207919 - DNA, 23 bp, Mus musculus
tgtctgtctgtctgtgtgcatgt

SEQ ID NO: 207920 - DNA, 23 bp, Mus musculus
tgcatctctgtctgtatctactg

SEQ ID NO: 207921 - DNA, 23 bp, Mus musculus
ctttgacgttctaatgccacagt

SEQ ID NO: 207922 - DNA, 22 bp, Mus musculus
tcagagagaagacagtgggaat

SEQ ID NO: 207923 - DNA, 21 bp, Mus musculus
ttggtagtttgacatattgta

SEQ ID NO: 207924 - DNA, 23 bp, Mus musculus
aggagcctgagtgaagatctgga

SEQ ID NO: 207925 - DNA, 21 bp, Mus musculus
tgtttccctgacagcttgcca

SEQ ID NO: 207926 - DNA, 22 bp, Mus musculus
tgagaactgaattccatgggtt

SEQ ID NO: 207927 - DNA, 23 bp, Mus musculus
cagacctgtgaaattcagttctt

SEQ ID NO: 207928 - DNA, 23 bp, Mus musculus
tgacacatgctgttgttggggta

SEQ ID NO: 207929 - DNA, 20 bp, Mus musculus
tgtgtctctctgagtcttca

SEQ ID NO: 207930 - DNA, 21 bp, Mus musculus
tgtgatgtttaggctagcttg

SEQ ID NO: 207931 - DNA, 19 bp, Mus musculus
tgtgcataatgtatgcatg

SEQ ID NO: 207932 - DNA, 23 bp, Mus musculus
gacttctcagactgtgagctggt

SEQ ID NO: 207933 - DNA, 19 bp, Mus musculus
gagtagctccacttccaga

SEQ ID NO: 207934 - DNA, 23 bp, Mus musculus
actctgacacgtgacagtggtca

SEQ ID NO: 207935 - DNA, 23 bp, Mus musculus
aaaggtgttgtcatagtctgctg

SEQ ID NO: 207936 - DNA, 23 bp, Mus musculus
tctgtggattgtagtgtggttat

SEQ ID NO: 207937 - DNA, 19 bp, Mus musculus
tgtgtgcatgcctgcatgc

SEQ ID NO: 207938 - DNA, 23 bp, Mus musculus
tagtgcatggtgatctgatagga

SEQ ID NO: 207939 - DNA, 22 bp, Mus musculus
tgttttgtgacctattatgtgg

SEQ ID NO: 207940 - DNA, 22 bp, Mus musculus
tgttttgtgaccaattatatgg

SEQ ID NO: 207941 - DNA, 21 bp, Mus musculus
tatgtgtatgtgtatatgtga

SEQ ID NO: 207942 - DNA, 23 bp, Mus musculus
atgtgtatatttgtatatgtatg

SEQ ID NO: 207943 - DNA, 22 bp, Mus musculus
tgttttgtgaccaattatatgg

SEQ ID NO: 207944 - DNA, 23 bp, Mus musculus
tgtgtatgtatatatgtatgtat

SEQ ID NO: 207945 - DNA, 18 bp, Mus musculus
tcagaggacagtcaggcc

SEQ ID NO: 207946 - DNA, 21 bp, Mus musculus
atgtatgtatgcatctgcatg

SEQ ID NO: 207947 - DNA, 23 bp, Mus musculus
tttcttaggacttactcttattc

SEQ ID NO: 207948 - DNA, 23 bp, Mus musculus
tatatgcatatttatctgtatgt

SEQ ID NO: 207949 - DNA, 23 bp, Mus musculus
aagtcttgtgtattagatgtctt

SEQ ID NO: 207950 - DNA, 23 bp, Mus musculus
gtatgtgtgcaagagcatgtgaa

SEQ ID NO: 207951 - DNA, 20 bp, Mus musculus
agtgttacctattgtcagtc

SEQ ID NO: 207952 - DNA, 23 bp, Mus musculus
tagtccatggtgatctgatagga

SEQ ID NO: 207953 - DNA, 23 bp, Mus musculus
tcacatcagagacttgacaagtt

SEQ ID NO: 207954 - DNA, 23 bp, Mus musculus
tcagtgtctctgtaacatctgtc

SEQ ID NO: 207955 - DNA, 21 bp, Mus musculus
tcaagaagtcagtgttttctg

SEQ ID NO: 207956 - DNA, 23 bp, Mus musculus
taagaattcacagtcattttgat

SEQ ID NO: 207957 - DNA, 18 bp, Mus musculus
tacataggcaggttaggt

SEQ ID NO: 207958 - DNA, 23 bp, Mus musculus
tctggttgtacaatcagctagtg

SEQ ID NO: 207959 - DNA, 19 bp, Mus musculus
atgaagttgtgttccagaa

SEQ ID NO: 207960 - DNA, 22 bp, Mus musculus
actgccagacacactctgctct

SEQ ID NO: 207961 - DNA, 23 bp, Mus musculus
gtctctctgtgtcacttgcctgt

SEQ ID NO: 207962 - DNA, 19 bp, Mus musculus
gatttttctttttggtgta

SEQ ID NO: 207963 - DNA, 22 bp, Mus musculus
tgttttgtgaccaattatatgg

SEQ ID NO: 207964 - DNA, 23 bp, Mus musculus
tatgtatatatatatgtgtgtgt

SEQ ID NO: 207965 - DNA, 22 bp, Mus musculus
cttcatatctgatgatgaagct

SEQ ID NO: 207966 - DNA, 23 bp, Mus musculus
ttatttacagttttagatgttgt

SEQ ID NO: 207967 - DNA, 23 bp, Mus musculus
tgagtcattgtgaataagccttt

SEQ ID NO: 207968 - DNA, 23 bp, Mus musculus
aacagatgctgctgtctctctat

SEQ ID NO: 207969 - DNA, 23 bp, Mus musculus
atatgtatgcatgtacaaatagt

SEQ ID NO: 207970 - DNA, 20 bp, Mus musculus
tcatctaaggaatgactgac

SEQ ID NO: 207971 - DNA, 23 bp, Mus musculus
tgcatcgagaagaacgtggtggg

SEQ ID NO: 207972 - DNA, 23 bp, Mus musculus
atatcgcattttctccatctgtt

SEQ ID NO: 207973 - DNA, 20 bp, Mus musculus
atctatctctatctatagag

SEQ ID NO: 207974 - DNA, 21 bp, Mus musculus
aacagagaggaggcgctcttt

SEQ ID NO: 207975 - DNA, 22 bp, Mus musculus
tgtgtatgtatgtgtgtgtata

SEQ ID NO: 207976 - DNA, 21 bp, Mus musculus
ttatgtgttatctctctgtct

SEQ ID NO: 207977 - DNA, 23 bp, Mus musculus
gtgtctgtatctgtgtctgtgtg

SEQ ID NO: 207978 - DNA, 23 bp, Mus musculus
agttagtggaactctttgggaag

SEQ ID NO: 207979 - DNA, 23 bp, Mus musculus
acagtcacagactctgttctagc

SEQ ID NO: 207980 - DNA, 22 bp, Mus musculus
tctgtacgaccaagtgtttgca

SEQ ID NO: 207981 - DNA, 20 bp, Mus musculus
tgtgtgtatatatatgagtg

SEQ ID NO: 207982 - DNA, 22 bp, Mus musculus
tgtgtatatgtatatgtgtgag

SEQ ID NO: 207983 - DNA, 20 bp, Mus musculus
taagtgtatatacatatgag

SEQ ID NO: 207984 - DNA, 23 bp, Mus musculus
atgtgtgtatatacatatgtgtg

SEQ ID NO: 207985 - DNA, 23 bp, Mus musculus
cagttctctgtgtgtataagccc

SEQ ID NO: 207986 - DNA, 23 bp, Mus musculus
ctgtaagtggtaaatatagacat

SEQ ID NO: 207987 - DNA, 23 bp, Mus musculus
agtgtgtgagacacagtagttgc

SEQ ID NO: 207988 - DNA, 23 bp, Mus musculus
atctctgtgagctcaagaccagt

SEQ ID NO: 207989 - DNA, 23 bp, Mus musculus
tctcggacagtggttttcctctg

SEQ ID NO: 207990 - DNA, 21 bp, Mus musculus
agaagtagagacagacagaca

SEQ ID NO: 207991 - DNA, 23 bp, Mus musculus
atgaagacccagtgtctgtgtgt

SEQ ID NO: 207992 - DNA, 23 bp, Mus musculus
ccactcactcggagtctccctgc

SEQ ID NO: 207993 - DNA, 23 bp, Mus musculus
cactcagagaagagagggtggac

SEQ ID NO: 207994 - DNA, 21 bp, Mus musculus
gagttgaagcagagaccgtga

SEQ ID NO: 207995 - DNA, 22 bp, Mus musculus
tagcatgaaggtgctctcttct

SEQ ID NO: 207996 - DNA, 23 bp, Mus musculus
ttcagagaggaggaggtctgtag

SEQ ID NO: 207997 - DNA, 23 bp, Mus musculus
gttcagagtcatcagactggacg

SEQ ID NO: 207998 - DNA, 19 bp, Mus musculus
agtgtacagggcatcctct

SEQ ID NO: 207999 - DNA, 22 bp, Mus musculus
tgacccactgacccactgttgt

SEQ ID NO: 208000 - DNA, 23 bp, Mus musculus
cgggactgtgtgtggaacaagag

SEQ ID NO: 208001 - DNA, 19 bp, Mus musculus
actttctgtgctttccctg

SEQ ID NO: 208002 - DNA, 21 bp, Mus musculus
catctgatcacagagagcaca

SEQ ID NO: 208003 - DNA, 23 bp, Mus musculus
caatagctgcaggagactgagga

SEQ ID NO: 208004 - DNA, 19 bp, Mus musculus
tcactccctcagagactgg

SEQ ID NO: 208005 - DNA, 21 bp, Mus musculus
tctctgtgtctctgtctctct

SEQ ID NO: 208006 - DNA, 23 bp, Mus musculus
aacactgagagggacactaaggg

SEQ ID NO: 208007 - DNA, 22 bp, Mus musculus
tcacacaggcataaatacaggc

SEQ ID NO: 208008 - DNA, 23 bp, Mus musculus
atgttggagcgcagattgtcagt

SEQ ID NO: 208009 - DNA, 23 bp, Mus musculus
cacttgtgtgtctgtgttcttgc

SEQ ID NO: 208010 - DNA, 23 bp, Mus musculus
tgacagaagtacaattgtgagca

SEQ ID NO: 208011 - DNA, 23 bp, Mus musculus
tgattcaggaagggaatgtattg

SEQ ID NO: 208012 - DNA, 23 bp, Mus musculus
tgtctgtgtgtctgtctgtcctt

SEQ ID NO: 208013 - DNA, 19 bp, Mus musculus
cagagactcagtgcctcag

SEQ ID NO: 208014 - DNA, 18 bp, Mus musculus
agagtgctgaaggatgag

SEQ ID NO: 208015 - DNA, 19 bp, Mus musculus
tctgctccagttttctaag

SEQ ID NO: 208016 - DNA, 23 bp, Mus musculus
tcagcttctaactcactgctcag

SEQ ID NO: 208017 - DNA, 22 bp, Mus musculus
tctgtctgcctgtgaccgtgct

SEQ ID NO: 208018 - DNA, 23 bp, Mus musculus
tgtgtgtgcatgtgcaagtgtaa

SEQ ID NO: 208019 - DNA, 20 bp, Mus musculus
agtgaccatgcagagtgggt

SEQ ID NO: 208020 - DNA, 23 bp, Mus musculus
gtgtcactgtgtcactgtgtcac

SEQ ID NO: 208021 - DNA, 23 bp, Mus musculus
aaacttgctgtggctctgttcac

SEQ ID NO: 208022 - DNA, 21 bp, Mus musculus
aatacacattcagattccaca

SEQ ID NO: 208023 - DNA, 22 bp, Mus musculus
tattatgtacatgtatatatgt

SEQ ID NO: 208024 - DNA, 19 bp, Mus musculus
tatactcaatgattggtca

SEQ ID NO: 208025 - DNA, 22 bp, Mus musculus
cactgtctcagtctgtgtgagc

SEQ ID NO: 208026 - DNA, 21 bp, Mus musculus
tgtctgcctgtgtctgtctgt

SEQ ID NO: 208027 - DNA, 23 bp, Mus musculus
tcaactgctggcactctctcttg

SEQ ID NO: 208028 - DNA, 19 bp, Mus musculus
actggatctttgagttttc

SEQ ID NO: 208029 - DNA, 23 bp, Mus musculus
gtgtatgtgtatgtgcatgtgca

SEQ ID NO: 208030 - DNA, 23 bp, Mus musculus
ggacagtagactgaaagcagagg

SEQ ID NO: 208031 - DNA, 23 bp, Mus musculus
tctgtctgtctgtctgtctgttt

SEQ ID NO: 208032 - DNA, 23 bp, Mus musculus
tttatatgtatgcaatgtgtgtg

SEQ ID NO: 208033 - DNA, 23 bp, Mus musculus
tgagtgaagtgagtcacaaaagt

SEQ ID NO: 208034 - DNA, 22 bp, Mus musculus
tttgtggttcatctggtcttga

SEQ ID NO: 208035 - DNA, 21 bp, Mus musculus
tgtgtgtgtgtgtgagtctgt

SEQ ID NO: 208036 - DNA, 23 bp, Mus musculus
ccctgtctcacttactctgtctc

SEQ ID NO: 208037 - DNA, 23 bp, Mus musculus
tcagatccagaatctgtctgtct

SEQ ID NO: 208038 - DNA, 23 bp, Mus musculus
gtcactgtctgttagtctgtcca

SEQ ID NO: 208039 - DNA, 20 bp, Mus musculus
tccctggcagtctttattgt

SEQ ID NO: 208040 - DNA, 23 bp, Mus musculus
gagagcactggctgctcttgtag

SEQ ID NO: 208041 - DNA, 23 bp, Mus musculus
ttagtccatggtgatctgatagg

SEQ ID NO: 208042 - DNA, 23 bp, Mus musculus
actgattatatggtcagttttga

SEQ ID NO: 208043 - DNA, 23 bp, Mus musculus
ttacattcttttacttgctttga

SEQ ID NO: 208044 - DNA, 20 bp, Mus musculus
tttcagacagataaccaaca

SEQ ID NO: 208045 - DNA, 23 bp, Mus musculus
agtcactgtctctctaactggga

SEQ ID NO: 208046 - DNA, 23 bp, Mus musculus
tcaatcatgaaagcaattttatg

SEQ ID NO: 208047 - DNA, 20 bp, Mus musculus
atgtatgtgtgtatgtgtgt

SEQ ID NO: 208048 - DNA, 22 bp, Mus musculus
gtatgtatggatgtgtgtgtga

SEQ ID NO: 208049 - DNA, 23 bp, Mus musculus
agttccttgttattctagctgca

SEQ ID NO: 208050 - DNA, 19 bp, Mus musculus
caggacaaaggattttcag

SEQ ID NO: 208051 - DNA, 20 bp, Mus musculus
actgaacttccaataatgtg

SEQ ID NO: 208052 - DNA, 18 bp, Mus musculus
ttgacacaagatagtgtc

SEQ ID NO: 208053 - DNA, 22 bp, Mus musculus
tagtccatggtgatttgatagg

SEQ ID NO: 208054 - DNA, 22 bp, Mus musculus
tgttttgtgaccaattatatgg

SEQ ID NO: 208055 - DNA, 19 bp, Mus musculus
aattattacaggtcctctt

SEQ ID NO: 208056 - DNA, 21 bp, Mus musculus
ctggtttgctcttcctggctt

SEQ ID NO: 208057 - DNA, 23 bp, Mus musculus
tagtccatagtgatctgatagga

SEQ ID NO: 208058 - DNA, 22 bp, Mus musculus
tgttttgtgaccaattatatgg

SEQ ID NO: 208059 - DNA, 23 bp, Mus musculus
atttgcaagtaaagatgtaagga

SEQ ID NO: 208060 - DNA, 23 bp, Mus musculus
tgacctagatggttctattgttt

SEQ ID NO: 208061 - DNA, 23 bp, Mus musculus
cttgtgaactgtaaaaggtttct

SEQ ID NO: 208062 - DNA, 18 bp, Mus musculus
acacatacataggtgtat

SEQ ID NO: 208063 - DNA, 23 bp, Mus musculus
tgtatgtatatgcatgtgtttcc

SEQ ID NO: 208064 - DNA, 21 bp, Mus musculus
tgggacttcatctaattgcat

SEQ ID NO: 208065 - DNA, 23 bp, Mus musculus
tttgctatttatgtatatgtgta

SEQ ID NO: 208066 - DNA, 21 bp, Mus musculus
atctcagtccctaactctgtc

SEQ ID NO: 208067 - DNA, 19 bp, Mus musculus
tcagtgtctcagaggaagc

SEQ ID NO: 208068 - DNA, 21 bp, Mus musculus
tgtctctctaagtgactctgt

SEQ ID NO: 208069 - DNA, 20 bp, Mus musculus
atatgtgtatgtatatgcat

SEQ ID NO: 208070 - DNA, 23 bp, Mus musculus
gagagtaaacagagagcagttgt

SEQ ID NO: 208071 - DNA, 23 bp, Mus musculus
agtgttctgagagaatgttttca

SEQ ID NO: 208072 - DNA, 22 bp, Mus musculus
tcagatataggattggtaaaga

SEQ ID NO: 208073 - DNA, 22 bp, Mus musculus
tcactgagtctaagaatgatgt

SEQ ID NO: 208074 - DNA, 21 bp, Mus musculus
aatgctaattttaggcctgtg

SEQ ID NO: 208075 - DNA, 21 bp, Mus musculus
tgagagtagtctgtcagatga

SEQ ID NO: 208076 - DNA, 23 bp, Mus musculus
gttatcttaggccactgtttgca

SEQ ID NO: 208077 - DNA, 23 bp, Mus musculus
ttttgcattgatattcgtaaggg

SEQ ID NO: 208078 - DNA, 22 bp, Mus musculus
tgttttgtgaccaattatatgg

SEQ ID NO: 208079 - DNA, 23 bp, Mus musculus
cttcactgcctccctgtttccca

SEQ ID NO: 208080 - DNA, 23 bp, Mus musculus
ttagcttttcatttgtaagagga

SEQ ID NO: 208081 - DNA, 23 bp, Mus musculus
gtgctttctctgtctctctgagc

SEQ ID NO: 208082 - DNA, 19 bp, Mus musculus
tggctgctatgtttgctgg

SEQ ID NO: 208083 - DNA, 23 bp, Mus musculus
ttattgtgtctggtatgattggt

SEQ ID NO: 208084 - DNA, 18 bp, Mus musculus
tatcatcgtgcttgatgt

SEQ ID NO: 208085 - DNA, 23 bp, Mus musculus
ctgtgtctgactgtgtcttgtcc

SEQ ID NO: 208086 - DNA, 23 bp, Mus musculus
atttgtggaagttctgaagtgac

SEQ ID NO: 208087 - DNA, 19 bp, Mus musculus
tagatgtagcaaaatgatt

SEQ ID NO: 208088 - DNA, 23 bp, Mus musculus
attgtatgtatatgtatgtgtat

SEQ ID NO: 208089 - DNA, 18 bp, Mus musculus
ctactgtgttcaaaacca

SEQ ID NO: 208090 - DNA, 23 bp, Mus musculus
tccctgtgtcatactatgcaatt

SEQ ID NO: 208091 - DNA, 18 bp, Mus musculus
tacacacacacgtacaca

SEQ ID NO: 208092 - DNA, 23 bp, Mus musculus
tttggatttcttcagaatctgtt

SEQ ID NO: 208093 - DNA, 23 bp, Mus musculus
atttgtgcatgttcatgtgcaca

SEQ ID NO: 208094 - DNA, 23 bp, Mus musculus
tagtgagtgctcttccagaggtc

SEQ ID NO: 208095 - DNA, 20 bp, Mus musculus
tatgtatatgtatatgtata

SEQ ID NO: 208096 - DNA, 23 bp, Mus musculus
tataatgtatatgtatatgtata

SEQ ID NO: 208097 - DNA, 23 bp, Mus musculus
atgtcagagaatacttcccaagc

SEQ ID NO: 208098 - DNA, 19 bp, Mus musculus
tgtgtgtatgtatgtatgt

SEQ ID NO: 208099 - DNA, 23 bp, Mus musculus
taggtagatagatagatagatag

SEQ ID NO: 208100 - DNA, 22 bp, Mus musculus
acgctgtctctcattcacgctg

SEQ ID NO: 208101 - DNA, 23 bp, Mus musculus
tcagcatcagagagtgtgttgtg

SEQ ID NO: 208102 - DNA, 23 bp, Mus musculus
tctctctcactctctagaattca

SEQ ID NO: 208103 - DNA, 23 bp, Mus musculus
tctgggtgtgtcagagttcttgg

SEQ ID NO: 208104 - DNA, 23 bp, Mus musculus
acctctgagacactgagaccctg

SEQ ID NO: 208105 - DNA, 21 bp, Mus musculus
acagtacatgcactgatatta

SEQ ID NO: 208106 - DNA, 23 bp, Mus musculus
tgtgtgcatgtgcatgcatatgt

SEQ ID NO: 208107 - DNA, 23 bp, Mus musculus
tcaggtactgcatgtatacagtg

SEQ ID NO: 208108 - DNA, 23 bp, Mus musculus
ctgactgactgactgactgactg

SEQ ID NO: 208109 - DNA, 23 bp, Mus musculus
tgtgtttcctgtgacagtgtgta

SEQ ID NO: 208110 - DNA, 22 bp, Mus musculus
tgtttctctccatctcactatg

SEQ ID NO: 208111 - DNA, 23 bp, Mus musculus
tcttagatcctctgcaactgtga

SEQ ID NO: 208112 - DNA, 23 bp, Mus musculus
acgggctggagagatggttcagt

SEQ ID NO: 208113 - DNA, 23 bp, Mus musculus
tgcatgtatgcatgtatgtatgt

SEQ ID NO: 208114 - DNA, 18 bp, Mus musculus
gacactcagtgtgactgg

SEQ ID NO: 208115 - DNA, 23 bp, Mus musculus
gaagactgagtgtcttcctggct

SEQ ID NO: 208116 - DNA, 21 bp, Mus musculus
acgaaaagaaagaagtctatg

SEQ ID NO: 208117 - DNA, 23 bp, Mus musculus
ttcccagtcaccacatggtggtc

SEQ ID NO: 208118 - DNA, 19 bp, Mus musculus
agagaagagggactgttgt

SEQ ID NO: 208119 - DNA, 23 bp, Mus musculus
aacctatcgttctctctctctct

SEQ ID NO: 208120 - DNA, 22 bp, Mus musculus
atgtccttcccttttgtttgtg

SEQ ID NO: 208121 - DNA, 23 bp, Mus musculus
tcactgacagacatgttctaggg

SEQ ID NO: 208122 - DNA, 23 bp, Mus musculus
ttcacacagaaatgactgagcag

SEQ ID NO: 208123 - DNA, 23 bp, Mus musculus
tagttttagagcatgtccttggg

SEQ ID NO: 208124 - DNA, 23 bp, Mus musculus
tttctctgtgtagctctctctgt

SEQ ID NO: 208125 - DNA, 23 bp, Mus musculus
ttggtggatttcatttgcatgca

SEQ ID NO: 208126 - DNA, 21 bp, Mus musculus
tatatgtcctggaaggtgaca

SEQ ID NO: 208127 - DNA, 23 bp, Mus musculus
aggaagttagaatttcaaatgtt

SEQ ID NO: 208128 - DNA, 23 bp, Mus musculus
ttagagcataaacagtagcaaat

SEQ ID NO: 208129 - DNA, 23 bp, Mus musculus
ttgtatgtgtgcatgtgcatgtg

SEQ ID NO: 208130 - DNA, 22 bp, Mus musculus
ctctgtgactgtcagcctgtgc

SEQ ID NO: 208131 - DNA, 23 bp, Mus musculus
aatcagtgttgatctgataggat

SEQ ID NO: 208132 - DNA, 23 bp, Mus musculus
ttgtctagtctatttgatgttct

SEQ ID NO: 208133 - DNA, 21 bp, Mus musculus
tttcttctatgattttgttga

SEQ ID NO: 208134 - DNA, 20 bp, Mus musculus
tggctcagtggttaggagca

SEQ ID NO: 208135 - DNA, 23 bp, Mus musculus
tagtccatggtgatctgatagga

SEQ ID NO: 208136 - DNA, 21 bp, Mus musculus
tgtgatcaattatatggttaa

SEQ ID NO: 208137 - DNA, 19 bp, Mus musculus
tgaggttccagggtcagct

SEQ ID NO: 208138 - DNA, 23 bp, Mus musculus
tgtgtgtgtgtatgtatatatgt

SEQ ID NO: 208139 - DNA, 22 bp, Mus musculus
gatgtctagtgtttgtctagaa

SEQ ID NO: 208140 - DNA, 23 bp, Mus musculus
tgtctgtctgtctgtgtgtgtgc

SEQ ID NO: 208141 - DNA, 23 bp, Mus musculus
tcagttctctgtgtgaaacagca

SEQ ID NO: 208142 - DNA, 23 bp, Mus musculus
aactagatggttctattgttctg

SEQ ID NO: 208143 - DNA, 20 bp, Mus musculus
tatgtatacatgtacatgta

SEQ ID NO: 208144 - DNA, 23 bp, Mus musculus
tatatacaatatgtatatatgta

SEQ ID NO: 208145 - DNA, 23 bp, Mus musculus
atatatgtgtgtgtatatgtata

SEQ ID NO: 208146 - DNA, 19 bp, Mus musculus
taggaccagggttcaattc

SEQ ID NO: 208147 - DNA, 20 bp, Mus musculus
ttctgtagagattttcttga

SEQ ID NO: 208148 - DNA, 23 bp, Mus musculus
tctgtctctctaaagcgtctggt

SEQ ID NO: 208149 - DNA, 22 bp, Mus musculus
gggtctctggctctctctcagg

SEQ ID NO: 208150 - DNA, 23 bp, Mus musculus
tcatgtctggctcagtctctgcc

SEQ ID NO: 208151 - DNA, 23 bp, Mus musculus
tgtgactgtctcagtgcaggtca

SEQ ID NO: 208152 - DNA, 22 bp, Mus musculus
ttgctcagagatagctcgctct

SEQ ID NO: 208153 - DNA, 19 bp, Mus musculus
tcagtggaaaaggatgtgc

SEQ ID NO: 208154 - DNA, 19 bp, Mus musculus
ttgcctgatgatagtgatg

SEQ ID NO: 208155 - DNA, 20 bp, Mus musculus
tatgctgtgaaggtagatct

SEQ ID NO: 208156 - DNA, 22 bp, Mus musculus
tatgtatatgtatgtatacata

SEQ ID NO: 208157 - DNA, 22 bp, Mus musculus
ttatatgtacatatacatattg

SEQ ID NO: 208158 - DNA, 23 bp, Mus musculus
tatgtatgtatatatgtatgtag

SEQ ID NO: 208159 - DNA, 21 bp, Mus musculus
tactggacatgtgtgggagtc

SEQ ID NO: 208160 - DNA, 23 bp, Mus musculus
atgtgtgtgtgcatatgcatgtg

SEQ ID NO: 208161 - DNA, 22 bp, Mus musculus
tgttttgtgaccaattatatgg

SEQ ID NO: 208162 - DNA, 21 bp, Mus musculus
aacattcatgagtgtgggtat

SEQ ID NO: 208163 - DNA, 23 bp, Mus musculus
gtatgtatgtatgtatgtatgta

SEQ ID NO: 208164 - DNA, 20 bp, Mus musculus
atagggacatgaacaattta

SEQ ID NO: 208165 - DNA, 22 bp, Mus musculus
tgttttgtgaccaattatatgg

SEQ ID NO: 208166 - DNA, 23 bp, Mus musculus
acttctctctctctcagattttc

SEQ ID NO: 208167 - DNA, 23 bp, Mus musculus
gagtcttcactggtctttgctta

SEQ ID NO: 208168 - DNA, 21 bp, Mus musculus
ctgagaaaggcacagttgaga

SEQ ID NO: 208169 - DNA, 23 bp, Mus musculus
ggtgaccctgtctctgtctgtcc

SEQ ID NO: 208170 - DNA, 22 bp, Mus musculus
atagtggtagaatataggtgca

SEQ ID NO: 208171 - DNA, 22 bp, Mus musculus
tgttttgtgaccaattatatgg

SEQ ID NO: 208172 - DNA, 22 bp, Mus musculus
cttagtccatggtgatctgata

SEQ ID NO: 208173 - DNA, 23 bp, Mus musculus
ctatatatatgtgtatgtatatg

SEQ ID NO: 208174 - DNA, 21 bp, Mus musculus
gagttagttggtagtattgtt

SEQ ID NO: 208175 - DNA, 23 bp, Mus musculus
tctctctgtctctgtccggcttg

SEQ ID NO: 208176 - DNA, 23 bp, Mus musculus
tgatgaaaagaaagcatattctt

SEQ ID NO: 208177 - DNA, 22 bp, Mus musculus
aatatctattagtttcattgtg

SEQ ID NO: 208178 - DNA, 23 bp, Mus musculus
taaagtgtatttctagttgacta

SEQ ID NO: 208179 - DNA, 22 bp, Mus musculus
tctgttgcagacttacatttca

SEQ ID NO: 208180 - DNA, 22 bp, Mus musculus
tgttttgtgaccaattatatgg

SEQ ID NO: 208181 - DNA, 23 bp, Mus musculus
atacatgtctatgtgtatatatg

SEQ ID NO: 208182 - DNA, 23 bp, Mus musculus
ccacactgtaactctgtggctct

SEQ ID NO: 208183 - DNA, 23 bp, Mus musculus
tgcctctcacagtctccttgcct

SEQ ID NO: 208184 - DNA, 23 bp, Mus musculus
gggtgggtcagtagctagtgact

SEQ ID NO: 208185 - DNA, 21 bp, Mus musculus
aaagtacttcaaggtgaccag

SEQ ID NO: 208186 - DNA, 23 bp, Mus musculus
actctctctctctggtaaccttt

SEQ ID NO: 208187 - DNA, 21 bp, Mus musculus
tgggaagtagaacaggagcag

SEQ ID NO: 208188 - DNA, 23 bp, Mus musculus
ctggctgagaccttgctgccact

SEQ ID NO: 208189 - DNA, 19 bp, Mus musculus
cctagatggttctattgtt

SEQ ID NO: 208190 - DNA, 22 bp, Mus musculus
aactgagagttgacagacacca

SEQ ID NO: 208191 - DNA, 22 bp, Mus musculus
tgttttgtgaccaattatatgg

SEQ ID NO: 208192 - DNA, 23 bp, Mus musculus
tatgcatgtatgcatgtatgtat

SEQ ID NO: 208193 - DNA, 22 bp, Mus musculus
tgttttgtgaccaattatatgg

SEQ ID NO: 208194 - DNA, 23 bp, Mus musculus
gtcacttctcagtcactctctga

SEQ ID NO: 208195 - DNA, 23 bp, Mus musculus
tgacagtctctgagtatctgcct

SEQ ID NO: 208196 - DNA, 18 bp, Mus musculus
atatatgtatgtatagat

SEQ ID NO: 208197 - DNA, 22 bp, Mus musculus
aacagaatttaagaaaaggcat

SEQ ID NO: 208198 - DNA, 22 bp, Mus musculus
tgttttgtgaccaattatatgg

SEQ ID NO: 208199 - DNA, 22 bp, Mus musculus
tgttttgtgaccaattatatgg

SEQ ID NO: 208200 - DNA, 23 bp, Mus musculus
tactgtctctgactgttgcttgt

SEQ ID NO: 208201 - DNA, 23 bp, Mus musculus
aaaaggtagaaagttgtttagaa

SEQ ID NO: 208202 - DNA, 22 bp, Mus musculus
tatctaggactacttctccttt

SEQ ID NO: 208203 - DNA, 19 bp, Mus musculus
tatgtagttagatttagag

SEQ ID NO: 208204 - DNA, 23 bp, Mus musculus
aaaatgtatgtatgcatgtgtga

SEQ ID NO: 208205 - DNA, 23 bp, Mus musculus
tcagatctgaactgtgtctctgt

SEQ ID NO: 208206 - DNA, 22 bp, Mus musculus
tgttttgtgaccaattatatgg

SEQ ID NO: 208207 - DNA, 23 bp, Mus musculus
tgcctcagtgcctctgtgcttcc

SEQ ID NO: 208208 - DNA, 23 bp, Mus musculus
cacagagagaagagtctgaccag

SEQ ID NO: 208209 - DNA, 21 bp, Mus musculus
ttcagtatacttgaagtgaac

SEQ ID NO: 208210 - DNA, 23 bp, Mus musculus
ttgaagggacaggctgttttctg

SEQ ID NO: 208211 - DNA, 19 bp, Mus musculus
tgagtagaatgttgtcagc

SEQ ID NO: 208212 - DNA, 19 bp, Mus musculus
ctcctaaatttgatgtgtg

SEQ ID NO: 208213 - DNA, 22 bp, Mus musculus
tgtcttggagtccctctctgtt

SEQ ID NO: 208214 - DNA, 23 bp, Mus musculus
tgagacacccttgttcctgtcac

SEQ ID NO: 208215 - DNA, 23 bp, Mus musculus
tcagctagaagcttctttcctgt

SEQ ID NO: 208216 - DNA, 22 bp, Mus musculus
aaagctagtcattttgatgttc

SEQ ID NO: 208217 - DNA, 23 bp, Mus musculus
tagtccatggtgatctgatagga

SEQ ID NO: 208218 - DNA, 22 bp, Mus musculus
tgttttgtgaccaattatatgg

SEQ ID NO: 208219 - DNA, 23 bp, Mus musculus
tgttaacattcaactctcactcc

SEQ ID NO: 208220 - DNA, 23 bp, Mus musculus
tgtttggttttctagctgatagt

SEQ ID NO: 208221 - DNA, 23 bp, Mus musculus
ggcttcacagtgggaaacataag

SEQ ID NO: 208222 - DNA, 23 bp, Mus musculus
gtgtctgtctgtctgtgtatttg

SEQ ID NO: 208223 - DNA, 23 bp, Mus musculus
tcttactgcaacttgatatgcca

SEQ ID NO: 208224 - DNA, 19 bp, Mus musculus
tgcctgtctcctctgtaag

SEQ ID NO: 208225 - DNA, 23 bp, Mus musculus
cccagcttaaaagtgtgtgtgca

SEQ ID NO: 208226 - DNA, 23 bp, Mus musculus
cagaaagtactgaaactgatgtt

SEQ ID NO: 208227 - DNA, 22 bp, Mus musculus
tgttttgtgaccaattatatgg

SEQ ID NO: 208228 - DNA, 23 bp, Mus musculus
tgcctcagtgcctctgtgcttcc

SEQ ID NO: 208229 - DNA, 22 bp, Mus musculus
acttgaaatgtaatatatatat

SEQ ID NO: 208230 - DNA, 19 bp, Mus musculus
acatatcttgaatatgcat

SEQ ID NO: 208231 - DNA, 21 bp, Mus musculus
tattatagtgttactatagag

SEQ ID NO: 208232 - DNA, 19 bp, Mus musculus
ttgtgagcaatgctgtttg

SEQ ID NO: 208233 - DNA, 23 bp, Mus musculus
taattagagaagttactcagcag

SEQ ID NO: 208234 - DNA, 22 bp, Mus musculus
taaattagtggtggttgcactt

SEQ ID NO: 208235 - DNA, 23 bp, Mus musculus
tatgcatgtatatatgtatgtat

SEQ ID NO: 208236 - DNA, 22 bp, Mus musculus
tatgtatgtattgtatgcatgt

SEQ ID NO: 208237 - DNA, 22 bp, Mus musculus
tgttttgtgaccaattatatgg

SEQ ID NO: 208238 - DNA, 22 bp, Mus musculus
atggacacagctcaagttctgt

SEQ ID NO: 208239 - DNA, 22 bp, Mus musculus
tgttttgtgaccaattatatgg

SEQ ID NO: 208240 - DNA, 22 bp, Mus musculus
tgttttgtgaccaattatatgg

SEQ ID NO: 208241 - DNA, 23 bp, Mus musculus
tgtgtatgtatatatatatgtgt

SEQ ID NO: 208242 - DNA, 22 bp, Mus musculus
tgtgtgtatatatatgtatgtg

SEQ ID NO: 208243 - DNA, 23 bp, Mus musculus
tatatgtgtatatacatatgtgt

SEQ ID NO: 208244 - DNA, 21 bp, Mus musculus
aggttctcactctcggtcatc

SEQ ID NO: 208245 - DNA, 18 bp, Mus musculus
tgactagtatgtggtgac

SEQ ID NO: 208246 - DNA, 23 bp, Mus musculus
tgagagtgaagcctgaccctcac

SEQ ID NO: 208247 - DNA, 19 bp, Mus musculus
ttttgtgaccgattatatg

SEQ ID NO: 208248 - DNA, 20 bp, Mus musculus
atgtgtatgtatatgtatgt

SEQ ID NO: 208249 - DNA, 18 bp, Mus musculus
tatatatgtatgtatatg

SEQ ID NO: 208250 - DNA, 23 bp, Mus musculus
agcctgcctgcctgtgtggctta

SEQ ID NO: 208251 - DNA, 22 bp, Mus musculus
tatatgtgtgtgtgtatatatg

SEQ ID NO: 208252 - DNA, 23 bp, Mus musculus
atgtgtgtatatatatgtgtgta

SEQ ID NO: 208253 - DNA, 20 bp, Mus musculus
cacctgtctctctctctgac

SEQ ID NO: 208254 - DNA, 23 bp, Mus musculus
gtctgtctgtctgtctgtctgtc

SEQ ID NO: 208255 - DNA, 22 bp, Mus musculus
cttctctgtgagtcagtgtgcc

SEQ ID NO: 208256 - DNA, 20 bp, Mus musculus
atgtgcatttagtgtggcta

SEQ ID NO: 208257 - DNA, 22 bp, Mus musculus
acaggtgctggagtcaggcagt

SEQ ID NO: 208258 - DNA, 23 bp, Mus musculus
acagacattttctcactccagtg

SEQ ID NO: 208259 - DNA, 23 bp, Mus musculus
tcttgtctctctgtctgggcctc

SEQ ID NO: 208260 - DNA, 23 bp, Mus musculus
ttgtctgtctgtctgtctgtctg

SEQ ID NO: 208261 - DNA, 23 bp, Mus musculus
aaggattacagggtgtgatcttg

SEQ ID NO: 208262 - DNA, 23 bp, Mus musculus
tgtatgtgtgcatgtgtgtgtgt

SEQ ID NO: 208263 - DNA, 20 bp, Mus musculus
tgtatgtgcatgtgtatgtg

SEQ ID NO: 208264 - DNA, 23 bp, Mus musculus
tgtgcatgtgtatgtgtgtgtgt

SEQ ID NO: 208265 - DNA, 19 bp, Mus musculus
ctcagacttctggctttgg

SEQ ID NO: 208266 - DNA, 18 bp, Mus musculus
aatcatggtacacagacc

SEQ ID NO: 208267 - DNA, 23 bp, Mus musculus
agacatttgtttcaggagtgaag

SEQ ID NO: 208268 - DNA, 23 bp, Mus musculus
ctactgtgtctatgtctgtgtgt

SEQ ID NO: 208269 - DNA, 23 bp, Mus musculus
tgtatatatgatgcatatgtatc

SEQ ID NO: 208270 - DNA, 22 bp, Mus musculus
tgttttgtgaccaattatatgg

SEQ ID NO: 208271 - DNA, 21 bp, Mus musculus
tttctcagtcacagattggtg

SEQ ID NO: 208272 - DNA, 23 bp, Mus musculus
tgacctagatggttctattgttc

SEQ ID NO: 208273 - DNA, 23 bp, Mus musculus
aaggcaatgttctctgctgctcg

SEQ ID NO: 208274 - DNA, 20 bp, Mus musculus
cctctgggtgtgtgacagtc

SEQ ID NO: 208275 - DNA, 22 bp, Mus musculus
gactgagtctcagccactgtca

SEQ ID NO: 208276 - DNA, 22 bp, Mus musculus
tgtatgtctgagtcttgaagtt

SEQ ID NO: 208277 - DNA, 23 bp, Mus musculus
atggtagtggtggtagtgtgtat

SEQ ID NO: 208278 - DNA, 22 bp, Mus musculus
tatatgtgtgtgtgtatgtata

SEQ ID NO: 208279 - DNA, 18 bp, Mus musculus
ttccttatgttccagttc

SEQ ID NO: 208280 - DNA, 23 bp, Mus musculus
aagccagttcattcacttgtcag

SEQ ID NO: 208281 - DNA, 23 bp, Mus musculus
acacacacacactttatctctgt

SEQ ID NO: 208282 - DNA, 22 bp, Mus musculus
atcccacagtgggtaggttatg

SEQ ID NO: 208283 - DNA, 21 bp, Mus musculus
taagagcactgactgctcttg

SEQ ID NO: 208284 - DNA, 22 bp, Mus musculus
aggattgttgtgtgctaggaag

SEQ ID NO: 208285 - DNA, 22 bp, Mus musculus
tgacagaagagagtgtcagatc

SEQ ID NO: 208286 - DNA, 23 bp, Mus musculus
aacatcccaaactctagacaatg

SEQ ID NO: 208287 - DNA, 23 bp, Mus musculus
agacacacttcacagtgtgcact

SEQ ID NO: 208288 - DNA, 23 bp, Mus musculus
aatgagcatacatagtgtatgtg

SEQ ID NO: 208289 - DNA, 23 bp, Mus musculus
ctgtgtctctgtttagtttctgt

SEQ ID NO: 208290 - DNA, 22 bp, Mus musculus
atctgtccattgatgagagtgg

SEQ ID NO: 208291 - DNA, 22 bp, Mus musculus
agagtgggagctcagtgagact

SEQ ID NO: 208292 - DNA, 21 bp, Mus musculus
tcactggctcactcccaccct

SEQ ID NO: 208293 - DNA, 19 bp, Mus musculus
tttcccactgtctctgttt

SEQ ID NO: 208294 - DNA, 22 bp, Mus musculus
ttgccagtggcagacatgatgg

SEQ ID NO: 208295 - DNA, 23 bp, Mus musculus
tctgagaactcagtgtccagatg

SEQ ID NO: 208296 - DNA, 23 bp, Mus musculus
aggctcagtgtctctctcttctt

SEQ ID NO: 208297 - DNA, 23 bp, Mus musculus
gtcactcagactgacttccaaca

SEQ ID NO: 208298 - DNA, 21 bp, Mus musculus
ttcactcctctttctctgact

SEQ ID NO: 208299 - DNA, 23 bp, Mus musculus
gttcaattctcagcaaccacatg

SEQ ID NO: 208300 - DNA, 23 bp, Mus musculus
taaacagcatttacactttggag

SEQ ID NO: 208301 - DNA, 22 bp, Mus musculus
tcagagactcagagactctgca

SEQ ID NO: 208302 - DNA, 22 bp, Mus musculus
aacagtgtgcctatctacagtg

SEQ ID NO: 208303 - DNA, 23 bp, Mus musculus
tctgacagttgagagatggaagg

SEQ ID NO: 208304 - DNA, 23 bp, Mus musculus
gtctctgtctctcttactcttta

SEQ ID NO: 208305 - DNA, 23 bp, Mus musculus
tgagactgtctctgtctgcctta

SEQ ID NO: 208306 - DNA, 21 bp, Mus musculus
tctctgtctgtctagctggtt

SEQ ID NO: 208307 - DNA, 18 bp, Mus musculus
tcacttcagagtttgcgc

SEQ ID NO: 208308 - DNA, 22 bp, Mus musculus
tgttgactctgtgagtctctgc

SEQ ID NO: 208309 - DNA, 23 bp, Mus musculus
tcactgtaagtctgcatgcacat

SEQ ID NO: 208310 - DNA, 20 bp, Mus musculus
agtcactattctgttgctgt

SEQ ID NO: 208311 - DNA, 22 bp, Mus musculus
agggacactgactgtgtcgatc

SEQ ID NO: 208312 - DNA, 23 bp, Mus musculus
ttcctcagtgagctttgatgtgg

SEQ ID NO: 208313 - DNA, 23 bp, Mus musculus
ttgtacatgtgcagttgtgagtg

SEQ ID NO: 208314 - DNA, 23 bp, Mus musculus
gtatgtatgtatgcatatgtgtg

SEQ ID NO: 208315 - DNA, 23 bp, Mus musculus
gctgagtgagtgagtgagtgagt

SEQ ID NO: 208316 - DNA, 23 bp, Mus musculus
gtgtctgtctgtctgtctgtctg

SEQ ID NO: 208317 - DNA, 21 bp, Mus musculus
tctctcttgctctcagtgtcc

SEQ ID NO: 208318 - DNA, 23 bp, Mus musculus
gcctgtcagtcagtcagtgagag

SEQ ID NO: 208319 - DNA, 23 bp, Mus musculus
tctgtctcagtctggaaagctgg

SEQ ID NO: 208320 - DNA, 23 bp, Mus musculus
gtcactgctctgtgtgtgtgtgg

SEQ ID NO: 208321 - DNA, 23 bp, Mus musculus
tgtttctacatccatgtgtgtca

SEQ ID NO: 208322 - DNA, 23 bp, Mus musculus
aatggcagtggtagatgaaagag

SEQ ID NO: 208323 - DNA, 23 bp, Mus musculus
ttattggctgttcattgtggaaa

SEQ ID NO: 208324 - DNA, 19 bp, Mus musculus
atagtatgtatgcatacgt

SEQ ID NO: 208325 - DNA, 22 bp, Mus musculus
ctccagatccatttttgtttgt

SEQ ID NO: 208326 - DNA, 23 bp, Mus musculus
tcactgcatacctattctgcaga

SEQ ID NO: 208327 - DNA, 21 bp, Mus musculus
tgcagttgtgatctctttgga

SEQ ID NO: 208328 - DNA, 18 bp, Mus musculus
tgtcatggagctggagag

SEQ ID NO: 208329 - DNA, 23 bp, Mus musculus
aggctgttctcgatgaggatcca

SEQ ID NO: 208330 - DNA, 22 bp, Mus musculus
agcatctacatgattctgcatg

SEQ ID NO: 208331 - DNA, 20 bp, Mus musculus
gagtgggagtttggagttag

SEQ ID NO: 208332 - DNA, 23 bp, Mus musculus
tgcctgcctgcctgcctgcctgc

SEQ ID NO: 208333 - DNA, 18 bp, Mus musculus
ctgtgtgtcctctacaca

SEQ ID NO: 208334 - DNA, 23 bp, Mus musculus
aggtagagttgtgtgaaagcaga

SEQ ID NO: 208335 - DNA, 22 bp, Mus musculus
tgactactacctgaatgcttgt

SEQ ID NO: 208336 - DNA, 22 bp, Mus musculus
cacactgtttctctctctctct

SEQ ID NO: 208337 - DNA, 22 bp, Mus musculus
aaagaggatgtcgggctggaga

SEQ ID NO: 208338 - DNA, 20 bp, Mus musculus
tgtctctcaggatttgttgt

SEQ ID NO: 208339 - DNA, 19 bp, Mus musculus
atcagcctttacctttatt

SEQ ID NO: 208340 - DNA, 20 bp, Mus musculus
aagagattaaaagttgtagg

SEQ ID NO: 208341 - DNA, 22 bp, Mus musculus
ttcacagaagatagactacaga

SEQ ID NO: 208342 - DNA, 23 bp, Mus musculus
tgacactctctcactctctgaag

SEQ ID NO: 208343 - DNA, 23 bp, Mus musculus
agactgtcagtgtgtgtgcccct

SEQ ID NO: 208344 - DNA, 23 bp, Mus musculus
aagagacagaacagtgagagtac

SEQ ID NO: 208345 - DNA, 21 bp, Mus musculus
ttggatgatgagattagggtt

SEQ ID NO: 208346 - DNA, 23 bp, Mus musculus
gaccctgactgtgtccgtgtctc

SEQ ID NO: 208347 - DNA, 23 bp, Mus musculus
gcaaacatttagttgaactcact

SEQ ID NO: 208348 - DNA, 23 bp, Mus musculus
tgacagaagtcagtggtcagcta

SEQ ID NO: 208349 - DNA, 22 bp, Mus musculus
acatgtgtatatgatatataca

SEQ ID NO: 208350 - DNA, 22 bp, Mus musculus
ctgtctctgtctggtttccatg

SEQ ID NO: 208351 - DNA, 23 bp, Mus musculus
aactgtttccccttacagtgtct

SEQ ID NO: 208352 - DNA, 23 bp, Mus musculus
acatagatgtatgtatacacaca

SEQ ID NO: 208353 - DNA, 19 bp, Mus musculus
tgtatgtatgtatttatgt

SEQ ID NO: 208354 - DNA, 23 bp, Mus musculus
gtgtgtgtgtgtgtgataatgga

SEQ ID NO: 208355 - DNA, 21 bp, Mus musculus
tgagcatgggaaatcatgtgt

SEQ ID NO: 208356 - DNA, 23 bp, Mus musculus
tgttctgattttgttattattac

SEQ ID NO: 208357 - DNA, 23 bp, Mus musculus
aagtgctaggatttcaggcacgt

SEQ ID NO: 208358 - DNA, 23 bp, Mus musculus
gtgtggttggtagattttatgat

SEQ ID NO: 208359 - DNA, 23 bp, Mus musculus
cactctgtgtgtgtatgtgtgtg

SEQ ID NO: 208360 - DNA, 21 bp, Mus musculus
tactgaatgatgaaagcatgt

SEQ ID NO: 208361 - DNA, 23 bp, Mus musculus
tctgtctgtctgtctgtcagtct

SEQ ID NO: 208362 - DNA, 23 bp, Mus musculus
tgagtgcagacagagtgcagaca

SEQ ID NO: 208363 - DNA, 22 bp, Mus musculus
taaaggagtgcctggactctgt

SEQ ID NO: 208364 - DNA, 20 bp, Mus musculus
cgtgtgtgtgtgtgtgtgtg

SEQ ID NO: 208365 - DNA, 20 bp, Mus musculus
tggaatgtaaataagtaagg

SEQ ID NO: 208366 - DNA, 21 bp, Mus musculus
agttactttgtttaattgctc

SEQ ID NO: 208367 - DNA, 23 bp, Mus musculus
tatgactctgaggttaacatgat

SEQ ID NO: 208368 - DNA, 21 bp, Mus musculus
ttggaagattctagaagatag

SEQ ID NO: 208369 - DNA, 23 bp, Mus musculus
tctgtcacagtctgttacctgta

SEQ ID NO: 208370 - DNA, 23 bp, Mus musculus
atctacagactcgtacattaagc

SEQ ID NO: 208371 - DNA, 23 bp, Mus musculus
acagtgcaattattatgagagtt

SEQ ID NO: 208372 - DNA, 20 bp, Mus musculus
ttaacatagaaattgttcag

SEQ ID NO: 208373 - DNA, 23 bp, Mus musculus
tctgtctgtctgtctgcctgtct

SEQ ID NO: 208374 - DNA, 23 bp, Mus musculus
gtgtgtgtatatgtacatgtggg

SEQ ID NO: 208375 - DNA, 19 bp, Mus musculus
tgtgtctgtgtgtgtgcat

SEQ ID NO: 208376 - DNA, 22 bp, Mus musculus
aggaagttgaatggaggttaag

SEQ ID NO: 208377 - DNA, 20 bp, Mus musculus
tatacagaaattggttttga

SEQ ID NO: 208378 - DNA, 23 bp, Mus musculus
taagactgtcaggtaaagtacac

SEQ ID NO: 208379 - DNA, 23 bp, Mus musculus
tgtgtgtgtgtgtgtacgcatat

SEQ ID NO: 208380 - DNA, 22 bp, Mus musculus
tgttttgtgaccaattatatgg

SEQ ID NO: 208381 - DNA, 22 bp, Mus musculus
tgttttgtgaccaattatatgg

SEQ ID NO: 208382 - DNA, 21 bp, Mus musculus
tacccattgacttttgctgct

SEQ ID NO: 208383 - DNA, 23 bp, Mus musculus
aaatgtcattttgtagtagacaa

SEQ ID NO: 208384 - DNA, 20 bp, Mus musculus
atctggttgagagatctttt

SEQ ID NO: 208385 - DNA, 19 bp, Mus musculus
atgacagtagtttttctgc

SEQ ID NO: 208386 - DNA, 21 bp, Mus musculus
tccatggtggtctgataggat

SEQ ID NO: 208387 - DNA, 18 bp, Mus musculus
agactccctgggtttctt

SEQ ID NO: 208388 - DNA, 23 bp, Mus musculus
tcaagtacaatgttgaatagtta

SEQ ID NO: 208389 - DNA, 23 bp, Mus musculus
atcatttgtatgcctgcttgctt

SEQ ID NO: 208390 - DNA, 21 bp, Mus musculus
ctgagagaagagtgtctccag

SEQ ID NO: 208391 - DNA, 19 bp, Mus musculus
ttagcttctttgggtctgt

SEQ ID NO: 208392 - DNA, 20 bp, Mus musculus
aatggctcagggagatgtga

SEQ ID NO: 208393 - DNA, 23 bp, Mus musculus
ccaagggtcactggttccactct

SEQ ID NO: 208394 - DNA, 23 bp, Mus musculus
tcacactgcgtctgtattcagga

SEQ ID NO: 208395 - DNA, 23 bp, Mus musculus
tagccttgtgttttacttgaatc

SEQ ID NO: 208396 - DNA, 23 bp, Mus musculus
ctgtctgtctgtctgcctgtgtc

SEQ ID NO: 208397 - DNA, 23 bp, Mus musculus
cagtgtgtgtgtgtctgtgcatg

SEQ ID NO: 208398 - DNA, 22 bp, Mus musculus
tgtatgtgcatgtacatgtttg

SEQ ID NO: 208399 - DNA, 23 bp, Mus musculus
ttttagtatcaggttaacttctc

SEQ ID NO: 208400 - DNA, 23 bp, Mus musculus
tttaggtgcatacatatactatg

SEQ ID NO: 208401 - DNA, 23 bp, Mus musculus
gtatgtatgtatgtatgtatgta

SEQ ID NO: 208402 - DNA, 23 bp, Mus musculus
atgtatgtatgtatgtatgtatg

SEQ ID NO: 208403 - DNA, 22 bp, Mus musculus
atccatggtgatcagataggat

SEQ ID NO: 208404 - DNA, 22 bp, Mus musculus
aggctgttttgttaccaattat

SEQ ID NO: 208405 - DNA, 23 bp, Mus musculus
tactggtagctggaattcttcat

SEQ ID NO: 208406 - DNA, 21 bp, Mus musculus
actgtttacagcatgaagaag

SEQ ID NO: 208407 - DNA, 21 bp, Mus musculus
atacacacacagatatatatg

SEQ ID NO: 208408 - DNA, 21 bp, Mus musculus
taggacatagtttgagctgag

SEQ ID NO: 208409 - DNA, 23 bp, Mus musculus
gtctctgggtcactgtgtccact

SEQ ID NO: 208410 - DNA, 23 bp, Mus musculus
ttgtgtatgtgtgcatgtgtatg

SEQ ID NO: 208411 - DNA, 23 bp, Mus musculus
agtgagacaagtgagtgacttgt

SEQ ID NO: 208412 - DNA, 23 bp, Mus musculus
tttgtgtctgtggttaagatgtg

SEQ ID NO: 208413 - DNA, 23 bp, Mus musculus
tgtatgtatgtatgtatgtatgt

SEQ ID NO: 208414 - DNA, 22 bp, Mus musculus
aggtggtgatgagagtgaggac

SEQ ID NO: 208415 - DNA, 23 bp, Mus musculus
ttcatcttctcgttgggatttgt

SEQ ID NO: 208416 - DNA, 23 bp, Mus musculus
tgggtgtctgtgtgtctgtgcat

SEQ ID NO: 208417 - DNA, 19 bp, Mus musculus
aatatctgtgcatgtggat

SEQ ID NO: 208418 - DNA, 23 bp, Mus musculus
tgtatgtacatgtgtatatgtat

SEQ ID NO: 208419 - DNA, 21 bp, Mus musculus
tgtgtatttatatgtatgtct

SEQ ID NO: 208420 - DNA, 23 bp, Mus musculus
tttgagaatgtatatgtgtgtgc

SEQ ID NO: 208421 - DNA, 23 bp, Mus musculus
tctgtgtgtatatgtgtgtgcat

SEQ ID NO: 208422 - DNA, 23 bp, Mus musculus
atatgtggaggtaagaggttagc

SEQ ID NO: 208423 - DNA, 23 bp, Mus musculus
tctctctctctttgtacaatgtc

SEQ ID NO: 208424 - DNA, 23 bp, Mus musculus
ctgtgtctctgtttagtttctgt

SEQ ID NO: 208425 - DNA, 23 bp, Mus musculus
atgtgcatgtgcatgtgcatgtg

SEQ ID NO: 208426 - DNA, 23 bp, Mus musculus
tgctggagactatatgaggacat

SEQ ID NO: 208427 - DNA, 21 bp, Mus musculus
tgtgggactgagcaactgcta

SEQ ID NO: 208428 - DNA, 22 bp, Mus musculus
atatgtatatatatatatgtct

SEQ ID NO: 208429 - DNA, 23 bp, Mus musculus
atatgtatatttgtaaatatgta

SEQ ID NO: 208430 - DNA, 21 bp, Mus musculus
tgcctctggcagaatgttcta

SEQ ID NO: 208431 - DNA, 23 bp, Mus musculus
tagtgcatggtgatctgatagga

SEQ ID NO: 208432 - DNA, 23 bp, Mus musculus
gttatgtgacctattatgtggtt

SEQ ID NO: 208433 - DNA, 23 bp, Mus musculus
tagtaagttgactcagcaggaca

SEQ ID NO: 208434 - DNA, 21 bp, Mus musculus
aatcacacaccctctgttagc

SEQ ID NO: 208435 - DNA, 20 bp, Mus musculus
tgtcagcatccacattgtgt

SEQ ID NO: 208436 - DNA, 21 bp, Mus musculus
ttctgtgcattcttcttccag

SEQ ID NO: 208437 - DNA, 23 bp, Mus musculus
tccatgtgtgtccgtgtgtgtgt

SEQ ID NO: 208438 - DNA, 23 bp, Mus musculus
agcttgactgcctgaatttgatc

SEQ ID NO: 208439 - DNA, 18 bp, Mus musculus
tttgtccaagtcttttat

SEQ ID NO: 208440 - DNA, 23 bp, Mus musculus
gagtgagctactgatttggtagg

SEQ ID NO: 208441 - DNA, 23 bp, Mus musculus
acatggtgtgtgtgcctgtgcat

SEQ ID NO: 208442 - DNA, 22 bp, Mus musculus
ggtggaacctgtaggccttagc

SEQ ID NO: 208443 - DNA, 23 bp, Mus musculus
taatggttgcattgtttttctta

SEQ ID NO: 208444 - DNA, 20 bp, Mus musculus
aaactcaggctttatcttta

SEQ ID NO: 208445 - DNA, 22 bp, Mus musculus
agtcagagaacactgacagagg

SEQ ID NO: 208446 - DNA, 21 bp, Mus musculus
tatgcatatatatgtgtgtgt

SEQ ID NO: 208447 - DNA, 23 bp, Mus musculus
tctggctctgtctgactatagca

SEQ ID NO: 208448 - DNA, 23 bp, Mus musculus
gggcactgagtgtctctgtcagt

SEQ ID NO: 208449 - DNA, 23 bp, Mus musculus
tctcaatgtggttttgatttgaa

SEQ ID NO: 208450 - DNA, 18 bp, Mus musculus
tgagagactttgaagaca

SEQ ID NO: 208451 - DNA, 22 bp, Mus musculus
tttaaattgtttttcaaatgtt

SEQ ID NO: 208452 - DNA, 23 bp, Mus musculus
caagaggaaaggaaatgatttgg

SEQ ID NO: 208453 - DNA, 21 bp, Mus musculus
ttcacagcttctctcacagcc

SEQ ID NO: 208454 - DNA, 22 bp, Mus musculus
tgttttgtgaccaattatatgg

SEQ ID NO: 208455 - DNA, 23 bp, Mus musculus
acagcttgaacaaattgagaatc

SEQ ID NO: 208456 - DNA, 20 bp, Mus musculus
tatgctctaggccaatgttg

SEQ ID NO: 208457 - DNA, 22 bp, Mus musculus
tttcagagcgcagtgaattcag

SEQ ID NO: 208458 - DNA, 21 bp, Mus musculus
atactggttgcttgatttttc

SEQ ID NO: 208459 - DNA, 22 bp, Mus musculus
tgagtggctctgacagtgcctg

SEQ ID NO: 208460 - DNA, 23 bp, Mus musculus
atataagctatacatgtaatgtg

SEQ ID NO: 208461 - DNA, 22 bp, Mus musculus
tgttttgtgaccaattatatgg

SEQ ID NO: 208462 - DNA, 23 bp, Mus musculus
agtccatggtgatctgataggat

SEQ ID NO: 208463 - DNA, 22 bp, Mus musculus
tgtgaccacttatatggtcaat

SEQ ID NO: 208464 - DNA, 22 bp, Mus musculus
tgttttgtgaccaattatatgg

SEQ ID NO: 208465 - DNA, 20 bp, Mus musculus
tgtatgcatgcatgtatgtt

SEQ ID NO: 208466 - DNA, 21 bp, Mus musculus
tatgtatgtatgcatgtgtaa

SEQ ID NO: 208467 - DNA, 23 bp, Mus musculus
atattgtcatattgttattctgt

SEQ ID NO: 208468 - DNA, 19 bp, Mus musculus
tattcttatgtttctgtgg

SEQ ID NO: 208469 - DNA, 18 bp, Mus musculus
aatgatagttatcctata

SEQ ID NO: 208470 - DNA, 23 bp, Mus musculus
ctcaggctgtcccactctcactg

SEQ ID NO: 208471 - DNA, 23 bp, Mus musculus
gtctgtgcctctctctctgggtc

SEQ ID NO: 208472 - DNA, 19 bp, Mus musculus
tagtgtgtgtgtgtgtgtg

SEQ ID NO: 208473 - DNA, 18 bp, Mus musculus
acagaagcttctcctcac

SEQ ID NO: 208474 - DNA, 18 bp, Mus musculus
tgagacaagagtgagatc

SEQ ID NO: 208475 - DNA, 22 bp, Mus musculus
tgttttgtgaccaattatatgg

SEQ ID NO: 208476 - DNA, 23 bp, Mus musculus
ttgaagtaaagtaggttttgaaa

SEQ ID NO: 208477 - DNA, 23 bp, Mus musculus
gttcacagtgactgtctgtcagt

SEQ ID NO: 208478 - DNA, 23 bp, Mus musculus
attcctgttttgtctagctgcat

SEQ ID NO: 208479 - DNA, 19 bp, Mus musculus
agtgtgtatgtctcttagg

SEQ ID NO: 208480 - DNA, 22 bp, Mus musculus
atacatcgctgagtgtgagcat

SEQ ID NO: 208481 - DNA, 23 bp, Mus musculus
tgtgtttctacattcattgctga

SEQ ID NO: 208482 - DNA, 21 bp, Mus musculus
atattgcaatacaatgtcagt

SEQ ID NO: 208483 - DNA, 21 bp, Mus musculus
tctgtctgactgagtcccttc

SEQ ID NO: 208484 - DNA, 21 bp, Mus musculus
tgacagacaacagattagcat

SEQ ID NO: 208485 - DNA, 21 bp, Mus musculus
aatcacacccagcttgcttgg

SEQ ID NO: 208486 - DNA, 23 bp, Mus musculus
aaaggagctggagtgacagtgat

SEQ ID NO: 208487 - DNA, 23 bp, Mus musculus
cagacacactgaggcagagagag

SEQ ID NO: 208488 - DNA, 20 bp, Mus musculus
tggcaggcagtgaggacact

SEQ ID NO: 208489 - DNA, 19 bp, Mus musculus
catcactgaagggagtcag

SEQ ID NO: 208490 - DNA, 21 bp, Mus musculus
aacaggaactgaagcagagag

SEQ ID NO: 208491 - DNA, 21 bp, Mus musculus
cctctctgactccctgactca

SEQ ID NO: 208492 - DNA, 18 bp, Mus musculus
tgtgcttccatgtagctg

SEQ ID NO: 208493 - DNA, 23 bp, Mus musculus
caggcactctgtgtgcctcagaa

SEQ ID NO: 208494 - DNA, 23 bp, Mus musculus
tgtcgctgcctctgactcagaga

SEQ ID NO: 208495 - DNA, 23 bp, Mus musculus
tgtatatatgtatgtatgtgtat

SEQ ID NO: 208496 - DNA, 23 bp, Mus musculus
tatagagattttcttgttctggt

SEQ ID NO: 208497 - DNA, 23 bp, Mus musculus
aggctggctccctgtgtgtgtgc

SEQ ID NO: 208498 - DNA, 23 bp, Mus musculus
agtactgagagtggagatagagg

SEQ ID NO: 208499 - DNA, 19 bp, Mus musculus
tgtgtgtgtgtgtgtgtgt

SEQ ID NO: 208500 - DNA, 20 bp, Mus musculus
tgctctcagatatcagagag

SEQ ID NO: 208501 - DNA, 21 bp, Mus musculus
actcatctgtgagtggagagt

SEQ ID NO: 208502 - DNA, 22 bp, Mus musculus
tgttttgtgaccaattatatgg

SEQ ID NO: 208503 - DNA, 22 bp, Mus musculus
tgtgctgactgagcagagaggc

SEQ ID NO: 208504 - DNA, 19 bp, Mus musculus
cagaggttgagagcaggtt

SEQ ID NO: 208505 - DNA, 22 bp, Mus musculus
tacaatcatctgtcattccagt

SEQ ID NO: 208506 - DNA, 23 bp, Mus musculus
agtcccactgagagtattcacag

SEQ ID NO: 208507 - DNA, 23 bp, Mus musculus
tatctataaatatatgtgtgtgt

SEQ ID NO: 208508 - DNA, 23 bp, Mus musculus
agtggtagatggatctgtgtgag

SEQ ID NO: 208509 - DNA, 22 bp, Mus musculus
ttaaagctcaaattaatgatct

SEQ ID NO: 208510 - DNA, 21 bp, Mus musculus
cagaggtgtgtgtgtgtctgt

SEQ ID NO: 208511 - DNA, 20 bp, Mus musculus
aagagcactgactgctcttc

SEQ ID NO: 208512 - DNA, 23 bp, Mus musculus
gaactctccctctctgtctgtct

SEQ ID NO: 208513 - DNA, 22 bp, Mus musculus
tcacgtgactgaagagtctcag

SEQ ID NO: 208514 - DNA, 23 bp, Mus musculus
gatagtgcagggagtggacgatg

SEQ ID NO: 208515 - DNA, 21 bp, Mus musculus
tggttcttggtgtttggtaaa

SEQ ID NO: 208516 - DNA, 21 bp, Mus musculus
tactaacactggaaagcaatt

SEQ ID NO: 208517 - DNA, 20 bp, Mus musculus
tgagtgtctggtttttttct

SEQ ID NO: 208518 - DNA, 22 bp, Mus musculus
tctagcttttcttttgctgatc

SEQ ID NO: 208519 - DNA, 23 bp, Mus musculus
gtctctgtctgcctgtctttatc

SEQ ID NO: 208520 - DNA, 22 bp, Mus musculus
tgagttcagtcactctgtctct

SEQ ID NO: 208521 - DNA, 22 bp, Mus musculus
tgagctagacatttcttcttga

SEQ ID NO: 208522 - DNA, 23 bp, Mus musculus
atcagaacactggctcacttcag

SEQ ID NO: 208523 - DNA, 23 bp, Mus musculus
aatgagagctatcttctctgagt

SEQ ID NO: 208524 - DNA, 21 bp, Mus musculus
atgattctggagaaggacctg

SEQ ID NO: 208525 - DNA, 21 bp, Mus musculus
atgtcagaacagagaggcctg

SEQ ID NO: 208526 - DNA, 23 bp, Mus musculus
gactccctttgctggcttctgtg

SEQ ID NO: 208527 - DNA, 23 bp, Mus musculus
gctgtctctctcagtgcctgtga

SEQ ID NO: 208528 - DNA, 20 bp, Mus musculus
tgagtggttaaggagttgaa

SEQ ID NO: 208529 - DNA, 18 bp, Mus musculus
tctatgatacataagaaa

SEQ ID NO: 208530 - DNA, 23 bp, Mus musculus
ctgtctgtatgtctgtctgtctg

SEQ ID NO: 208531 - DNA, 18 bp, Mus musculus
aggtaccttcagaggatg

SEQ ID NO: 208532 - DNA, 22 bp, Mus musculus
tccatgtcagttagaaaagtac

SEQ ID NO: 208533 - DNA, 20 bp, Mus musculus
tgtatgtgtaaatgtgtata

SEQ ID NO: 208534 - DNA, 23 bp, Mus musculus
gtgtgtgtagatgtatgtgtgtg

SEQ ID NO: 208535 - DNA, 21 bp, Mus musculus
tgcatgtgtgtgcgcatgtgt

SEQ ID NO: 208536 - DNA, 20 bp, Mus musculus
tgtgtacatgcatgtgtgtg

SEQ ID NO: 208537 - DNA, 22 bp, Mus musculus
tgttttgtaaagaagtaggaag

SEQ ID NO: 208538 - DNA, 19 bp, Mus musculus
aagtcttctgtctttgcac

SEQ ID NO: 208539 - DNA, 23 bp, Mus musculus
aataagggctgggtctctgtccc

SEQ ID NO: 208540 - DNA, 23 bp, Mus musculus
agggattcagacactttctctca

SEQ ID NO: 208541 - DNA, 20 bp, Mus musculus
atttgaatatatatagttga

SEQ ID NO: 208542 - DNA, 23 bp, Mus musculus
tgtctctctgagtctgtgtctgt

SEQ ID NO: 208543 - DNA, 18 bp, Mus musculus
agtgaaccaagacaatga

SEQ ID NO: 208544 - DNA, 23 bp, Mus musculus
tgttttctgaaattgttcatgtt

SEQ ID NO: 208545 - DNA, 23 bp, Mus musculus
tgcatgtatgtatgcatgtgtgt

SEQ ID NO: 208546 - DNA, 18 bp, Mus musculus
atacaagcatgtctctct

SEQ ID NO: 208547 - DNA, 23 bp, Mus musculus
atgtatgtatatatgtatgtatg

SEQ ID NO: 208548 - DNA, 18 bp, Mus musculus
tgtgtgcatgtgcatatg

SEQ ID NO: 208549 - DNA, 22 bp, Mus musculus
atgaggtattggagcatttgaa

SEQ ID NO: 208550 - DNA, 20 bp, Mus musculus
caatgtatatatgtgtgttc

SEQ ID NO: 208551 - DNA, 22 bp, Mus musculus
tgacagagaccacacagcctgg

SEQ ID NO: 208552 - DNA, 23 bp, Mus musculus
tcaaagagcttttctactcattc

SEQ ID NO: 208553 - DNA, 23 bp, Mus musculus
tgagctaggctctgtcatacaca

SEQ ID NO: 208554 - DNA, 21 bp, Mus musculus
accctcgctgtcacactgact

SEQ ID NO: 208555 - DNA, 19 bp, Mus musculus
tgtatgagtgtctctctgt

SEQ ID NO: 208556 - DNA, 20 bp, Mus musculus
tggaacacatttttgaatgt

SEQ ID NO: 208557 - DNA, 20 bp, Mus musculus
ggcagagtcataggagtagg

SEQ ID NO: 208558 - DNA, 23 bp, Mus musculus
atgtgtctatgtgtctgtctttc

SEQ ID NO: 208559 - DNA, 23 bp, Mus musculus
tctgtctgtctgtctcactctcc

SEQ ID NO: 208560 - DNA, 20 bp, Mus musculus
tatgtatatgtttatgtgtg

SEQ ID NO: 208561 - DNA, 23 bp, Mus musculus
tatgagtgtgcctgtttatatat

SEQ ID NO: 208562 - DNA, 18 bp, Mus musculus
gtatgtatgtatacttgt

SEQ ID NO: 208563 - DNA, 21 bp, Mus musculus
cttccctttgtcatccttggc

SEQ ID NO: 208564 - DNA, 23 bp, Mus musculus
agtcagaagtgggtgtcagatac

SEQ ID NO: 208565 - DNA, 23 bp, Mus musculus
actctgtgactgtttctatattg

SEQ ID NO: 208566 - DNA, 18 bp, Mus musculus
tggacatacagaataggc

SEQ ID NO: 208567 - DNA, 23 bp, Mus musculus
agtaaagatgctacactgtccct

SEQ ID NO: 208568 - DNA, 23 bp, Mus musculus
gttctgtctcattctcctgaagg

SEQ ID NO: 208569 - DNA, 23 bp, Mus musculus
tctctcagccaatgtgccacgct

SEQ ID NO: 208570 - DNA, 21 bp, Mus musculus
gtaggatgcttgattgtttca

SEQ ID NO: 208571 - DNA, 22 bp, Mus musculus
taattgattgtaatcaagaatc

SEQ ID NO: 208572 - DNA, 22 bp, Mus musculus
aaatgttgatagtaattatgtt

SEQ ID NO: 208573 - DNA, 20 bp, Mus musculus
gtggtggtcagtgacttaca

SEQ ID NO: 208574 - DNA, 23 bp, Mus musculus
ctcactgtgatgagagactgcac

SEQ ID NO: 208575 - DNA, 22 bp, Mus musculus
atgtgcatgtgcatatgggtat

SEQ ID NO: 208576 - DNA, 22 bp, Mus musculus
tatatgtgcatgtacatgtggt

SEQ ID NO: 208577 - DNA, 19 bp, Mus musculus
tgtctctccctccttggct

SEQ ID NO: 208578 - DNA, 20 bp, Mus musculus
tgcttgtatgtatgtatgta

SEQ ID NO: 208579 - DNA, 21 bp, Mus musculus
tgtatgtatgtatgtatgccc

SEQ ID NO: 208580 - DNA, 23 bp, Mus musculus
tctgtgtttgtacatatgcacat

SEQ ID NO: 208581 - DNA, 22 bp, Mus musculus
agtcaggctcagtagagcctca

SEQ ID NO: 208582 - DNA, 21 bp, Mus musculus
attcagactcctaagctaggc

SEQ ID NO: 208583 - DNA, 23 bp, Mus musculus
tggaagtctgtagacagtgagcc

SEQ ID NO: 208584 - DNA, 21 bp, Mus musculus
tccttgaaatacattctgaaa

SEQ ID NO: 208585 - DNA, 22 bp, Mus musculus
tcatgagaactagatttgggga

SEQ ID NO: 208586 - DNA, 23 bp, Mus musculus
aaagtgcatcagatttgacttgg

SEQ ID NO: 208587 - DNA, 23 bp, Mus musculus
tctgtctgtgtgtctgtctgtgt

SEQ ID NO: 208588 - DNA, 23 bp, Mus musculus
tatatatgtatatgtgtatatgt

SEQ ID NO: 208589 - DNA, 21 bp, Mus musculus
tgcatgtatgaatatatgtgt

SEQ ID NO: 208590 - DNA, 20 bp, Mus musculus
tacatacacatatacatgta

SEQ ID NO: 208591 - DNA, 23 bp, Mus musculus
gtatatgcgtgtgtatgcataca

SEQ ID NO: 208592 - DNA, 23 bp, Mus musculus
tgtatatgtatgtatatgtatgt

SEQ ID NO: 208593 - DNA, 23 bp, Mus musculus
cttgtcacagacactcagtgcta

SEQ ID NO: 208594 - DNA, 20 bp, Mus musculus
gtgacacagacagactctgg

SEQ ID NO: 208595 - DNA, 19 bp, Mus musculus
ttctctgactttaagatta

SEQ ID NO: 208596 - DNA, 19 bp, Mus musculus
cactactatatccactgtg

SEQ ID NO: 208597 - DNA, 18 bp, Mus musculus
tctctgtaagtctttgaa

SEQ ID NO: 208598 - DNA, 23 bp, Mus musculus
tgtgtctgtgtgtgtgcacatgc

SEQ ID NO: 208599 - DNA, 23 bp, Mus musculus
caccttgtgaacagcctctgttg

SEQ ID NO: 208600 - DNA, 23 bp, Mus musculus
ttatgtgaccaattctatggtca

SEQ ID NO: 208601 - DNA, 23 bp, Mus musculus
tacagagagactttctttttttt

SEQ ID NO: 208602 - DNA, 23 bp, Mus musculus
acagtagtcattttgttttacta

SEQ ID NO: 208603 - DNA, 21 bp, Mus musculus
gcgtgcgtgtgtgtgcgtgtg

SEQ ID NO: 208604 - DNA, 23 bp, Mus musculus
ctctgtctgtctgtccatctgtc

SEQ ID NO: 208605 - DNA, 23 bp, Mus musculus
ttcaggtagattgttttactgtt

SEQ ID NO: 208606 - DNA, 19 bp, Mus musculus
tcagagtgagaggatgagg

SEQ ID NO: 208607 - DNA, 20 bp, Mus musculus
gtgatctctctctctctcag

SEQ ID NO: 208608 - DNA, 23 bp, Mus musculus
aatgtcactggctgttttgtttg

SEQ ID NO: 208609 - DNA, 23 bp, Mus musculus
actgagtccctgtgtgtctgaga

SEQ ID NO: 208610 - DNA, 23 bp, Mus musculus
gtggatctggaaataatttgagg

SEQ ID NO: 208611 - DNA, 18 bp, Mus musculus
aggaaaacctgtgtttgt

SEQ ID NO: 208612 - DNA, 23 bp, Mus musculus
gactcactgtgtgagcactttgt

SEQ ID NO: 208613 - DNA, 23 bp, Mus musculus
cacacagttctcagtctctgtgt

SEQ ID NO: 208614 - DNA, 23 bp, Mus musculus
cacacagttctcagtctctgtgt

SEQ ID NO: 208615 - DNA, 23 bp, Mus musculus
acataattgtgtctggcaaagaa

SEQ ID NO: 208616 - DNA, 22 bp, Mus musculus
agtctcacagtggctctcagtg

SEQ ID NO: 208617 - DNA, 23 bp, Mus musculus
tcaagtacactgtgtgtgtctgt

SEQ ID NO: 208618 - DNA, 19 bp, Mus musculus
tacactgcagagggagcca

SEQ ID NO: 208619 - DNA, 22 bp, Mus musculus
tgtgcctgtgtcagctgctctt

SEQ ID NO: 208620 - DNA, 20 bp, Mus musculus
tgtgtgagagagagtggccc

SEQ ID NO: 208621 - DNA, 23 bp, Mus musculus
atgtgtgtgtatatgtatgtgtg

SEQ ID NO: 208622 - DNA, 23 bp, Mus musculus
tatgtgtatatacatatgtgtgt

SEQ ID NO: 208623 - DNA, 23 bp, Mus musculus
ggatgcactccacatagcttctg

SEQ ID NO: 208624 - DNA, 20 bp, Mus musculus
atatgtatgaatgtatgtgt

SEQ ID NO: 208625 - DNA, 22 bp, Mus musculus
tgttttgtgaccaattatatgg

SEQ ID NO: 208626 - DNA, 20 bp, Mus musculus
tggcaagtaaagctgtttgg

SEQ ID NO: 208627 - DNA, 22 bp, Mus musculus
tgttttgtgaccaattatatgg

SEQ ID NO: 208628 - DNA, 23 bp, Mus musculus
atttgtttcattttgaatatgct

SEQ ID NO: 208629 - DNA, 22 bp, Mus musculus
aaactccaacctcatcacttct

SEQ ID NO: 208630 - DNA, 23 bp, Mus musculus
tctctgactctcacttccctggc

SEQ ID NO: 208631 - DNA, 23 bp, Mus musculus
tcacacagctaccactttttctg

SEQ ID NO: 208632 - DNA, 18 bp, Mus musculus
tgggaatcccaattcaag

SEQ ID NO: 208633 - DNA, 23 bp, Mus musculus
tgagtagacagtgatgtcacctg

SEQ ID NO: 208634 - DNA, 23 bp, Mus musculus
tcagagttgagagtctgcagtca

SEQ ID NO: 208635 - DNA, 23 bp, Mus musculus
aagatgctgctgagagacttgtc

SEQ ID NO: 208636 - DNA, 23 bp, Mus musculus
tgagtctgtctttcttgttttct

SEQ ID NO: 208637 - DNA, 19 bp, Mus musculus
gctgtatagaaatgcttgg

SEQ ID NO: 208638 - DNA, 23 bp, Mus musculus
tctctctgtttctgttaagcatc

SEQ ID NO: 208639 - DNA, 23 bp, Mus musculus
ttgatgtgaaaatattttcatat

SEQ ID NO: 208640 - DNA, 23 bp, Mus musculus
ctagtggttttgttttcctcatg

SEQ ID NO: 208641 - DNA, 20 bp, Mus musculus
tgtgtatattaatatatgtg

SEQ ID NO: 208642 - DNA, 20 bp, Mus musculus
agacagagagacaaaaatgt

SEQ ID NO: 208643 - DNA, 23 bp, Mus musculus
tatgagaccacagtgagaacaga

SEQ ID NO: 208644 - DNA, 22 bp, Mus musculus
atgtatgtatatgtgtgtgtat

SEQ ID NO: 208645 - DNA, 21 bp, Mus musculus
caagaactctgtccatgctga

SEQ ID NO: 208646 - DNA, 23 bp, Mus musculus
aaaggcacaggcacatttgttgc

SEQ ID NO: 208647 - DNA, 23 bp, Mus musculus
tgcatgtatgtatgtatgtatgt

SEQ ID NO: 208648 - DNA, 21 bp, Mus musculus
tccatggtggtctgataggat

SEQ ID NO: 208649 - DNA, 22 bp, Mus musculus
tgttttgtgaccaattatatgg

SEQ ID NO: 208650 - DNA, 22 bp, Mus musculus
tgttttgtgaccaattatatgg

SEQ ID NO: 208651 - DNA, 23 bp, Mus musculus
gattacagttctgtgtttgtata

SEQ ID NO: 208652 - DNA, 20 bp, Mus musculus
aacaggagagattttgttga

SEQ ID NO: 208653 - DNA, 23 bp, Mus musculus
tgacagtctcactgactgctttc

SEQ ID NO: 208654 - DNA, 22 bp, Mus musculus
acatgctgtggaagttttctat

SEQ ID NO: 208655 - DNA, 19 bp, Mus musculus
ctatgtgcatatgtattat

SEQ ID NO: 208656 - DNA, 22 bp, Mus musculus
agagccatgtaattggagactg

SEQ ID NO: 208657 - DNA, 23 bp, Mus musculus
ctctgcctgtctgtctctctgtc

SEQ ID NO: 208658 - DNA, 23 bp, Mus musculus
tctcactctgtatctctgtctgt

SEQ ID NO: 208659 - DNA, 22 bp, Mus musculus
tgttttgtgacgaattatatgg

SEQ ID NO: 208660 - DNA, 23 bp, Mus musculus
tcttgttttgtgttcatcatgga

SEQ ID NO: 208661 - DNA, 23 bp, Mus musculus
agtcagatcacagtgtgctgatg

SEQ ID NO: 208662 - DNA, 22 bp, Mus musculus
tatcggcaacagtatgagcatt

SEQ ID NO: 208663 - DNA, 22 bp, Mus musculus
taaactgagatatgtatatcct

SEQ ID NO: 208664 - DNA, 23 bp, Mus musculus
aagtgtatacatcttcatactct

SEQ ID NO: 208665 - DNA, 23 bp, Mus musculus
tgtctgtctgtctgtctgtctgt

SEQ ID NO: 208666 - DNA, 23 bp, Mus musculus
agagaagataagttggaaggggt

SEQ ID NO: 208667 - DNA, 23 bp, Mus musculus
tttgacacagggtctcttgtagc

SEQ ID NO: 208668 - DNA, 23 bp, Mus musculus
tttgggttactacttggttgcta

SEQ ID NO: 208669 - DNA, 21 bp, Mus musculus
tgaaagagaagcagtgtgcat

SEQ ID NO: 208670 - DNA, 22 bp, Mus musculus
tcagagctgtgagtgagcacat

SEQ ID NO: 208671 - DNA, 23 bp, Mus musculus
tctggctgtgaggtttgctggat

SEQ ID NO: 208672 - DNA, 23 bp, Mus musculus
gtctgtctgtctgtttctctgtc

SEQ ID NO: 208673 - DNA, 19 bp, Mus musculus
tatatatatgtatatgtgt

SEQ ID NO: 208674 - DNA, 20 bp, Mus musculus
tctttgatagagagatggct

SEQ ID NO: 208675 - DNA, 21 bp, Mus musculus
ttaaaggttctattctgagtc

SEQ ID NO: 208676 - DNA, 23 bp, Mus musculus
tgagtgtctgtgtgtctgtgtgc

SEQ ID NO: 208677 - DNA, 23 bp, Mus musculus
atgtgtggatgctcatgtaggcc

SEQ ID NO: 208678 - DNA, 22 bp, Mus musculus
aaacagactagaagtaacgtga

SEQ ID NO: 208679 - DNA, 23 bp, Mus musculus
taaactctgtcactttctgacag

SEQ ID NO: 208680 - DNA, 23 bp, Mus musculus
cctcagagatgtgtttatgatgt

SEQ ID NO: 208681 - DNA, 19 bp, Mus musculus
cagaatacatctaggagct

SEQ ID NO: 208682 - DNA, 23 bp, Mus musculus
tctggatcaaggtagtttactag

SEQ ID NO: 208683 - DNA, 19 bp, Mus musculus
agacttgagactcattttg

SEQ ID NO: 208684 - DNA, 18 bp, Mus musculus
agtatgaatttgtgctgg

SEQ ID NO: 208685 - DNA, 22 bp, Mus musculus
tgttttgtgaccaattatatgg

SEQ ID NO: 208686 - DNA, 23 bp, Mus musculus
tcactctctgcatatggtttgac

SEQ ID NO: 208687 - DNA, 23 bp, Mus musculus
tatgagtgagaactctcgggttg

SEQ ID NO: 208688 - DNA, 23 bp, Mus musculus
agcagtctcagtcagttggtgcc

SEQ ID NO: 208689 - DNA, 20 bp, Mus musculus
tatatatatgtgtgtgtgca

SEQ ID NO: 208690 - DNA, 19 bp, Mus musculus
ctcatgtcagcaagcactt

SEQ ID NO: 208691 - DNA, 23 bp, Mus musculus
atcattgtatgcagtttctagat

SEQ ID NO: 208692 - DNA, 18 bp, Mus musculus
ttttcttgtctatttgcc

SEQ ID NO: 208693 - DNA, 23 bp, Mus musculus
tcaagtactatgttgaatagata

SEQ ID NO: 208694 - DNA, 22 bp, Mus musculus
tactgcttttagtatgtctatg

SEQ ID NO: 208695 - DNA, 23 bp, Mus musculus
ttttgtattgtccatcttctact

SEQ ID NO: 208696 - DNA, 23 bp, Mus musculus
tctgtctcagtcacctgctggtt

SEQ ID NO: 208697 - DNA, 19 bp, Mus musculus
agaggacatccatgctaga

SEQ ID NO: 208698 - DNA, 22 bp, Mus musculus
gttccactagtgattctgttat

SEQ ID NO: 208699 - DNA, 23 bp, Mus musculus
taacagcagacggtggagactag

SEQ ID NO: 208700 - DNA, 23 bp, Mus musculus
tgtcaccagggaactgagaggct

SEQ ID NO: 208701 - DNA, 23 bp, Mus musculus
ttcagacagacctcacagagaca

SEQ ID NO: 208702 - DNA, 23 bp, Mus musculus
ttacagacaggaagacaattgta

SEQ ID NO: 208703 - DNA, 23 bp, Mus musculus
tacatgtatatatatatatgtgt

SEQ ID NO: 208704 - DNA, 22 bp, Mus musculus
tgttttgtgaccaattatatgg

SEQ ID NO: 208705 - DNA, 23 bp, Mus musculus
accaccctcactcagtggctggc

SEQ ID NO: 208706 - DNA, 23 bp, Mus musculus
actggaacattagaaaccagtgc

SEQ ID NO: 208707 - DNA, 23 bp, Mus musculus
gtctgtctgtctgcctgtctgtc

SEQ ID NO: 208708 - DNA, 22 bp, Mus musculus
tgttttgtgaccaattatatgg

SEQ ID NO: 208709 - DNA, 23 bp, Mus musculus
aatggaatgtagcctgtgggtgt

SEQ ID NO: 208710 - DNA, 18 bp, Mus musculus
catgtaggactgagtgct

SEQ ID NO: 208711 - DNA, 22 bp, Mus musculus
ttatctttttgaaacctcatga

SEQ ID NO: 208712 - DNA, 18 bp, Mus musculus
atgttggtctgataggat

SEQ ID NO: 208713 - DNA, 23 bp, Mus musculus
tagtccatgttgatctgatagga

SEQ ID NO: 208714 - DNA, 20 bp, Mus musculus
tcaatatatatgtatatgta

SEQ ID NO: 208715 - DNA, 21 bp, Mus musculus
tatagtgccaacagaaatcat

SEQ ID NO: 208716 - DNA, 22 bp, Mus musculus
atcacagcctcttttcttctct

SEQ ID NO: 208717 - DNA, 23 bp, Mus musculus
catgggcatgtacacatgtgtga

SEQ ID NO: 208718 - DNA, 23 bp, Mus musculus
tatgtactgtgtatgtatatgtg

SEQ ID NO: 208719 - DNA, 18 bp, Mus musculus
tttgtggatgtgtgtata

SEQ ID NO: 208720 - DNA, 23 bp, Mus musculus
tatgtgtatatatatatgtgtgt

SEQ ID NO: 208721 - DNA, 22 bp, Mus musculus
aagactactgaaattggtgttg

SEQ ID NO: 208722 - DNA, 21 bp, Mus musculus
tccatggtggtctgataggat

SEQ ID NO: 208723 - DNA, 22 bp, Mus musculus
tgttttgtgaccaattatatgg

SEQ ID NO: 208724 - DNA, 23 bp, Mus musculus
ttcttattctacaggtgaatgca

SEQ ID NO: 208725 - DNA, 19 bp, Mus musculus
tgtacatatgtatatatgt

SEQ ID NO: 208726 - DNA, 23 bp, Mus musculus
acatatgtatatgtatatgtatg

SEQ ID NO: 208727 - DNA, 23 bp, Mus musculus
tgtatatacgtacatatgcatat

SEQ ID NO: 208728 - DNA, 19 bp, Mus musculus
agcatgtacgtatgtatgt

SEQ ID NO: 208729 - DNA, 23 bp, Mus musculus
tagtccatggtgatctgatagga

SEQ ID NO: 208730 - DNA, 23 bp, Mus musculus
ttgtttgtaaccaattatgtggt

SEQ ID NO: 208731 - DNA, 18 bp, Mus musculus
ggtctctctatatatata

SEQ ID NO: 208732 - DNA, 23 bp, Mus musculus
tctgtggattgtagcctggacat

SEQ ID NO: 208733 - DNA, 23 bp, Mus musculus
agtgagtgcatatctaatgaata

SEQ ID NO: 208734 - DNA, 23 bp, Mus musculus
tgcaaagtgaagaaagtgagctg

SEQ ID NO: 208735 - DNA, 22 bp, Mus musculus
agaagtcttcattgctctttct

SEQ ID NO: 208736 - DNA, 23 bp, Mus musculus
tagctcagtacagtggatcagtt

SEQ ID NO: 208737 - DNA, 22 bp, Mus musculus
tgttttgtgaccaattatatgg

SEQ ID NO: 208738 - DNA, 22 bp, Mus musculus
tgttttgtgaccaattatatgg

SEQ ID NO: 208739 - DNA, 19 bp, Mus musculus
cttgagagcgagtggaatg

SEQ ID NO: 208740 - DNA, 23 bp, Mus musculus
atgtgtgtatgtgcatgtgcatg

SEQ ID NO: 208741 - DNA, 22 bp, Mus musculus
tgttttgtgaccaattatatgg

SEQ ID NO: 208742 - DNA, 23 bp, Mus musculus
gtgaagacactgaggactgtacc

SEQ ID NO: 208743 - DNA, 21 bp, Mus musculus
agaccttgacagtctcttccc

SEQ ID NO: 208744 - DNA, 23 bp, Mus musculus
tgtatgtatgtacatatgtatgt

SEQ ID NO: 208745 - DNA, 23 bp, Mus musculus
acagatgacagtgactccaaagg

SEQ ID NO: 208746 - DNA, 22 bp, Mus musculus
tgattatatatcaatatgaaag

SEQ ID NO: 208747 - DNA, 22 bp, Mus musculus
ttttttgttgctactgtaatat

SEQ ID NO: 208748 - DNA, 23 bp, Mus musculus
gtattcattcaagtcagagagct

SEQ ID NO: 208749 - DNA, 19 bp, Mus musculus
atctgtaggttaattttgg

SEQ ID NO: 208750 - DNA, 19 bp, Mus musculus
cagctgattatccatgctc

SEQ ID NO: 208751 - DNA, 18 bp, Mus musculus
gtgcatgtgtgtatatat

SEQ ID NO: 208752 - DNA, 20 bp, Mus musculus
tgtctatatatgtatatatg

SEQ ID NO: 208753 - DNA, 23 bp, Mus musculus
actggtgctttgtcactgtttct

SEQ ID NO: 208754 - DNA, 21 bp, Mus musculus
ttctggaaataatgatttctc

SEQ ID NO: 208755 - DNA, 23 bp, Mus musculus
catgtgtctggaagaattcacag

SEQ ID NO: 208756 - DNA, 20 bp, Mus musculus
aagggtgctggtgccttcct

SEQ ID NO: 208757 - DNA, 21 bp, Mus musculus
tatacactctaatattgtctc

SEQ ID NO: 208758 - DNA, 20 bp, Mus musculus
ttaggatgttatgctgctct

SEQ ID NO: 208759 - DNA, 23 bp, Mus musculus
ggaagagaacagaagccactgat

SEQ ID NO: 208760 - DNA, 22 bp, Mus musculus
gcatactgttttctcaccagga

SEQ ID NO: 208761 - DNA, 23 bp, Mus musculus
ttgacagcatgctgaaagcaaat

SEQ ID NO: 208762 - DNA, 23 bp, Mus musculus
tgactagtgtctgtgttctagtg

SEQ ID NO: 208763 - DNA, 23 bp, Mus musculus
cactcccctttctctaactttgg

SEQ ID NO: 208764 - DNA, 21 bp, Mus musculus
tagcaaccacatggtggctta

SEQ ID NO: 208765 - DNA, 23 bp, Mus musculus
agacagacagagagcttgcactg

SEQ ID NO: 208766 - DNA, 23 bp, Mus musculus
atatatgtgtgtgtatatgtata

SEQ ID NO: 208767 - DNA, 23 bp, Mus musculus
tatgtgtgtgtatatgtatatgt

SEQ ID NO: 208768 - DNA, 23 bp, Mus musculus
tatatgtgtgtatatgtatatac

SEQ ID NO: 208769 - DNA, 23 bp, Mus musculus
tatatgtgtgtatatgtatatat

SEQ ID NO: 208770 - DNA, 20 bp, Mus musculus
tgtgtgtgtgtatgtatata

SEQ ID NO: 208771 - DNA, 23 bp, Mus musculus
tatgtatgtatgtatgtgtgtgt

SEQ ID NO: 208772 - DNA, 18 bp, Mus musculus
tccctgggtctgagggtc

SEQ ID NO: 208773 - DNA, 23 bp, Mus musculus
cagaaggctcagtgtgtgtgtct

SEQ ID NO: 208774 - DNA, 23 bp, Mus musculus
tggctggctgggtggctgcctca

SEQ ID NO: 208775 - DNA, 22 bp, Mus musculus
agtacttctgccagacatgtat

SEQ ID NO: 208776 - DNA, 22 bp, Mus musculus
tgttttgtgaccaattatatgg

SEQ ID NO: 208777 - DNA, 23 bp, Mus musculus
tcttaaggttttaatgaggaaca

SEQ ID NO: 208778 - DNA, 23 bp, Mus musculus
ttcactcactcagacattactgg

SEQ ID NO: 208779 - DNA, 22 bp, Mus musculus
tgttttgtgaccaattatatgg

SEQ ID NO: 208780 - DNA, 23 bp, Mus musculus
gatttcagttattgttgttcccg

SEQ ID NO: 208781 - DNA, 20 bp, Mus musculus
gagcacaacagagtgtggtc

SEQ ID NO: 208782 - DNA, 23 bp, Mus musculus
accatgagagaacatactgaggg

SEQ ID NO: 208783 - DNA, 19 bp, Mus musculus
tggtctttcacgacagact

SEQ ID NO: 208784 - DNA, 20 bp, Mus musculus
ataacatgctgcattttatg

SEQ ID NO: 208785 - DNA, 23 bp, Mus musculus
atgatgtaggcaatactgtgagt

SEQ ID NO: 208786 - DNA, 23 bp, Mus musculus
gaagacactgagcttaggagctg

SEQ ID NO: 208787 - DNA, 22 bp, Mus musculus
tgtgtctctgtcagaattcact

SEQ ID NO: 208788 - DNA, 23 bp, Mus musculus
agctagttgaagctagattagat

SEQ ID NO: 208789 - DNA, 23 bp, Mus musculus
ttagtccgtgttgatctggtagg

SEQ ID NO: 208790 - DNA, 23 bp, Mus musculus
tgagactgtctgtgaatctgtgt

SEQ ID NO: 208791 - DNA, 23 bp, Mus musculus
cactctcactctgtctcccctcc

SEQ ID NO: 208792 - DNA, 23 bp, Mus musculus
ttgaaagtgtaggtcaatgaggg

SEQ ID NO: 208793 - DNA, 23 bp, Mus musculus
attcagaatttcatgatctgtgt

SEQ ID NO: 208794 - DNA, 23 bp, Mus musculus
ctgtagagagtgtgcagagtgca

SEQ ID NO: 208795 - DNA, 22 bp, Mus musculus
attgaagctgttttgaaagttg

SEQ ID NO: 208796 - DNA, 19 bp, Mus musculus
acgtggtagatagttctgt

SEQ ID NO: 208797 - DNA, 23 bp, Mus musculus
ctctctctgtgtaatgtctggct

SEQ ID NO: 208798 - DNA, 20 bp, Mus musculus
cgcaccctctgtgtcacagt

SEQ ID NO: 208799 - DNA, 23 bp, Mus musculus
tcactctgacttttttttgtgtg

SEQ ID NO: 208800 - DNA, 23 bp, Mus musculus
cactggaatgaagtctgcatttt

SEQ ID NO: 208801 - DNA, 23 bp, Mus musculus
tgagtacatgcatgggtatgtgt

SEQ ID NO: 208802 - DNA, 19 bp, Mus musculus
aggagcttgaggaatggct

SEQ ID NO: 208803 - DNA, 23 bp, Mus musculus
agtgctgggtgactcagtgtctc

SEQ ID NO: 208804 - DNA, 21 bp, Mus musculus
ttcaaatctcagcaaccacat

SEQ ID NO: 208805 - DNA, 23 bp, Mus musculus
atgctagaggctggcttagcagt

SEQ ID NO: 208806 - DNA, 23 bp, Mus musculus
gtgatgtggtatattctttttat

SEQ ID NO: 208807 - DNA, 20 bp, Mus musculus
tgtatgtatgtatatatgcc

SEQ ID NO: 208808 - DNA, 20 bp, Mus musculus
gtatgtatgcatgtatgtat

SEQ ID NO: 208809 - DNA, 20 bp, Mus musculus
aaaggttctgagttcaaatc

SEQ ID NO: 208810 - DNA, 19 bp, Mus musculus
tctcttccttttgtttgct

SEQ ID NO: 208811 - DNA, 19 bp, Mus musculus
caggcagacacagacacag

SEQ ID NO: 208812 - DNA, 20 bp, Mus musculus
ctgaggatttgaactcaagt

SEQ ID NO: 208813 - DNA, 23 bp, Mus musculus
tatgcttgaaatctcagcactta

SEQ ID NO: 208814 - DNA, 21 bp, Mus musculus
tgtctctggaagactagtggc

SEQ ID NO: 208815 - DNA, 23 bp, Mus musculus
gctggctggctggctggctggct

SEQ ID NO: 208816 - DNA, 23 bp, Mus musculus
tggctggctggctggctgggtgg

SEQ ID NO: 208817 - DNA, 23 bp, Mus musculus
ttcaaatctcagcaaccacttag

SEQ ID NO: 208818 - DNA, 23 bp, Mus musculus
ttgtctgctcattttgtagttct

SEQ ID NO: 208819 - DNA, 23 bp, Mus musculus
atatggttcagtgaaagtatgta

SEQ ID NO: 208820 - DNA, 22 bp, Mus musculus
atgcattgaagcatacacagta

SEQ ID NO: 208821 - DNA, 23 bp, Mus musculus
gtctgtctgtctgtcttgtctgt

SEQ ID NO: 208822 - DNA, 22 bp, Mus musculus
ctgatttttctctgctactcat

SEQ ID NO: 208823 - DNA, 19 bp, Mus musculus
atgaggaacagcaaccaag

SEQ ID NO: 208824 - DNA, 23 bp, Mus musculus
taaagttgaatcactcaagaaag

SEQ ID NO: 208825 - DNA, 21 bp, Mus musculus
tatgtatgcatgtgtgtatgt

SEQ ID NO: 208826 - DNA, 20 bp, Mus musculus
tatgtgtgtgtgtgtatatg

SEQ ID NO: 208827 - DNA, 21 bp, Mus musculus
tatcagatggagggatggagg

SEQ ID NO: 208828 - DNA, 23 bp, Mus musculus
tggacagactgcagagagtgtgg

SEQ ID NO: 208829 - DNA, 23 bp, Mus musculus
tgtatgtatgtatgtatatctag

SEQ ID NO: 208830 - DNA, 22 bp, Mus musculus
aaatgatatattatatatgtgt

SEQ ID NO: 208831 - DNA, 23 bp, Mus musculus
gaggaacacttgagtttttgatc

SEQ ID NO: 208832 - DNA, 23 bp, Mus musculus
gaatctcagggtcgttttgattg

SEQ ID NO: 208833 - DNA, 19 bp, Mus musculus
tatgtatatgtatgtgtat

SEQ ID NO: 208834 - DNA, 22 bp, Mus musculus
acagactgttgtgagccactgt

SEQ ID NO: 208835 - DNA, 23 bp, Mus musculus
tctctgtctctgagtgtttaagg

SEQ ID NO: 208836 - DNA, 22 bp, Mus musculus
tgttttgtgaccaattatatgg

SEQ ID NO: 208837 - DNA, 19 bp, Mus musculus
tttcttctttgacccagtg

SEQ ID NO: 208838 - DNA, 22 bp, Mus musculus
tgttttgtgaccaattatatgg

SEQ ID NO: 208839 - DNA, 22 bp, Mus musculus
tgttttgtgaccaattatatgg

SEQ ID NO: 208840 - DNA, 22 bp, Mus musculus
actgtcacagtgataactctgt

SEQ ID NO: 208841 - DNA, 21 bp, Mus musculus
atacatgtacatgaggggcac

SEQ ID NO: 208842 - DNA, 23 bp, Mus musculus
gagaactgactgctcttccagag

SEQ ID NO: 208843 - DNA, 22 bp, Mus musculus
tcattctgaaagactgagatct

SEQ ID NO: 208844 - DNA, 22 bp, Mus musculus
tttaagcatcttttgtagtgct

SEQ ID NO: 208845 - DNA, 23 bp, Mus musculus
ttgtgctagaatagttgtctcta

SEQ ID NO: 208846 - DNA, 22 bp, Mus musculus
tgttttgtgaccaattatatgg

SEQ ID NO: 208847 - DNA, 21 bp, Mus musculus
tagtgtgtatatgtatatata

SEQ ID NO: 208848 - DNA, 20 bp, Mus musculus
atactgcagtgtctgcacat

SEQ ID NO: 208849 - DNA, 21 bp, Mus musculus
tgggacactacagatatttct

SEQ ID NO: 208850 - DNA, 23 bp, Mus musculus
tttgcctttacttgatgtgactg

SEQ ID NO: 208851 - DNA, 23 bp, Mus musculus
tatgtctgtacaccctatgtgta

SEQ ID NO: 208852 - DNA, 23 bp, Mus musculus
ctctgagagtcaagagtgtgtcc

SEQ ID NO: 208853 - DNA, 23 bp, Mus musculus
acactgtatgtcagaggtaaagt

SEQ ID NO: 208854 - DNA, 19 bp, Mus musculus
ggtagatgttggagtgggc

SEQ ID NO: 208855 - DNA, 20 bp, Mus musculus
tggtcagccctacagctctc

SEQ ID NO: 208856 - DNA, 23 bp, Mus musculus
taaccaaagttgagttccacaag

SEQ ID NO: 208857 - DNA, 23 bp, Mus musculus
tttattcaagttgaattgggatg

SEQ ID NO: 208858 - DNA, 21 bp, Mus musculus
agaaagaccaatgccaataag

SEQ ID NO: 208859 - DNA, 23 bp, Mus musculus
tctctgtctctatctctgtctct

SEQ ID NO: 208860 - DNA, 22 bp, Mus musculus
tgtcacagtgtggaatggatgt

SEQ ID NO: 208861 - DNA, 21 bp, Mus musculus
gatggatagtttaatgtggaa

SEQ ID NO: 208862 - DNA, 18 bp, Mus musculus
tgctgccatgatttactg

SEQ ID NO: 208863 - DNA, 20 bp, Mus musculus
tgtgtatatgtatatgtgta

SEQ ID NO: 208864 - DNA, 22 bp, Mus musculus
tatttgcacatatatttacaat

SEQ ID NO: 208865 - DNA, 18 bp, Mus musculus
aaacaagattgcaaaaca

SEQ ID NO: 208866 - DNA, 23 bp, Mus musculus
tctcattctcagtcactcaggct

SEQ ID NO: 208867 - DNA, 19 bp, Mus musculus
ttgttgtgtggatggagct

SEQ ID NO: 208868 - DNA, 22 bp, Mus musculus
tctttagtttgggaatgttttc

SEQ ID NO: 208869 - DNA, 22 bp, Mus musculus
tgttttgtgaccaattatatgg

SEQ ID NO: 208870 - DNA, 19 bp, Mus musculus
caactggagagggagctgt

SEQ ID NO: 208871 - DNA, 22 bp, Mus musculus
tgttttgtgaccaattatatgg

SEQ ID NO: 208872 - DNA, 22 bp, Mus musculus
cttgtgtctgggttacctcact

SEQ ID NO: 208873 - DNA, 18 bp, Mus musculus
atcctaggtgaatctctc

SEQ ID NO: 208874 - DNA, 23 bp, Mus musculus
taagtggaagttttgcaaattga

SEQ ID NO: 208875 - DNA, 20 bp, Mus musculus
tcagttcccagaaaacacat

SEQ ID NO: 208876 - DNA, 21 bp, Mus musculus
ttatagctacataaggtaaat

SEQ ID NO: 208877 - DNA, 22 bp, Mus musculus
cagtcttaggccatggtggtct

SEQ ID NO: 208878 - DNA, 23 bp, Mus musculus
tagtgcatggtgatctgatagga

SEQ ID NO: 208879 - DNA, 23 bp, Mus musculus
tttgtgacctattatgtggtcaa

SEQ ID NO: 208880 - DNA, 22 bp, Mus musculus
tgttttgtgaccaattatatgg

SEQ ID NO: 208881 - DNA, 22 bp, Mus musculus
tgttttgtgaccaattatatgg

SEQ ID NO: 208882 - DNA, 22 bp, Mus musculus
tgttttgtgaccaattatatgg

SEQ ID NO: 208883 - DNA, 23 bp, Mus musculus
tttgcgaccaattatatggtcaa

SEQ ID NO: 208884 - DNA, 23 bp, Mus musculus
tgttctgtctgtctgtctgcctc

SEQ ID NO: 208885 - DNA, 20 bp, Mus musculus
tattgctactatatatcaca

SEQ ID NO: 208886 - DNA, 22 bp, Mus musculus
tgttttgtgaccaattatatgg

SEQ ID NO: 208887 - DNA, 22 bp, Mus musculus
atatcaacaatttcttaatttg

SEQ ID NO: 208888 - DNA, 23 bp, Mus musculus
tattaagagaggatttgatccac

SEQ ID NO: 208889 - DNA, 23 bp, Mus musculus
aataaatcagatattcatggtaa

SEQ ID NO: 208890 - DNA, 22 bp, Mus musculus
tttgaagttctgtttgtgtgag

SEQ ID NO: 208891 - DNA, 20 bp, Mus musculus
agcttgtatgtatgtatgta

SEQ ID NO: 208892 - DNA, 23 bp, Mus musculus
acatgtgtgtgtgtgtgcctctg

SEQ ID NO: 208893 - DNA, 23 bp, Mus musculus
tgagagtgagctatgtcaaggag

SEQ ID NO: 208894 - DNA, 18 bp, Mus musculus
acactcacacacatactt

SEQ ID NO: 208895 - DNA, 23 bp, Mus musculus
tctctgatgtgacagagctcagg

SEQ ID NO: 208896 - DNA, 20 bp, Mus musculus
tttgtctatatatatgtgtg

SEQ ID NO: 208897 - DNA, 18 bp, Mus musculus
gcaatgtggcaagctggt

SEQ ID NO: 208898 - DNA, 19 bp, Mus musculus
ctgaggaatgttgaatggc

SEQ ID NO: 208899 - DNA, 23 bp, Mus musculus
agtcaggatgaagaacagtattt

SEQ ID NO: 208900 - DNA, 22 bp, Mus musculus
ttgtttctaggttcactggccc

SEQ ID NO: 208901 - DNA, 21 bp, Mus musculus
tatgtttgtggtttggttctg

SEQ ID NO: 208902 - DNA, 22 bp, Mus musculus
tgtgatcctggttgtgtcagaa

SEQ ID NO: 208903 - DNA, 20 bp, Mus musculus
atggttgaactctgcaatct

SEQ ID NO: 208904 - DNA, 21 bp, Mus musculus
tttatcaggagttacctattg

SEQ ID NO: 208905 - DNA, 21 bp, Mus musculus
gagagttgaaaggcagctgga

SEQ ID NO: 208906 - DNA, 23 bp, Mus musculus
actggaggtggactttgaggttt

SEQ ID NO: 208907 - DNA, 23 bp, Mus musculus
tttgttcttttcctacagttttg

SEQ ID NO: 208908 - DNA, 23 bp, Mus musculus
aatgcttgtatgtatgtatgtat

SEQ ID NO: 208909 - DNA, 22 bp, Mus musculus
tcacttgctgctccactgtaaa

SEQ ID NO: 208910 - DNA, 19 bp, Mus musculus
aggagtccctacactgcag

SEQ ID NO: 208911 - DNA, 23 bp, Mus musculus
tgtgacagacaagacagtgcaga

SEQ ID NO: 208912 - DNA, 21 bp, Mus musculus
attgcctctcagagagttctc

SEQ ID NO: 208913 - DNA, 23 bp, Mus musculus
gtctctgtgtgtatctgtatgtg

SEQ ID NO: 208914 - DNA, 19 bp, Mus musculus
gaggttctgagttcaactc

SEQ ID NO: 208915 - DNA, 23 bp, Mus musculus
tgtaatactgtttggtaaagagt

SEQ ID NO: 208916 - DNA, 20 bp, Mus musculus
aatctcctcatcatgcatta

SEQ ID NO: 208917 - DNA, 22 bp, Mus musculus
ctctggctctctctctctctat

SEQ ID NO: 208918 - DNA, 19 bp, Mus musculus
tgactcagctgttaagggt

SEQ ID NO: 208919 - DNA, 18 bp, Mus musculus
tgagttcaatttccagtg

SEQ ID NO: 208920 - DNA, 21 bp, Mus musculus
tgttaataagtttgtatttct

SEQ ID NO: 208921 - DNA, 22 bp, Mus musculus
tgttttgtgaccaattatatgg

SEQ ID NO: 208922 - DNA, 23 bp, Mus musculus
actctgtctctgtgtaatttctg

SEQ ID NO: 208923 - DNA, 20 bp, Mus musculus
atgagagtggggtaatgaag

SEQ ID NO: 208924 - DNA, 22 bp, Mus musculus
tgttttgtgaccaattatatgg

SEQ ID NO: 208925 - DNA, 22 bp, Mus musculus
tgttttgtgaccaattatatgg

SEQ ID NO: 208926 - DNA, 23 bp, Mus musculus
gttctctggttcttattgtaggg

SEQ ID NO: 208927 - DNA, 23 bp, Mus musculus
gtcagacagtagagagagggaac

SEQ ID NO: 208928 - DNA, 21 bp, Mus musculus
tcaaagtcacagagtaagggc

SEQ ID NO: 208929 - DNA, 23 bp, Mus musculus
tggataaccaggtctatctggaa

SEQ ID NO: 208930 - DNA, 23 bp, Mus musculus
tgtatatgtatatatgtatatgt

SEQ ID NO: 208931 - DNA, 23 bp, Mus musculus
tgactgtgtctgacattgcagtt

SEQ ID NO: 208932 - DNA, 22 bp, Mus musculus
aagtttgatgaggattgcattt

SEQ ID NO: 208933 - DNA, 18 bp, Mus musculus
gattttgattgtatactc

SEQ ID NO: 208934 - DNA, 19 bp, Mus musculus
tcagaggtcctgagttcaa

SEQ ID NO: 208935 - DNA, 23 bp, Mus musculus
gttgtgtctgtcaatactataac

SEQ ID NO: 208936 - DNA, 23 bp, Mus musculus
tgttgggttccttctgtctctgc

SEQ ID NO: 208937 - DNA, 22 bp, Mus musculus
attcagacaggctatctagcag

SEQ ID NO: 208938 - DNA, 22 bp, Mus musculus
tcacaggcttaataaagactct

SEQ ID NO: 208939 - DNA, 23 bp, Mus musculus
atgtgtgtatatgtatatgtgtg

SEQ ID NO: 208940 - DNA, 23 bp, Mus musculus
actctctccgacactcactggct

SEQ ID NO: 208941 - DNA, 21 bp, Mus musculus
tttgcatatatacatgtgtgt

SEQ ID NO: 208942 - DNA, 20 bp, Mus musculus
tatgtatatatgtatgtgtg

SEQ ID NO: 208943 - DNA, 18 bp, Mus musculus
tatgagtgtgtgtataca

SEQ ID NO: 208944 - DNA, 20 bp, Mus musculus
gagcatgaaggagctgtggg

SEQ ID NO: 208945 - DNA, 21 bp, Mus musculus
ttctcctgcattaactttctg

SEQ ID NO: 208946 - DNA, 23 bp, Mus musculus
cacacactcagcctgtctgcctg

SEQ ID NO: 208947 - DNA, 18 bp, Mus musculus
cctttctattcttcaggc

SEQ ID NO: 208948 - DNA, 23 bp, Mus musculus
acacacagggaatggctgtgata

SEQ ID NO: 208949 - DNA, 23 bp, Mus musculus
tctgtatttgttagcatgtatat

SEQ ID NO: 208950 - DNA, 23 bp, Mus musculus
tactgactggtatttatttgttt

SEQ ID NO: 208951 - DNA, 23 bp, Mus musculus
gagttgtgtctgcctctctcagt

SEQ ID NO: 208952 - DNA, 23 bp, Mus musculus
agccctgactgctcttccagagg

SEQ ID NO: 208953 - DNA, 21 bp, Mus musculus
agagagaccagctccagctgc

SEQ ID NO: 208954 - DNA, 23 bp, Mus musculus
tcactcacactgagtctgcagtc

SEQ ID NO: 208955 - DNA, 23 bp, Mus musculus
tgtctgactgtctgtctattctc

SEQ ID NO: 208956 - DNA, 22 bp, Mus musculus
tgttttgtgaccaattatatgg

SEQ ID NO: 208957 - DNA, 22 bp, Mus musculus
cactcagtcagtcagtcccaat

SEQ ID NO: 208958 - DNA, 18 bp, Mus musculus
tggtcagaaatgcagttc

SEQ ID NO: 208959 - DNA, 23 bp, Mus musculus
actggaatttagttcttactgaa

SEQ ID NO: 208960 - DNA, 18 bp, Mus musculus
tatctcaagtgacagagc

SEQ ID NO: 208961 - DNA, 22 bp, Mus musculus
tactgtaactccaggtggatgt

SEQ ID NO: 208962 - DNA, 22 bp, Mus musculus
attgcaagtagcttcttttgtt

SEQ ID NO: 208963 - DNA, 23 bp, Mus musculus
ctctgtctgtctgtatatgatgg

SEQ ID NO: 208964 - DNA, 23 bp, Mus musculus
tggtttgtaaagatgtttgaaaa

SEQ ID NO: 208965 - DNA, 23 bp, Mus musculus
cacactctcacactgtgaactgt

SEQ ID NO: 208966 - DNA, 23 bp, Mus musculus
gggtctctcactgagtcaggtag

SEQ ID NO: 208967 - DNA, 23 bp, Mus musculus
tgtgtggtttgtagtctgcatac

SEQ ID NO: 208968 - DNA, 23 bp, Mus musculus
tgcctgcctgcctcacagcctga

SEQ ID NO: 208969 - DNA, 20 bp, Mus musculus
atgagttgcttatctatgga

SEQ ID NO: 208970 - DNA, 19 bp, Mus musculus
ttgactagagtgactggtc

SEQ ID NO: 208971 - DNA, 21 bp, Mus musculus
ttctctagaggaacagatcca

SEQ ID NO: 208972 - DNA, 23 bp, Mus musculus
attgtatcagtttttgtggaaat

SEQ ID NO: 208973 - DNA, 21 bp, Mus musculus
tacagagttgtgagtgagcac

SEQ ID NO: 208974 - DNA, 22 bp, Mus musculus
aatctcacagccacacttcttt

SEQ ID NO: 208975 - DNA, 23 bp, Mus musculus
gcagaggttgttgaatctgtatg

SEQ ID NO: 208976 - DNA, 22 bp, Mus musculus
ttctgtgagtgagacatcctgg

SEQ ID NO: 208977 - DNA, 20 bp, Mus musculus
aagagcactgactgctcttc

SEQ ID NO: 208978 - DNA, 23 bp, Mus musculus
atgcatgtatgtatgaatgtatg

SEQ ID NO: 208979 - DNA, 23 bp, Mus musculus
cagagcactagtgatttggttga

SEQ ID NO: 208980 - DNA, 23 bp, Mus musculus
tctgtctctgtgtgtgtgtgtgc

SEQ ID NO: 208981 - DNA, 23 bp, Mus musculus
aacatgaggtgcatatatatatg

SEQ ID NO: 208982 - DNA, 23 bp, Mus musculus
ttacattttgtgtgtgtgtgtgt

SEQ ID NO: 208983 - DNA, 23 bp, Mus musculus
ttaattcattcatctgcctgcct

SEQ ID NO: 208984 - DNA, 22 bp, Mus musculus
tctctgactctcattcttcata

SEQ ID NO: 208985 - DNA, 23 bp, Mus musculus
ctgctctctctctctgcctgtgc

SEQ ID NO: 208986 - DNA, 19 bp, Mus musculus
tctgaagttggtcacttga

SEQ ID NO: 208987 - DNA, 20 bp, Mus musculus
tgtgctatatgtgtctgtgt

SEQ ID NO: 208988 - DNA, 23 bp, Mus musculus
atgtgtgtctgtgtgtatgtagt

SEQ ID NO: 208989 - DNA, 19 bp, Mus musculus
tatacacacatatacatat

SEQ ID NO: 208990 - DNA, 19 bp, Mus musculus
accgggttttcagatggtg

SEQ ID NO: 208991 - DNA, 23 bp, Mus musculus
tgcttgactgttttgtacatgca

SEQ ID NO: 208992 - DNA, 23 bp, Mus musculus
cgatgacagaaaaatgtgaggtg

SEQ ID NO: 208993 - DNA, 23 bp, Mus musculus
atatatctatatctatatctgta

SEQ ID NO: 208994 - DNA, 21 bp, Mus musculus
tcggtgagactttgtgtgtag

SEQ ID NO: 208995 - DNA, 23 bp, Mus musculus
acaatctctgactctctttctac

SEQ ID NO: 208996 - DNA, 21 bp, Mus musculus
atacatgtatatatgtatatg

SEQ ID NO: 208997 - DNA, 21 bp, Mus musculus
gtatgcatatatgtatgtatg

SEQ ID NO: 208998 - DNA, 21 bp, Mus musculus
atgcatgcatgtatgtatgta

SEQ ID NO: 208999 - DNA, 22 bp, Mus musculus
tgcatgtatgtgtgcaacagta

SEQ ID NO: 209000 - DNA, 20 bp, Mus musculus
gtcaggaaagtttcaggact

SEQ ID NO: 209001 - DNA, 23 bp, Mus musculus
tgtggctgaattcacagtctatt

SEQ ID NO: 209002 - DNA, 22 bp, Mus musculus
tcagacagcagagactgggcaa

SEQ ID NO: 209003 - DNA, 23 bp, Mus musculus
tctgtctgtctgtctgtctgtcc

SEQ ID NO: 209004 - DNA, 22 bp, Mus musculus
tgtgtgtgtgagtgcatgtgca

SEQ ID NO: 209005 - DNA, 23 bp, Mus musculus
gcatgatgtgcacacaggtatag

SEQ ID NO: 209006 - DNA, 23 bp, Mus musculus
ggctctgcatgaggaagtgaccg

SEQ ID NO: 209007 - DNA, 18 bp, Mus musculus
tgcctttttaatctttta

SEQ ID NO: 209008 - DNA, 18 bp, Mus musculus
tactgagattaaaggtgt

SEQ ID NO: 209009 - DNA, 23 bp, Mus musculus
tatgtatgtatatgtataggtgt

SEQ ID NO: 209010 - DNA, 23 bp, Mus musculus
tgttctcaaaagtgtagctgctg

SEQ ID NO: 209011 - DNA, 23 bp, Mus musculus
tggcagtcactcactcagtggca

SEQ ID NO: 209012 - DNA, 20 bp, Mus musculus
tcagagagagcacagagcgc

SEQ ID NO: 209013 - DNA, 19 bp, Mus musculus
aaacagcactgaaactcag

SEQ ID NO: 209014 - DNA, 19 bp, Mus musculus
atatatgctcagtttctta

SEQ ID NO: 209015 - DNA, 20 bp, Mus musculus
agttccttctgagtgcccag

SEQ ID NO: 209016 - DNA, 22 bp, Mus musculus
tcgatgttgatggtctggaagc

SEQ ID NO: 209017 - DNA, 23 bp, Mus musculus
actatgacatttgtagtgttctc

SEQ ID NO: 209018 - DNA, 18 bp, Mus musculus
tatcacatgtacacacac

SEQ ID NO: 209019 - DNA, 18 bp, Mus musculus
tacctgttgatctccaag

SEQ ID NO: 209020 - DNA, 19 bp, Mus musculus
tctgagatgggagagagca

SEQ ID NO: 209021 - DNA, 20 bp, Mus musculus
tgagagatgagtctgtgctg

SEQ ID NO: 209022 - DNA, 23 bp, Mus musculus
atatttgtgtgggtgcatgtgta

SEQ ID NO: 209023 - DNA, 23 bp, Mus musculus
ttgttactggaacctgatagcct

SEQ ID NO: 209024 - DNA, 23 bp, Mus musculus
ttctctctgccactctctgtcct

SEQ ID NO: 209025 - DNA, 22 bp, Mus musculus
acgtgtcaggatgacatcttcg

SEQ ID NO: 209026 - DNA, 23 bp, Mus musculus
cctcaagatcctatagactgaag

SEQ ID NO: 209027 - DNA, 23 bp, Mus musculus
ttacgttgtttgttgatgtctaa

SEQ ID NO: 209028 - DNA, 23 bp, Mus musculus
tgcacagactgaattgagactcc

SEQ ID NO: 209029 - DNA, 23 bp, Mus musculus
tatgtgattatatatgtatgtga

SEQ ID NO: 209030 - DNA, 20 bp, Mus musculus
atgtgtttatgagtatatgt

SEQ ID NO: 209031 - DNA, 20 bp, Mus musculus
tatgcatatgtatacatata

SEQ ID NO: 209032 - DNA, 19 bp, Mus musculus
tgtgtatgcatgtatatat

SEQ ID NO: 209033 - DNA, 23 bp, Mus musculus
tatgtatatgcatatgttttgca

SEQ ID NO: 209034 - DNA, 20 bp, Mus musculus
tgcatgagtgttttgcatgt

SEQ ID NO: 209035 - DNA, 20 bp, Mus musculus
tgcatgtatgtatgtatgta

SEQ ID NO: 209036 - DNA, 23 bp, Mus musculus
tctgcctgtgtctgtctgtctgt

SEQ ID NO: 209037 - DNA, 23 bp, Mus musculus
actgcaagagttctcggtctctg

SEQ ID NO: 209038 - DNA, 22 bp, Mus musculus
tgttttgtgaccaattatatgg

SEQ ID NO: 209039 - DNA, 22 bp, Mus musculus
tgttttgtgaccaattatatgg

SEQ ID NO: 209040 - DNA, 23 bp, Mus musculus
caggggaagagtctatagtgatg

SEQ ID NO: 209041 - DNA, 23 bp, Mus musculus
actgtctctctgtgaaaagttcc

SEQ ID NO: 209042 - DNA, 22 bp, Mus musculus
tgttttgtgaccaattatatgg

SEQ ID NO: 209043 - DNA, 22 bp, Mus musculus
tttgcttgtatgtatgtatgta

SEQ ID NO: 209044 - DNA, 23 bp, Mus musculus
agttcagtctccctgtctgtgtg

SEQ ID NO: 209045 - DNA, 18 bp, Mus musculus
cagaggtcttaagttcaa

SEQ ID NO: 209046 - DNA, 20 bp, Mus musculus
atcagaggctgggatagttc

SEQ ID NO: 209047 - DNA, 23 bp, Mus musculus
tctcagtcagtctctcattagcc

SEQ ID NO: 209048 - DNA, 23 bp, Mus musculus
accctgtgcctctgtctctaagc

SEQ ID NO: 209049 - DNA, 23 bp, Mus musculus
tctctgtgtctctgtctcaatgt

SEQ ID NO: 209050 - DNA, 22 bp, Mus musculus
cacagaagagactatgcacact

SEQ ID NO: 209051 - DNA, 22 bp, Mus musculus
tatacacatatacatatacata

SEQ ID NO: 209052 - DNA, 18 bp, Mus musculus
tgtgtatgtgtgtatata

SEQ ID NO: 209053 - DNA, 20 bp, Mus musculus
atatgtatatatatatgtgt

SEQ ID NO: 209054 - DNA, 23 bp, Mus musculus
tatgtatatatatatgtgtgtgt

SEQ ID NO: 209055 - DNA, 23 bp, Mus musculus
agggtctctgagtctgaagcttg

SEQ ID NO: 209056 - DNA, 23 bp, Mus musculus
taccacagtgaatgctaagtgag

SEQ ID NO: 209057 - DNA, 23 bp, Mus musculus
gagtgcatgagcaagtgcatgtg

SEQ ID NO: 209058 - DNA, 23 bp, Mus musculus
atatttatgcatataataacatt

SEQ ID NO: 209059 - DNA, 22 bp, Mus musculus
aacattgttattgtttgtgctt

SEQ ID NO: 209060 - DNA, 23 bp, Mus musculus
atttctctctgcaatgcatgcac

SEQ ID NO: 209061 - DNA, 23 bp, Mus musculus
gacgtagcttgattagtagaggg

SEQ ID NO: 209062 - DNA, 23 bp, Mus musculus
ctgagggtctgtctgtgtctggc

SEQ ID NO: 209063 - DNA, 21 bp, Mus musculus
ctgcttctagcttgaatagat

SEQ ID NO: 209064 - DNA, 22 bp, Mus musculus
tgttcctgttctaggctatctg

SEQ ID NO: 209065 - DNA, 23 bp, Mus musculus
agagaagacagacagacagacag

SEQ ID NO: 209066 - DNA, 22 bp, Mus musculus
tgtctctctgggtcttcatttt

SEQ ID NO: 209067 - DNA, 23 bp, Mus musculus
ttcactgttagttcaggaaccgg

SEQ ID NO: 209068 - DNA, 23 bp, Mus musculus
agtactgactgctcttccagagg

SEQ ID NO: 209069 - DNA, 23 bp, Mus musculus
ctctgcctctgtctctgtctccc

SEQ ID NO: 209070 - DNA, 23 bp, Mus musculus
ttcctgtgtcactggctgcctgt

SEQ ID NO: 209071 - DNA, 18 bp, Mus musculus
tgtgtatgtatgtgtgtg

SEQ ID NO: 209072 - DNA, 23 bp, Mus musculus
aacgagtgttgtcagggtgcaca

SEQ ID NO: 209073 - DNA, 20 bp, Mus musculus
ccctcacacattgctggtgg

SEQ ID NO: 209074 - DNA, 23 bp, Mus musculus
agtgtcagagtgtttgtccactg

SEQ ID NO: 209075 - DNA, 23 bp, Mus musculus
ttaagagcactgactgctctttc

SEQ ID NO: 209076 - DNA, 19 bp, Mus musculus
caagtctctctgtgtgtaa

SEQ ID NO: 209077 - DNA, 18 bp, Mus musculus
agagcactgcgtgtgcag

SEQ ID NO: 209078 - DNA, 23 bp, Mus musculus
tgtgagagtagagattaagtact

SEQ ID NO: 209079 - DNA, 23 bp, Mus musculus
ttgtctttgtgcatatgcatgtg

SEQ ID NO: 209080 - DNA, 23 bp, Mus musculus
tactacataaagatagtgctgag

SEQ ID NO: 209081 - DNA, 18 bp, Mus musculus
agttgagatagggactcc

SEQ ID NO: 209082 - DNA, 23 bp, Mus musculus
tgacttcttcctttccaatttgt

SEQ ID NO: 209083 - DNA, 23 bp, Mus musculus
ctctgtgtagtcctggctgtcct

SEQ ID NO: 209084 - DNA, 23 bp, Mus musculus
ataagtcttaggatttatatgga

SEQ ID NO: 209085 - DNA, 23 bp, Mus musculus
gtatgtatatgtatgtgtatatg

SEQ ID NO: 209086 - DNA, 20 bp, Mus musculus
ctgtgcttctgagaggctgt

SEQ ID NO: 209087 - DNA, 20 bp, Mus musculus
gggaagaactgccactgtag

SEQ ID NO: 209088 - DNA, 18 bp, Mus musculus
agagttctgtctgcctgt

SEQ ID NO: 209089 - DNA, 23 bp, Mus musculus
aatgaccataagtttagttgact

SEQ ID NO: 209090 - DNA, 22 bp, Mus musculus
acgtcctttctgtggtgctggt

SEQ ID NO: 209091 - DNA, 21 bp, Mus musculus
taaactgttgactgtgagctc

SEQ ID NO: 209092 - DNA, 22 bp, Mus musculus
agtggttagacagagtctacgt

SEQ ID NO: 209093 - DNA, 23 bp, Mus musculus
tggctgtcctagaactcagtctg

SEQ ID NO: 209094 - DNA, 23 bp, Mus musculus
cctctctgacactctgcagaagt

SEQ ID NO: 209095 - DNA, 23 bp, Mus musculus
tgagctcactgatcactgtgagg

SEQ ID NO: 209096 - DNA, 23 bp, Mus musculus
actcaggcagcttgctactcaga

SEQ ID NO: 209097 - DNA, 22 bp, Mus musculus
aagcccatgaaatttgtgcaga

SEQ ID NO: 209098 - DNA, 20 bp, Mus musculus
tcacacacagcatatgatgt

SEQ ID NO: 209099 - DNA, 19 bp, Mus musculus
aacctttcacagtaaagtc

SEQ ID NO: 209100 - DNA, 23 bp, Mus musculus
gtttggctctctgtctctgtccc

SEQ ID NO: 209101 - DNA, 21 bp, Mus musculus
tgagtatttgtatttctcatg

SEQ ID NO: 209102 - DNA, 20 bp, Mus musculus
tttccctttacaagaacatt

SEQ ID NO: 209103 - DNA, 23 bp, Mus musculus
tgagcaacattttctggctgttt

SEQ ID NO: 209104 - DNA, 23 bp, Mus musculus
acacacacatatatataatgtgt

SEQ ID NO: 209105 - DNA, 23 bp, Mus musculus
gtatgtatgtatgtatgtatgta

SEQ ID NO: 209106 - DNA, 23 bp, Mus musculus
atatgtgtatatatatatgtgtg

SEQ ID NO: 209107 - DNA, 19 bp, Mus musculus
tgtctctttgtgtatgacg

SEQ ID NO: 209108 - DNA, 23 bp, Mus musculus
tgtatatgtgcatgtgcatgtgc

SEQ ID NO: 209109 - DNA, 23 bp, Mus musculus
tatctcagtcactgtgggtgtgc

SEQ ID NO: 209110 - DNA, 23 bp, Mus musculus
gtatgtatgtatgtatatgtgtg

SEQ ID NO: 209111 - DNA, 21 bp, Mus musculus
atatatgtacacacacacaca

SEQ ID NO: 209112 - DNA, 18 bp, Mus musculus
tagattagatatgtaggg

SEQ ID NO: 209113 - DNA, 23 bp, Mus musculus
tgtgtgtgtgtgtgtgtgcatat

SEQ ID NO: 209114 - DNA, 20 bp, Mus musculus
agttcaaatctcagcaacca

SEQ ID NO: 209115 - DNA, 22 bp, Mus musculus
agagagagaagcttgtctcctc

SEQ ID NO: 209116 - DNA, 23 bp, Mus musculus
tctctgtgtcagagaaaccatct

SEQ ID NO: 209117 - DNA, 22 bp, Mus musculus
tgttttgtgaccaattatatgg

SEQ ID NO: 209118 - DNA, 23 bp, Mus musculus
actagtgatggctcttctactag

SEQ ID NO: 209119 - DNA, 22 bp, Mus musculus
aaggaggagatccactggctct

SEQ ID NO: 209120 - DNA, 21 bp, Mus musculus
atacactctgtgtctattctc

SEQ ID NO: 209121 - DNA, 22 bp, Mus musculus
tgggtgtggatgaggatgctgt

SEQ ID NO: 209122 - DNA, 23 bp, Mus musculus
gggctctctctctctggcaccct

SEQ ID NO: 209123 - DNA, 22 bp, Mus musculus
ttccaagttgaccacttggtat

SEQ ID NO: 209124 - DNA, 23 bp, Mus musculus
agtttcaggacagccagaactat

SEQ ID NO: 209125 - DNA, 19 bp, Mus musculus
tttgtccttgatctatagt

SEQ ID NO: 209126 - DNA, 23 bp, Mus musculus
tcagagaccctgagttatgacca

SEQ ID NO: 209127 - DNA, 23 bp, Mus musculus
accttgcttcacactcagactca

SEQ ID NO: 209128 - DNA, 23 bp, Mus musculus
tgtgtctctgcctggctctttgc

SEQ ID NO: 209129 - DNA, 21 bp, Mus musculus
atatgtctgtgtgtatatgta

SEQ ID NO: 209130 - DNA, 23 bp, Mus musculus
tactttgtctgcatgtccatctg

SEQ ID NO: 209131 - DNA, 23 bp, Mus musculus
tgtatgtgcatgtatatgtgtgt

SEQ ID NO: 209132 - DNA, 22 bp, Mus musculus
tgtatgtatatgtatgtgtata

SEQ ID NO: 209133 - DNA, 23 bp, Mus musculus
gtctgcctgcctgcctgcctgcc

SEQ ID NO: 209134 - DNA, 23 bp, Mus musculus
tgcagaatgctatagttttgggt

SEQ ID NO: 209135 - DNA, 22 bp, Mus musculus
ataagtgtatatgtatatgtgt

SEQ ID NO: 209136 - DNA, 22 bp, Mus musculus
taagtgtatatgtatatatgtg

SEQ ID NO: 209137 - DNA, 22 bp, Mus musculus
atatatgcatatgtatacatgt

SEQ ID NO: 209138 - DNA, 18 bp, Mus musculus
acagaggtcggcagtgtg

SEQ ID NO: 209139 - DNA, 23 bp, Mus musculus
aagtgctgacttctctggctgtc

SEQ ID NO: 209140 - DNA, 19 bp, Mus musculus
acagagctgagtgaggtca

SEQ ID NO: 209141 - DNA, 23 bp, Mus musculus
tgtatgtatgtatgtatgtatgt

SEQ ID NO: 209142 - DNA, 18 bp, Mus musculus
tggatttcaattcacact

SEQ ID NO: 209143 - DNA, 23 bp, Mus musculus
tggagctatagacatggggtaga

SEQ ID NO: 209144 - DNA, 23 bp, Mus musculus
gtgaacatagatgtgtgtgtgca

SEQ ID NO: 209145 - DNA, 23 bp, Mus musculus
tcactcagactctgacaggtctg

SEQ ID NO: 209146 - DNA, 19 bp, Mus musculus
tcgtaggctctatggtgag

SEQ ID NO: 209147 - DNA, 23 bp, Mus musculus
acagaactctgcctgtgtctgcc

SEQ ID NO: 209148 - DNA, 23 bp, Mus musculus
ggcgtctctcaggctgtgagact

SEQ ID NO: 209149 - DNA, 19 bp, Mus musculus
tcactgtgatggaaagtct

SEQ ID NO: 209150 - DNA, 23 bp, Mus musculus
aactgactgctcttccagaggac

SEQ ID NO: 209151 - DNA, 18 bp, Mus musculus
tacatggtgtctgtctta

SEQ ID NO: 209152 - DNA, 23 bp, Mus musculus
actgctatgaagagacaccatga

SEQ ID NO: 209153 - DNA, 19 bp, Mus musculus
aaacaagggagagacagag

SEQ ID NO: 209154 - DNA, 23 bp, Mus musculus
gtgggcattctgtgtctgtcact

SEQ ID NO: 209155 - DNA, 18 bp, Mus musculus
cacacacacacactctct

SEQ ID NO: 209156 - DNA, 23 bp, Mus musculus
taatcccacataaagattagtta

SEQ ID NO: 209157 - DNA, 22 bp, Mus musculus
tgttaggtagtggaatggggaa

SEQ ID NO: 209158 - DNA, 23 bp, Mus musculus
aatccttggtcctcagcttgtgg

SEQ ID NO: 209159 - DNA, 21 bp, Mus musculus
tgtatctatgtagaaagtagt

SEQ ID NO: 209160 - DNA, 23 bp, Mus musculus
tgatttgataagtagtatatttc

SEQ ID NO: 209161 - DNA, 22 bp, Mus musculus
atgtgactctatatctctctca

SEQ ID NO: 209162 - DNA, 23 bp, Mus musculus
catcccagagagtacatgtgtgt

SEQ ID NO: 209163 - DNA, 23 bp, Mus musculus
tgtatatatgtgtgtgtgtgtat

SEQ ID NO: 209164 - DNA, 23 bp, Mus musculus
tacatgtacagatgcatattcat

SEQ ID NO: 209165 - DNA, 22 bp, Mus musculus
catgtgtgtatatgtatgtgtg

SEQ ID NO: 209166 - DNA, 20 bp, Mus musculus
tgtgtgtgtgtgtgtgtgtg

SEQ ID NO: 209167 - DNA, 21 bp, Mus musculus
agaatgtgtgtctgtctgtct

SEQ ID NO: 209168 - DNA, 23 bp, Mus musculus
aatattgaagattttcttgtggt

SEQ ID NO: 209169 - DNA, 18 bp, Mus musculus
atctgtatgtgtatatat

SEQ ID NO: 209170 - DNA, 18 bp, Mus musculus
gacagcaacttcatccag

SEQ ID NO: 209171 - DNA, 22 bp, Mus musculus
attcccttttctagatgtttct

SEQ ID NO: 209172 - DNA, 18 bp, Mus musculus
tatgcatgtatgtatgta

SEQ ID NO: 209173 - DNA, 18 bp, Mus musculus
agtggtaatagtttttat

SEQ ID NO: 209174 - DNA, 20 bp, Mus musculus
tgtgcacatacaggtgtgag

SEQ ID NO: 209175 - DNA, 23 bp, Mus musculus
gtgcctgtgtgtgtgcatgtgga

SEQ ID NO: 209176 - DNA, 22 bp, Mus musculus
atgccacaggttcagcagacag

SEQ ID NO: 209177 - DNA, 22 bp, Mus musculus
tgttttgtgaccaattatatgg

SEQ ID NO: 209178 - DNA, 23 bp, Mus musculus
tattgaatcatcttaggattctg

SEQ ID NO: 209179 - DNA, 19 bp, Mus musculus
acacacacacatataatac

SEQ ID NO: 209180 - DNA, 23 bp, Mus musculus
tcccacagtgcctgagtctctga

SEQ ID NO: 209181 - DNA, 23 bp, Mus musculus
ttctgtctgtctgtcagggcgtg

SEQ ID NO: 209182 - DNA, 22 bp, Mus musculus
gagggtgagtctgtggcagtgg

SEQ ID NO: 209183 - DNA, 22 bp, Mus musculus
actggctgcgactgttccctct

SEQ ID NO: 209184 - DNA, 23 bp, Mus musculus
tggcagtgttctccattatctgt

SEQ ID NO: 209185 - DNA, 23 bp, Mus musculus
tgtgtgtgcttgtacatgttcat

SEQ ID NO: 209186 - DNA, 21 bp, Mus musculus
tccatggtggtctgataggat

SEQ ID NO: 209187 - DNA, 22 bp, Mus musculus
tgttttgtgaccaattatatgg

SEQ ID NO: 209188 - DNA, 22 bp, Mus musculus
tgttttgtgaccaattatatgg

SEQ ID NO: 209189 - DNA, 23 bp, Mus musculus
agatgtgactgtggaatggtaac

SEQ ID NO: 209190 - DNA, 22 bp, Mus musculus
aagagttattatacatgtgtgt

SEQ ID NO: 209191 - DNA, 22 bp, Mus musculus
taatagctcactgtcttttctg

SEQ ID NO: 209192 - DNA, 23 bp, Mus musculus
taaactgttgactctgctcattt

SEQ ID NO: 209193 - DNA, 23 bp, Mus musculus
agactatggttttgtagctctaa

SEQ ID NO: 209194 - DNA, 22 bp, Mus musculus
cttatagtcccttctcacaagg

SEQ ID NO: 209195 - DNA, 18 bp, Mus musculus
tggtgtatgtatgcaggt

SEQ ID NO: 209196 - DNA, 22 bp, Mus musculus
tgttttgtgaccaattatatgg

SEQ ID NO: 209197 - DNA, 23 bp, Mus musculus
tatgtgtatgtatatgaatgtat

SEQ ID NO: 209198 - DNA, 22 bp, Mus musculus
atgaatacacacacatacatat

SEQ ID NO: 209199 - DNA, 21 bp, Mus musculus
tgtttctgcaactattaagat

SEQ ID NO: 209200 - DNA, 23 bp, Mus musculus
aattgcttgcattttatatgtat

SEQ ID NO: 209201 - DNA, 23 bp, Mus musculus
cttgagaggctctgtcagtgcct

SEQ ID NO: 209202 - DNA, 23 bp, Mus musculus
acatcttccaccatagtatgaat

SEQ ID NO: 209203 - DNA, 23 bp, Mus musculus
gatgtggaagatggtagtttagt

SEQ ID NO: 209204 - DNA, 22 bp, Mus musculus
aatctaggcacatgttttcatt

SEQ ID NO: 209205 - DNA, 20 bp, Mus musculus
agcatgtatgtttgtatgta

SEQ ID NO: 209206 - DNA, 23 bp, Mus musculus
tatgtacatgtgtaaagtggtgg

SEQ ID NO: 209207 - DNA, 20 bp, Mus musculus
atatgtatgtttatatatgt

SEQ ID NO: 209208 - DNA, 22 bp, Mus musculus
taattagaatgctgtccctgtg

SEQ ID NO: 209209 - DNA, 23 bp, Mus musculus
agcttctttggaatatagtctgg

SEQ ID NO: 209210 - DNA, 23 bp, Mus musculus
tgtgagtctttatctctgtgtga

SEQ ID NO: 209211 - DNA, 23 bp, Mus musculus
tctgtctttatctctctctctct

SEQ ID NO: 209212 - DNA, 19 bp, Mus musculus
ctcacacatatatatgtgt

SEQ ID NO: 209213 - DNA, 23 bp, Mus musculus
tctctgtatctttctgtctcttt

SEQ ID NO: 209214 - DNA, 22 bp, Mus musculus
attctgattatttttcatgagt

SEQ ID NO: 209215 - DNA, 22 bp, Mus musculus
tgttttgtgaccaattatatgg

SEQ ID NO: 209216 - DNA, 23 bp, Mus musculus
tgaaatgttctatagatatctgt

SEQ ID NO: 209217 - DNA, 23 bp, Mus musculus
tttcagacaggaacaattctgag

SEQ ID NO: 209218 - DNA, 21 bp, Mus musculus
tcacttgttgctctgtctttc

SEQ ID NO: 209219 - DNA, 22 bp, Mus musculus
tgttttgtgaccaattatatgg

SEQ ID NO: 209220 - DNA, 18 bp, Mus musculus
atctatctatctatgtat

SEQ ID NO: 209221 - DNA, 23 bp, Mus musculus
tgtacttagaagagtgatatcac

SEQ ID NO: 209222 - DNA, 23 bp, Mus musculus
atgtatgtatgtatgtatatgta

SEQ ID NO: 209223 - DNA, 19 bp, Mus musculus
tacatgttacatattgtac

SEQ ID NO: 209224 - DNA, 18 bp, Mus musculus
tcacacacacacatacat

SEQ ID NO: 209225 - DNA, 23 bp, Mus musculus
tcactgtggctctcactgggcta

SEQ ID NO: 209226 - DNA, 23 bp, Mus musculus
gtgtgtatatgtatatggatgtg

SEQ ID NO: 209227 - DNA, 23 bp, Mus musculus
tgctttgcaaagaagtatgtttt

SEQ ID NO: 209228 - DNA, 23 bp, Mus musculus
ctgtgaaaatcctctttgttttc

SEQ ID NO: 209229 - DNA, 19 bp, Mus musculus
aaaaatgttcacatacctt

SEQ ID NO: 209230 - DNA, 23 bp, Mus musculus
attatgtgtgcatgtatgtatat

SEQ ID NO: 209231 - DNA, 23 bp, Mus musculus
tgtgtgtgcatctatttgtctgt

SEQ ID NO: 209232 - DNA, 22 bp, Mus musculus
gtaatgagaggaatggtgtctg

SEQ ID NO: 209233 - DNA, 21 bp, Mus musculus
tgacaacatcctcctcagcga

SEQ ID NO: 209234 - DNA, 18 bp, Mus musculus
tctctctgggtgtctgac

SEQ ID NO: 209235 - DNA, 20 bp, Mus musculus
agacctcaggctggagagat

SEQ ID NO: 209236 - DNA, 23 bp, Mus musculus
gtctccctgagtcccatattggt

SEQ ID NO: 209237 - DNA, 23 bp, Mus musculus
acagatgataacatctgggacac

SEQ ID NO: 209238 - DNA, 23 bp, Mus musculus
gtatgtgcatatgtaaacatgtg

SEQ ID NO: 209239 - DNA, 23 bp, Mus musculus
atatatgcacatatacatgtaca

SEQ ID NO: 209240 - DNA, 23 bp, Mus musculus
gttgtctgggactagctgtttac

SEQ ID NO: 209241 - DNA, 22 bp, Mus musculus
ttggcagggtttttggttagtt

SEQ ID NO: 209242 - DNA, 23 bp, Mus musculus
tgtgtgactgagtggctgacgaa

SEQ ID NO: 209243 - DNA, 19 bp, Mus musculus
tctcactgccaatcaccag

SEQ ID NO: 209244 - DNA, 23 bp, Mus musculus
tgtctcagcaagtggaagtgctt

SEQ ID NO: 209245 - DNA, 22 bp, Mus musculus
tgactgatgtaggagctggaga

SEQ ID NO: 209246 - DNA, 23 bp, Mus musculus
tcactgtgcaagcaataagtgtg

SEQ ID NO: 209247 - DNA, 23 bp, Mus musculus
ctctcatttagtagctggagtgg

SEQ ID NO: 209248 - DNA, 23 bp, Mus musculus
acagaacactgaatgctgtgtgt

SEQ ID NO: 209249 - DNA, 18 bp, Mus musculus
ccactcatgtctggctgc

SEQ ID NO: 209250 - DNA, 20 bp, Mus musculus
tcatgtgctaggttcatatt

SEQ ID NO: 209251 - DNA, 23 bp, Mus musculus
ctctccctctggctctgatggtg

SEQ ID NO: 209252 - DNA, 20 bp, Mus musculus
tatgtatatgtatatgtatg

SEQ ID NO: 209253 - DNA, 21 bp, Mus musculus
actgatctgtgagtgcagcag

SEQ ID NO: 209254 - DNA, 23 bp, Mus musculus
tgctctatcactctctgtcttat

SEQ ID NO: 209255 - DNA, 20 bp, Mus musculus
aagacctgggtttgatttca

SEQ ID NO: 209256 - DNA, 22 bp, Mus musculus
agagcttgcagagactgtgcga

SEQ ID NO: 209257 - DNA, 21 bp, Mus musculus
tgagagcacagagactgtgag

SEQ ID NO: 209258 - DNA, 23 bp, Mus musculus
atctcaaactccatgtccaagtg

SEQ ID NO: 209259 - DNA, 21 bp, Mus musculus
tctgtctgtctgcatgtgcat

SEQ ID NO: 209260 - DNA, 21 bp, Mus musculus
ttcatgtgatgcatgaatgtg

SEQ ID NO: 209261 - DNA, 23 bp, Mus musculus
gccagaggttgatttgaggaaga

SEQ ID NO: 209262 - DNA, 23 bp, Mus musculus
ttcccagcctctgtgtctgactc

SEQ ID NO: 209263 - DNA, 22 bp, Mus musculus
tcactggcctcagtgtctctga

SEQ ID NO: 209264 - DNA, 23 bp, Mus musculus
atgagtgggtggaaggtggctgt

SEQ ID NO: 209265 - DNA, 23 bp, Mus musculus
aaactggggggtggttttctgtg

SEQ ID NO: 209266 - DNA, 19 bp, Mus musculus
tcactgtcactgttacatg

SEQ ID NO: 209267 - DNA, 23 bp, Mus musculus
tgccactgttactgtctgacttt

SEQ ID NO: 209268 - DNA, 22 bp, Mus musculus
agggtccctctctctctgcctg

SEQ ID NO: 209269 - DNA, 22 bp, Mus musculus
tttcctgtgtgtctccttggct

SEQ ID NO: 209270 - DNA, 21 bp, Mus musculus
aaagtggtttagccttggagc

SEQ ID NO: 209271 - DNA, 18 bp, Mus musculus
cagaggtcctgagttcaa

SEQ ID NO: 209272 - DNA, 20 bp, Mus musculus
ctttgtgaatgatgcagtta

SEQ ID NO: 209273 - DNA, 23 bp, Mus musculus
aagtgtagtgaatttcttgctct

SEQ ID NO: 209274 - DNA, 19 bp, Mus musculus
agtgtgtgcatcccattct

SEQ ID NO: 209275 - DNA, 21 bp, Mus musculus
tgtgcatgtatatatgtgtat

SEQ ID NO: 209276 - DNA, 23 bp, Mus musculus
tccgtttctccttctataaagtg

SEQ ID NO: 209277 - DNA, 23 bp, Mus musculus
tctctgtgtgtgtgtacgtgcat

SEQ ID NO: 209278 - DNA, 23 bp, Mus musculus
gagaggctctgtcagtgcctgac

SEQ ID NO: 209279 - DNA, 23 bp, Mus musculus
gagaggctctgtcagtgcctgac

SEQ ID NO: 209280 - DNA, 20 bp, Mus musculus
tcactcaagattgtcagcag

SEQ ID NO: 209281 - DNA, 23 bp, Mus musculus
atgacacacacacatatatgtgt

SEQ ID NO: 209282 - DNA, 22 bp, Mus musculus
tgttttgtgaccaattatatgg

SEQ ID NO: 209283 - DNA, 22 bp, Mus musculus
tgtgtgtgtgtgtatgtataca

SEQ ID NO: 209284 - DNA, 22 bp, Mus musculus
acatacacacacatatatatgt

SEQ ID NO: 209285 - DNA, 20 bp, Mus musculus
acatacacacacatatacac

SEQ ID NO: 209286 - DNA, 21 bp, Mus musculus
agggtctctcactgagccaga

SEQ ID NO: 209287 - DNA, 23 bp, Mus musculus
tatgtgtatgtatgtgtatgtgt

SEQ ID NO: 209288 - DNA, 23 bp, Mus musculus
gtgtgtgtaaatgtatgtgtgtg

SEQ ID NO: 209289 - DNA, 23 bp, Mus musculus
tatgtgtatgtatgtgtatgtgt

SEQ ID NO: 209290 - DNA, 23 bp, Mus musculus
tgtgtaaatgtatgtgtgtgtgt

SEQ ID NO: 209291 - DNA, 20 bp, Mus musculus
acactgtgaacacaggagga

SEQ ID NO: 209292 - DNA, 23 bp, Mus musculus
tatgtgtctcgtgtatacatgtg

SEQ ID NO: 209293 - DNA, 23 bp, Mus musculus
tgtatgtgagcatgtgtatgctt

SEQ ID NO: 209294 - DNA, 21 bp, Mus musculus
gttactggattctcagcagga

SEQ ID NO: 209295 - DNA, 23 bp, Mus musculus
gcttctgtctctccctcagtggt

SEQ ID NO: 209296 - DNA, 22 bp, Mus musculus
catgagtccaggtaacttatgc

SEQ ID NO: 209297 - DNA, 20 bp, Mus musculus
atgcatacacacaaaagtgc

SEQ ID NO: 209298 - DNA, 19 bp, Mus musculus
gaaagcacagacccagctc

SEQ ID NO: 209299 - DNA, 22 bp, Mus musculus
tcattgaaagcagtcgctctct

SEQ ID NO: 209300 - DNA, 23 bp, Mus musculus
ttaaagaatggcagctaaggatg

SEQ ID NO: 209301 - DNA, 21 bp, Mus musculus
tatgtgcaccttgtacatgca

SEQ ID NO: 209302 - DNA, 23 bp, Mus musculus
agcatgtgagcctccctgaaacc

SEQ ID NO: 209303 - DNA, 23 bp, Mus musculus
gtctgtctgtctgtctgtctgtc

SEQ ID NO: 209304 - DNA, 21 bp, Mus musculus
tttctcagttgtcctagccat

SEQ ID NO: 209305 - DNA, 21 bp, Mus musculus
tcagtgccatatggatgacaa

SEQ ID NO: 209306 - DNA, 23 bp, Mus musculus
cacagactgtgtctctgtgtggc

SEQ ID NO: 209307 - DNA, 20 bp, Mus musculus
atatgtatacatatgtgtat

SEQ ID NO: 209308 - DNA, 23 bp, Mus musculus
tttttttatcgaagtctttggag

SEQ ID NO: 209309 - DNA, 20 bp, Mus musculus
cagtccctcagtcactgtgt

SEQ ID NO: 209310 - DNA, 23 bp, Mus musculus
ctctgtcactgcctcagttttcc

SEQ ID NO: 209311 - DNA, 19 bp, Mus musculus
aatggcagggtctgaacac

SEQ ID NO: 209312 - DNA, 23 bp, Mus musculus
atatatgtgtgcatatgtgtgta

SEQ ID NO: 209313 - DNA, 23 bp, Mus musculus
tatatggatgcatatgtaagtgt

SEQ ID NO: 209314 - DNA, 19 bp, Mus musculus
tgctatgtaaatgatgtca

SEQ ID NO: 209315 - DNA, 23 bp, Mus musculus
agaactcagagtgcacaggtcct

SEQ ID NO: 209316 - DNA, 23 bp, Mus musculus
agaactcagagtgcacaggtcct

SEQ ID NO: 209317 - DNA, 23 bp, Mus musculus
agaactcagagtgcacaggtcct

SEQ ID NO: 209318 - DNA, 22 bp, Mus musculus
agcatggtacttgatgaagctg

SEQ ID NO: 209319 - DNA, 23 bp, Mus musculus
gttttgagcttgtcttggagtga

SEQ ID NO: 209320 - DNA, 20 bp, Mus musculus
aatctcacacagtgagatga

SEQ ID NO: 209321 - DNA, 21 bp, Mus musculus
atgtgtgtttttatatatgta

SEQ ID NO: 209322 - DNA, 20 bp, Mus musculus
tatgtatgtatgtatgtatg

SEQ ID NO: 209323 - DNA, 23 bp, Mus musculus
tgagtctctcccactgcctcagg

SEQ ID NO: 209324 - DNA, 23 bp, Mus musculus
tctgtctgtctcaagggatgaga

SEQ ID NO: 209325 - DNA, 20 bp, Mus musculus
tctcagtgactctctctctc

SEQ ID NO: 209326 - DNA, 22 bp, Mus musculus
tgactgcctgcctgcctgcctg

SEQ ID NO: 209327 - DNA, 22 bp, Mus musculus
ctgattgggcaatctgtctcgg

SEQ ID NO: 209328 - DNA, 21 bp, Mus musculus
tgcttgaagtaattcagctga

SEQ ID NO: 209329 - DNA, 18 bp, Mus musculus
aactctccctggaactga

SEQ ID NO: 209330 - DNA, 23 bp, Mus musculus
tgtatatatgtatgtatacatgt

SEQ ID NO: 209331 - DNA, 22 bp, Mus musculus
attggtatgcatgcatatgtgt

SEQ ID NO: 209332 - DNA, 22 bp, Mus musculus
tatcagactgagatttcacaca

SEQ ID NO: 209333 - DNA, 23 bp, Mus musculus
agagagaagactcagagtggact

SEQ ID NO: 209334 - DNA, 23 bp, Mus musculus
catgtgtatgcatgcatatgtgt

SEQ ID NO: 209335 - DNA, 23 bp, Mus musculus
tgtgtatgtatgtatgtgtctat

SEQ ID NO: 209336 - DNA, 23 bp, Mus musculus
gacacgaagtttgttttttagat

SEQ ID NO: 209337 - DNA, 23 bp, Mus musculus
gactgacacaggagtgagagggc

SEQ ID NO: 209338 - DNA, 23 bp, Mus musculus
gtgtgtgcatttgcatgtgtgtg

SEQ ID NO: 209339 - DNA, 23 bp, Mus musculus
ttagtctgtggtgatctgatagg

SEQ ID NO: 209340 - DNA, 22 bp, Mus musculus
tgttttgtgaccaattatatgg

SEQ ID NO: 209341 - DNA, 20 bp, Mus musculus
tgctgactgctcttccagag

SEQ ID NO: 209342 - DNA, 23 bp, Mus musculus
accacagtgagcacacagcctca

SEQ ID NO: 209343 - DNA, 23 bp, Mus musculus
cttctctgtgcttgttcttggtg

SEQ ID NO: 209344 - DNA, 23 bp, Mus musculus
tcaccttctagcttgtgttgttt

SEQ ID NO: 209345 - DNA, 23 bp, Mus musculus
tgtctgtctgacaggctagctca

SEQ ID NO: 209346 - DNA, 23 bp, Mus musculus
agtgtgtgcatgaggaagtgatc

SEQ ID NO: 209347 - DNA, 19 bp, Mus musculus
agtgatcttttagaatgct

SEQ ID NO: 209348 - DNA, 18 bp, Mus musculus
ttcagtcagagcattgct

SEQ ID NO: 209349 - DNA, 23 bp, Mus musculus
aagagagtcctggatttgtcctc

SEQ ID NO: 209350 - DNA, 23 bp, Mus musculus
ggtctggctgtctctgtcatgca

SEQ ID NO: 209351 - DNA, 23 bp, Mus musculus
tgggtcaggaactcaaagccagt

SEQ ID NO: 209352 - DNA, 22 bp, Mus musculus
ctgggtcactcactcacaggct

SEQ ID NO: 209353 - DNA, 19 bp, Mus musculus
tgagaggagacagtgaaga

SEQ ID NO: 209354 - DNA, 21 bp, Mus musculus
taatggaaagtcagttaggag

SEQ ID NO: 209355 - DNA, 18 bp, Mus musculus
tgactttagtggcagcgg

SEQ ID NO: 209356 - DNA, 23 bp, Mus musculus
tgtatgtctgcctgtctgtttgt

SEQ ID NO: 209357 - DNA, 23 bp, Mus musculus
acacagatggtagaatgttctca

SEQ ID NO: 209358 - DNA, 23 bp, Mus musculus
agacactatattcccagaccttg

SEQ ID NO: 209359 - DNA, 23 bp, Mus musculus
atattgtgtcttcttgagcagag

SEQ ID NO: 209360 - DNA, 23 bp, Mus musculus
taaagagagttcagacaaggaga

SEQ ID NO: 209361 - DNA, 23 bp, Mus musculus
cacactgtccctgtgtctaaggg

SEQ ID NO: 209362 - DNA, 21 bp, Mus musculus
tagacacgaacttagtgtgtg

SEQ ID NO: 209363 - DNA, 23 bp, Mus musculus
tatctgcttctccttctgcagct

SEQ ID NO: 209364 - DNA, 23 bp, Mus musculus
tcggtgtgatgtcatgtgtctga

SEQ ID NO: 209365 - DNA, 23 bp, Mus musculus
ctgtcactcactgagtggccatc

SEQ ID NO: 209366 - DNA, 19 bp, Mus musculus
caagggacttcagaaatgg

SEQ ID NO: 209367 - DNA, 23 bp, Mus musculus
gcatgtatgtctacatgtctgtg

SEQ ID NO: 209368 - DNA, 23 bp, Mus musculus
aatcacagcttactctgtctctc

SEQ ID NO: 209369 - DNA, 23 bp, Mus musculus
acactgggcctatttttactgat

SEQ ID NO: 209370 - DNA, 22 bp, Mus musculus
aggaacaatgcatttgagtgac

SEQ ID NO: 209371 - DNA, 21 bp, Mus musculus
caacgtggttttcatttctat

SEQ ID NO: 209372 - DNA, 20 bp, Mus musculus
tgcagactagtgatgtggca

SEQ ID NO: 209373 - DNA, 20 bp, Mus musculus
tatatatgcatatatataca

SEQ ID NO: 209374 - DNA, 21 bp, Mus musculus
agagagcctctctgtcactca

SEQ ID NO: 209375 - DNA, 23 bp, Mus musculus
agaggtagctagttgtatagata

SEQ ID NO: 209376 - DNA, 22 bp, Mus musculus
ttggaccagacacagcagcaca

SEQ ID NO: 209377 - DNA, 19 bp, Mus musculus
gtcaggtgagactcagcac

SEQ ID NO: 209378 - DNA, 23 bp, Mus musculus
tggctgcctgcctctatgcaatg

SEQ ID NO: 209379 - DNA, 23 bp, Mus musculus
tgtctgtctgtctctgtctggga

SEQ ID NO: 209380 - DNA, 18 bp, Mus musculus
catgaatatatatgtgta

SEQ ID NO: 209381 - DNA, 22 bp, Mus musculus
ttctacatgtatatgcatatat

SEQ ID NO: 209382 - DNA, 23 bp, Mus musculus
tgtttagagaaaatagtgaggac

SEQ ID NO: 209383 - DNA, 23 bp, Mus musculus
tctcacacagaaatcgcacccgt

SEQ ID NO: 209384 - DNA, 21 bp, Mus musculus
tgctgacccctagtccagtgc

SEQ ID NO: 209385 - DNA, 23 bp, Mus musculus
agaacagacacacacaggctgga

SEQ ID NO: 209386 - DNA, 20 bp, Mus musculus
ctaggttgttgtgtttactg

SEQ ID NO: 209387 - DNA, 22 bp, Mus musculus
tgtgagtatgtatgatgtatgt

SEQ ID NO: 209388 - DNA, 23 bp, Mus musculus
tcactctctctgggtgtctggag

SEQ ID NO: 209389 - DNA, 23 bp, Mus musculus
ttcagctcctatatgatgccttt

SEQ ID NO: 209390 - DNA, 20 bp, Mus musculus
tcaccctctgactctgtggc

SEQ ID NO: 209391 - DNA, 23 bp, Mus musculus
tcggatccgtctgagcttggctg

SEQ ID NO: 209392 - DNA, 23 bp, Mus musculus
actccatttgttttgatgatgga

SEQ ID NO: 209393 - DNA, 21 bp, Mus musculus
tcgatcggtcggtcggtcagt

SEQ ID NO: 209394 - DNA, 22 bp, Mus musculus
ggtgctgctgctgctgctgctg

SEQ ID NO: 209395 - DNA, 22 bp, Mus musculus
gcacattacacggtcgacctct

SEQ ID NO: 209396 - DNA, 23 bp, Mus musculus
tctgggtctctgtttctttgatg

SEQ ID NO: 209397 - DNA, 23 bp, Mus musculus
aaacacacccagctaaccttttt

SEQ ID NO: 209398 - DNA, 23 bp, Mus musculus
tgaagagaggttatcctttgtgt

SEQ ID NO: 209399 - DNA, 22 bp, Mus musculus
tatgcaagggcaagctctcttc

SEQ ID NO: 209400 - DNA, 23 bp, Mus musculus
tgtgtgactggttgaccagaggg

SEQ ID NO: 209401 - DNA, 23 bp, Mus musculus
ataggttatccgtgttgccttcg

SEQ ID NO: 209402 - DNA, 23 bp, Mus musculus
tgtgtgcctgcgtgtctgggtgt

SEQ ID NO: 209403 - DNA, 23 bp, Mus musculus
tccagtgacactctctctctgag

SEQ ID NO: 209404 - DNA, 23 bp, Mus musculus
agagtgtgtggcacagatcttgg

SEQ ID NO: 209405 - DNA, 23 bp, Mus musculus
aggtagaaagttgtttagtttgg

SEQ ID NO: 209406 - DNA, 23 bp, Mus musculus
tgcctgcctgcctgcctgcctag

SEQ ID NO: 209407 - DNA, 23 bp, Mus musculus
tcatgtgcatgtgcacgtgcacg

SEQ ID NO: 209408 - DNA, 23 bp, Mus musculus
tctgtctgtctttctgtctgtca

SEQ ID NO: 209409 - DNA, 23 bp, Mus musculus
cgcactctgagtctctggttccc

SEQ ID NO: 209410 - DNA, 20 bp, Mus musculus
aagagcactgactgctcttc

SEQ ID NO: 209411 - DNA, 18 bp, Mus musculus
atatgtgagtatgtgttc

SEQ ID NO: 209412 - DNA, 23 bp, Mus musculus
ttctgtgattgtatttgtgtgat

SEQ ID NO: 209413 - DNA, 23 bp, Mus musculus
actgtgtagctctgactattctg

SEQ ID NO: 209414 - DNA, 23 bp, Mus musculus
tgggtagctctcttctgtgagtg

SEQ ID NO: 209415 - DNA, 23 bp, Mus musculus
tgtgtgtgcatgtccatgtgcat

SEQ ID NO: 209416 - DNA, 23 bp, Mus musculus
tctgtgtctgtctttgtgcccag

SEQ ID NO: 209417 - DNA, 20 bp, Mus musculus
tgtggcaggcagagcggctg

SEQ ID NO: 209418 - DNA, 20 bp, Mus musculus
tcccagtctctctgtgtctc

SEQ ID NO: 209419 - DNA, 23 bp, Mus musculus
tcactttctctctctctctagtt

SEQ ID NO: 209420 - DNA, 23 bp, Mus musculus
gtatctgtgtgtgtgtgtgtgtc

SEQ ID NO: 209421 - DNA, 23 bp, Mus musculus
agctgtgtagaagggtcagtgag

SEQ ID NO: 209422 - DNA, 23 bp, Mus musculus
tgggtccctgtctgcctcattcc

SEQ ID NO: 209423 - DNA, 23 bp, Mus musculus
tgttgacagttgtcactgtgctg

SEQ ID NO: 209424 - DNA, 23 bp, Mus musculus
ctcttgggatggagatggcttgg

SEQ ID NO: 209425 - DNA, 19 bp, Mus musculus
tttctctcagtctgtgtcc

SEQ ID NO: 209426 - DNA, 23 bp, Mus musculus
gtggctcactccctctgtcatct

SEQ ID NO: 209427 - DNA, 23 bp, Mus musculus
tctgtcactgttttctgtttctg

SEQ ID NO: 209428 - DNA, 23 bp, Mus musculus
ggagagagtctctgtgtgtgcct

SEQ ID NO: 209429 - DNA, 23 bp, Mus musculus
tgtgaggttggttgtctgggagg

SEQ ID NO: 209430 - DNA, 20 bp, Mus musculus
aacctgagttctgtctctga

SEQ ID NO: 209431 - DNA, 23 bp, Mus musculus
gtcacagaacagttttacatgtc

SEQ ID NO: 209432 - DNA, 23 bp, Mus musculus
tcttgacagttcaacagttctgt

SEQ ID NO: 209433 - DNA, 23 bp, Mus musculus
tgtgaaatgtttaggaccactag

SEQ ID NO: 209434 - DNA, 23 bp, Mus musculus
tgtgtgcatgtatgtgtgcatgt

SEQ ID NO: 209435 - DNA, 21 bp, Mus musculus
atgtatgtatgcatgtgcatg

SEQ ID NO: 209436 - DNA, 20 bp, Mus musculus
tatgtgcatgtatgtatgta

SEQ ID NO: 209437 - DNA, 23 bp, Mus musculus
ttcctctgtgtctgtgtcagtgc

SEQ ID NO: 209438 - DNA, 23 bp, Mus musculus
tctctctgtccctgagtacctgg

SEQ ID NO: 209439 - DNA, 21 bp, Mus musculus
acagactctttctgtgtcacg

SEQ ID NO: 209440 - DNA, 23 bp, Mus musculus
tgtatatatgtgtatgtatatgt

SEQ ID NO: 209441 - DNA, 23 bp, Mus musculus
ctcagtctgtcaccctcaccagt

SEQ ID NO: 209442 - DNA, 23 bp, Mus musculus
cctgtctgtgtggtttgatgttg

SEQ ID NO: 209443 - DNA, 23 bp, Mus musculus
acttctgtgtggctgcctgactc

SEQ ID NO: 209444 - DNA, 23 bp, Mus musculus
atgtgtgtatgcatgtggtctgt

SEQ ID NO: 209445 - DNA, 22 bp, Mus musculus
atgtatgtatgcatgtatatgt

SEQ ID NO: 209446 - DNA, 23 bp, Mus musculus
atatatgtatatgtatatgtgtg

SEQ ID NO: 209447 - DNA, 22 bp, Mus musculus
tggttcagtctgttgtctgggc

SEQ ID NO: 209448 - DNA, 23 bp, Mus musculus
catagagtgctcagagtgcagtt

SEQ ID NO: 209449 - DNA, 23 bp, Mus musculus
ggccctctgagtgtctctctagg

SEQ ID NO: 209450 - DNA, 23 bp, Mus musculus
atcacttgagattttgatcttaa

SEQ ID NO: 209451 - DNA, 23 bp, Mus musculus
tataatctcagagtgttttgatt

SEQ ID NO: 209452 - DNA, 18 bp, Mus musculus
tctctctctctaacatca

SEQ ID NO: 209453 - DNA, 23 bp, Mus musculus
agttgagtttttcatggtttctg

SEQ ID NO: 209454 - DNA, 20 bp, Mus musculus
tcagtccctctgacagaggc

SEQ ID NO: 209455 - DNA, 23 bp, Mus musculus
ttcctgtcagaagtgggagggta

SEQ ID NO: 209456 - DNA, 23 bp, Mus musculus
tgatgggagttgtttccttaatc

SEQ ID NO: 209457 - DNA, 22 bp, Mus musculus
tgttttgtgaccaattatatgg

SEQ ID NO: 209458 - DNA, 22 bp, Mus musculus
tgttttgtgaccaattatatgg

SEQ ID NO: 209459 - DNA, 23 bp, Mus musculus
tgagaggctctgtcagtgcctga

SEQ ID NO: 209460 - DNA, 22 bp, Mus musculus
tgtgaccatttgattctttatt

SEQ ID NO: 209461 - DNA, 22 bp, Mus musculus
attctgacagagaattttggga

SEQ ID NO: 209462 - DNA, 22 bp, Mus musculus
gtccgtggtgatcagataggat

SEQ ID NO: 209463 - DNA, 23 bp, Mus musculus
tgttttgtgaccgagtatatggt

SEQ ID NO: 209464 - DNA, 23 bp, Mus musculus
attggtactattataaggtgtgt

SEQ ID NO: 209465 - DNA, 23 bp, Mus musculus
gtgtctcacactgtgtgtggtat

SEQ ID NO: 209466 - DNA, 23 bp, Mus musculus
ttaagactgaagactgtgtgctc

SEQ ID NO: 209467 - DNA, 18 bp, Mus musculus
gcagaatcttgtgtttcc

SEQ ID NO: 209468 - DNA, 22 bp, Mus musculus
aaattattgaagtggtccttgg

SEQ ID NO: 209469 - DNA, 23 bp, Mus musculus
tagtccttggtgatctgatagga

SEQ ID NO: 209470 - DNA, 23 bp, Mus musculus
catgtttgaaactctctgtcatt

SEQ ID NO: 209471 - DNA, 23 bp, Mus musculus
aggatgtgtctgaagtcagtgtg

SEQ ID NO: 209472 - DNA, 19 bp, Mus musculus
ccttgaacttctcattgta

SEQ ID NO: 209473 - DNA, 23 bp, Mus musculus
tagtccttggtgatctgatagga

SEQ ID NO: 209474 - DNA, 22 bp, Mus musculus
tgttttgtgaccaattatatgg

SEQ ID NO: 209475 - DNA, 22 bp, Mus musculus
aggctgtgtcaatgtactgtag

SEQ ID NO: 209476 - DNA, 23 bp, Mus musculus
gtatgtgacagaaacttcagtgt

SEQ ID NO: 209477 - DNA, 20 bp, Mus musculus
tctcagacactctgtccgtg

SEQ ID NO: 209478 - DNA, 19 bp, Mus musculus
taagactgtgttatgagaa

SEQ ID NO: 209479 - DNA, 23 bp, Mus musculus
tatcagtcagggtttgtctgtga

SEQ ID NO: 209480 - DNA, 23 bp, Mus musculus
actagtttcctttgttgactgaa

SEQ ID NO: 209481 - DNA, 23 bp, Mus musculus
tgatgtcctagctagttttatgt

SEQ ID NO: 209482 - DNA, 20 bp, Mus musculus
ttgacacaagctagagtcca

SEQ ID NO: 209483 - DNA, 23 bp, Mus musculus
agagaagctgctagaaagtcctt

SEQ ID NO: 209484 - DNA, 23 bp, Mus musculus
ctctgtgtggctctgtctctgag

SEQ ID NO: 209485 - DNA, 22 bp, Mus musculus
tgttctttctgcctcagttcac

SEQ ID NO: 209486 - DNA, 22 bp, Mus musculus
tgttttgtgaccaattatatgg

SEQ ID NO: 209487 - DNA, 22 bp, Mus musculus
tcgcactctctgctgctgcctg

SEQ ID NO: 209488 - DNA, 18 bp, Mus musculus
tctagaacgacctatgcg

SEQ ID NO: 209489 - DNA, 18 bp, Mus musculus
tcagtgctagagtgttgt

SEQ ID NO: 209490 - DNA, 23 bp, Mus musculus
acaacctgcttgagtgtctgact

SEQ ID NO: 209491 - DNA, 20 bp, Mus musculus
cagggtctgtcagacactct

SEQ ID NO: 209492 - DNA, 19 bp, Mus musculus
tgtgtgtgtgtgtgtgtgt

SEQ ID NO: 209493 - DNA, 18 bp, Mus musculus
cttatgttttatgagtgt

SEQ ID NO: 209494 - DNA, 23 bp, Mus musculus
tttctcagtgaggttaagcacac

SEQ ID NO: 209495 - DNA, 23 bp, Mus musculus
gcccctgtctctgtctctgtctt

SEQ ID NO: 209496 - DNA, 23 bp, Mus musculus
ttgcatagtcacaaaagtgatca

SEQ ID NO: 209497 - DNA, 19 bp, Mus musculus
acacagaagcgagtgtgca

SEQ ID NO: 209498 - DNA, 20 bp, Mus musculus
ttttgtgcaaggatctgctg

SEQ ID NO: 209499 - DNA, 22 bp, Mus musculus
gtgtgcacacatgtgtgtgcct

SEQ ID NO: 209500 - DNA, 18 bp, Mus musculus
acatgtatgcatgtatac

SEQ ID NO: 209501 - DNA, 22 bp, Mus musculus
acatgtgtatgtatctgtatgt

SEQ ID NO: 209502 - DNA, 23 bp, Mus musculus
aacagtcagaacactgtgtccac

SEQ ID NO: 209503 - DNA, 21 bp, Mus musculus
tcactctgagctggtaaataa

SEQ ID NO: 209504 - DNA, 23 bp, Mus musculus
agcctgtctctctgagtgcctca

SEQ ID NO: 209505 - DNA, 23 bp, Mus musculus
tagaggcagttgcttgtaaagat

SEQ ID NO: 209506 - DNA, 23 bp, Mus musculus
ttaaagcatgtttacagggaata

SEQ ID NO: 209507 - DNA, 23 bp, Mus musculus
caaagagtgtgagttttagatct

SEQ ID NO: 209508 - DNA, 22 bp, Mus musculus
aacttgagctgccagtcatcca

SEQ ID NO: 209509 - DNA, 22 bp, Mus musculus
atgtgtgtatataggtatgtgt

SEQ ID NO: 209510 - DNA, 23 bp, Mus musculus
tatgtatgcatgtatatatgtat

SEQ ID NO: 209511 - DNA, 22 bp, Mus musculus
taatctctgtggcttccttgac

SEQ ID NO: 209512 - DNA, 23 bp, Mus musculus
tgactgtctctccttagtctttg

SEQ ID NO: 209513 - DNA, 22 bp, Mus musculus
taggtcatctgtaagttccaca

SEQ ID NO: 209514 - DNA, 23 bp, Mus musculus
tagattgatacagtcattgtgga

SEQ ID NO: 209515 - DNA, 23 bp, Mus musculus
tatgcatatatatgcatatatga

SEQ ID NO: 209516 - DNA, 23 bp, Mus musculus
catatgtatatatgtatatatgt

SEQ ID NO: 209517 - DNA, 23 bp, Mus musculus
atgtgtatatatgtatatgtgta

SEQ ID NO: 209518 - DNA, 23 bp, Mus musculus
tgtgtgtatatatgtatatgtgt

SEQ ID NO: 209519 - DNA, 22 bp, Mus musculus
tgttttgtgaccaattatatgg

SEQ ID NO: 209520 - DNA, 19 bp, Mus musculus
tcactctctgccttcttcc

SEQ ID NO: 209521 - DNA, 19 bp, Mus musculus
actctatgatatgtgtata

SEQ ID NO: 209522 - DNA, 21 bp, Mus musculus
gtatgtatacatgtatgtatg

SEQ ID NO: 209523 - DNA, 23 bp, Mus musculus
tcagagtctctgtctctctactt

SEQ ID NO: 209524 - DNA, 23 bp, Mus musculus
aagagcactgactgctcttccag

SEQ ID NO: 209525 - DNA, 23 bp, Mus musculus
acaactgctgtaactcctgttcc

SEQ ID NO: 209526 - DNA, 23 bp, Mus musculus
actgcctgcctgcctgtctgtct

SEQ ID NO: 209527 - DNA, 22 bp, Mus musculus
aggtagtacatgccttagaata

SEQ ID NO: 209528 - DNA, 23 bp, Mus musculus
gtctgtctctctctctcataggc

SEQ ID NO: 209529 - DNA, 23 bp, Mus musculus
tagtccatggtgatctgatagga

SEQ ID NO: 209530 - DNA, 22 bp, Mus musculus
tgttttgtgaccaattatatgg

SEQ ID NO: 209531 - DNA, 20 bp, Mus musculus
atcaagtggccatagttgtg

SEQ ID NO: 209532 - DNA, 22 bp, Mus musculus
tcacttctattccattggtcta

SEQ ID NO: 209533 - DNA, 23 bp, Mus musculus
tagtctgtggtaatctgatagaa

SEQ ID NO: 209534 - DNA, 23 bp, Mus musculus
caatatttttgtatctgttgagg

SEQ ID NO: 209535 - DNA, 23 bp, Mus musculus
atgtatatgtacatgatgtatat

SEQ ID NO: 209536 - DNA, 21 bp, Mus musculus
tatgcttctatgtatatgtat

SEQ ID NO: 209537 - DNA, 22 bp, Mus musculus
agccatcttggttctgagactc

SEQ ID NO: 209538 - DNA, 23 bp, Mus musculus
tgcacagatgagagtgtggacta

SEQ ID NO: 209539 - DNA, 23 bp, Mus musculus
aggccatggtggtctgataggat

SEQ ID NO: 209540 - DNA, 23 bp, Mus musculus
agtccatggtggtctgataggat

SEQ ID NO: 209541 - DNA, 23 bp, Mus musculus
agtccatggtggtctgataggat

SEQ ID NO: 209542 - DNA, 22 bp, Mus musculus
gatggaaccatgagtaacagaa

SEQ ID NO: 209543 - DNA, 23 bp, Mus musculus
tctgtcactcactgtgtcaactg

SEQ ID NO: 209544 - DNA, 23 bp, Mus musculus
cctaggtggttctattgttctgt

SEQ ID NO: 209545 - DNA, 19 bp, Mus musculus
atatatttgtgtatatcta

SEQ ID NO: 209546 - DNA, 20 bp, Mus musculus
tggtatatacatgctataca

SEQ ID NO: 209547 - DNA, 18 bp, Mus musculus
gaaatcatacagatgtcg

SEQ ID NO: 209548 - DNA, 23 bp, Mus musculus
ttagagaatgaacatctgggtga

SEQ ID NO: 209549 - DNA, 20 bp, Mus musculus
actgtgtagacagtcagcaa

SEQ ID NO: 209550 - DNA, 23 bp, Mus musculus
cagctgctcactctgtgtgtgtg

SEQ ID NO: 209551 - DNA, 22 bp, Mus musculus
gtatgtatatgtatgtgtatgt

SEQ ID NO: 209552 - DNA, 22 bp, Mus musculus
tggttgagccactctgtctact

SEQ ID NO: 209553 - DNA, 18 bp, Mus musculus
acagaagagagtgagaag

SEQ ID NO: 209554 - DNA, 18 bp, Mus musculus
ctgtgtctgtgtctgctt

SEQ ID NO: 209555 - DNA, 22 bp, Mus musculus
tagtctcttcatttttaagtgg

SEQ ID NO: 209556 - DNA, 22 bp, Mus musculus
taagcttagaattgtaccaggc

SEQ ID NO: 209557 - DNA, 23 bp, Mus musculus
caccactggttttgtttcctata

SEQ ID NO: 209558 - DNA, 23 bp, Mus musculus
tatgagtccatttgtgatgtttg

SEQ ID NO: 209559 - DNA, 20 bp, Mus musculus
aggtgttaagaaattgtgtt

SEQ ID NO: 209560 - DNA, 23 bp, Mus musculus
tatgtgactctgacttttttgcc

SEQ ID NO: 209561 - DNA, 22 bp, Mus musculus
tgtagccttcagaggcaggtga

SEQ ID NO: 209562 - DNA, 23 bp, Mus musculus
tctgtctgtctgtctgtctgtgt

SEQ ID NO: 209563 - DNA, 18 bp, Mus musculus
gtatatatacatgtgtgt

SEQ ID NO: 209564 - DNA, 18 bp, Mus musculus
tatatgtatgtatatgaa

SEQ ID NO: 209565 - DNA, 21 bp, Mus musculus
tgtatatatgtacatgtatgt

SEQ ID NO: 209566 - DNA, 23 bp, Mus musculus
aaagctcaagatcactatctctc

SEQ ID NO: 209567 - DNA, 23 bp, Mus musculus
tctctctctctcactgagaccca

SEQ ID NO: 209568 - DNA, 23 bp, Mus musculus
agacaccagctccatgttcagaa

SEQ ID NO: 209569 - DNA, 20 bp, Mus musculus
agagagaagagcctgaccag

SEQ ID NO: 209570 - DNA, 18 bp, Mus musculus
tgagagcctgcatggtct

SEQ ID NO: 209571 - DNA, 21 bp, Mus musculus
ttgagcaactaactcatggtc

SEQ ID NO: 209572 - DNA, 23 bp, Mus musculus
tatatatgatgtggatgtgtgta

SEQ ID NO: 209573 - DNA, 19 bp, Mus musculus
tacatggacgacacaacct

SEQ ID NO: 209574 - DNA, 20 bp, Mus musculus
agtgtatgtgtgtgtgtgtg

SEQ ID NO: 209575 - DNA, 23 bp, Mus musculus
tatacatagtatatgtatatgta

SEQ ID NO: 209576 - DNA, 20 bp, Mus musculus
acatatgtatatgtatatgt

SEQ ID NO: 209577 - DNA, 19 bp, Mus musculus
atacatatatgtatgctgt

SEQ ID NO: 209578 - DNA, 22 bp, Mus musculus
tgttttgtgaccaattatatgg

SEQ ID NO: 209579 - DNA, 22 bp, Mus musculus
ctctgactcagaagcttgttgg

SEQ ID NO: 209580 - DNA, 23 bp, Mus musculus
tagagctgggaaaagattgcgaa

SEQ ID NO: 209581 - DNA, 23 bp, Mus musculus
agatagggagtgcattgtaaaac

SEQ ID NO: 209582 - DNA, 23 bp, Mus musculus
atccatgttgctgttaatatgag

SEQ ID NO: 209583 - DNA, 23 bp, Mus musculus
agagatgaaagaagatcgtgaag

SEQ ID NO: 209584 - DNA, 22 bp, Mus musculus
tgttttgtgaccaattatatgg

SEQ ID NO: 209585 - DNA, 22 bp, Mus musculus
tgttttgtgaccaattatatgg

SEQ ID NO: 209586 - DNA, 21 bp, Mus musculus
tgaggtacatttcctatgtgt

SEQ ID NO: 209587 - DNA, 21 bp, Mus musculus
ttattgaggaaatgattccat

SEQ ID NO: 209588 - DNA, 23 bp, Mus musculus
tgacatagatggttctattgttc

SEQ ID NO: 209589 - DNA, 23 bp, Mus musculus
ttgacaggagcctagtatggctg

SEQ ID NO: 209590 - DNA, 21 bp, Mus musculus
ccatcacagactctgtctctc

SEQ ID NO: 209591 - DNA, 18 bp, Mus musculus
atgatggtctgataggat

SEQ ID NO: 209592 - DNA, 22 bp, Mus musculus
tgttttgtgaccaattatatgg

SEQ ID NO: 209593 - DNA, 22 bp, Mus musculus
ccagtccacatgctctgtgtga

SEQ ID NO: 209594 - DNA, 18 bp, Mus musculus
agtggatctgaaagacag

SEQ ID NO: 209595 - DNA, 23 bp, Mus musculus
tgaatctcacactctgtcttccc

SEQ ID NO: 209596 - DNA, 23 bp, Mus musculus
tctgtgtgtgtgtgtgccacagg

SEQ ID NO: 209597 - DNA, 21 bp, Mus musculus
gtatgtgtctgtgtgtgtgtg

SEQ ID NO: 209598 - DNA, 21 bp, Mus musculus
gagggtctgtcagtctgtggc

SEQ ID NO: 209599 - DNA, 18 bp, Mus musculus
acatgtatgtatgcacat

SEQ ID NO: 209600 - DNA, 23 bp, Mus musculus
actaccacggatagagttagaac

SEQ ID NO: 209601 - DNA, 22 bp, Mus musculus
acagtgctgagtgaggacagtc

SEQ ID NO: 209602 - DNA, 18 bp, Mus musculus
ttgagccatctctccagc

SEQ ID NO: 209603 - DNA, 20 bp, Mus musculus
cagtgacacattgctctgtg

SEQ ID NO: 209604 - DNA, 23 bp, Mus musculus
gctgactgccagcctctcagcct

SEQ ID NO: 209605 - DNA, 20 bp, Mus musculus
gcttgcacttgtgcctgcct

SEQ ID NO: 209606 - DNA, 20 bp, Mus musculus
tatgtgtgtatgtatatgtg

SEQ ID NO: 209607 - DNA, 19 bp, Mus musculus
aacagcatatacatataca

SEQ ID NO: 209608 - DNA, 20 bp, Mus musculus
atatgtatgtatatatgtgt

SEQ ID NO: 209609 - DNA, 22 bp, Mus musculus
tatatgtggctatgcaatctgt

SEQ ID NO: 209610 - DNA, 21 bp, Mus musculus
ttctgaagatgggtctgtcag

SEQ ID NO: 209611 - DNA, 21 bp, Mus musculus
agtcacgttggtcagactgta

SEQ ID NO: 209612 - DNA, 21 bp, Mus musculus
cattgctctcaagtctggctc

SEQ ID NO: 209613 - DNA, 20 bp, Mus musculus
atatgcatatagtgtgtgta

SEQ ID NO: 209614 - DNA, 20 bp, Mus musculus
atatgtataatatatatgca

SEQ ID NO: 209615 - DNA, 23 bp, Mus musculus
gcagtgtctgtgcgtctctgcca

SEQ ID NO: 209616 - DNA, 20 bp, Mus musculus
ctctgtcactctgtcaccgt

SEQ ID NO: 209617 - DNA, 23 bp, Mus musculus
gcatgtgtgtgtgcatgtgcatg

SEQ ID NO: 209618 - DNA, 20 bp, Mus musculus
tgctctatgctagccctgtg

SEQ ID NO: 209619 - DNA, 20 bp, Mus musculus
atgtctctacaggatcagaa

SEQ ID NO: 209620 - DNA, 23 bp, Mus musculus
tgtctgtctgtctgtctcagatg

SEQ ID NO: 209621 - DNA, 23 bp, Mus musculus
acctctgtgagcctctgagtctc

SEQ ID NO: 209622 - DNA, 23 bp, Mus musculus
cctcgctctcactgacactgccc

SEQ ID NO: 209623 - DNA, 23 bp, Mus musculus
agacagactggagagtgtgcaga

SEQ ID NO: 209624 - DNA, 23 bp, Mus musculus
tggagcacccagtcctaagtggg

SEQ ID NO: 209625 - DNA, 23 bp, Mus musculus
tgtgcgtgtgtctgtccgtgtgt

SEQ ID NO: 209626 - DNA, 21 bp, Mus musculus
tggctccatctctgcagggtt

SEQ ID NO: 209627 - DNA, 23 bp, Mus musculus
gcttctctgtgtctctctcagtg

SEQ ID NO: 209628 - DNA, 23 bp, Mus musculus
atgaacagctgtaggtagatggt

SEQ ID NO: 209629 - DNA, 19 bp, Mus musculus
acacacatacattatgtat

SEQ ID NO: 209630 - DNA, 23 bp, Mus musculus
caatgtttctcaacctgtgggtc

SEQ ID NO: 209631 - DNA, 23 bp, Mus musculus
agactccctcgctcactgctttg

SEQ ID NO: 209632 - DNA, 23 bp, Mus musculus
gtatatgatatacacatgtatgt

SEQ ID NO: 209633 - DNA, 23 bp, Mus musculus
gtatatgattatgtatatgtatg

SEQ ID NO: 209634 - DNA, 18 bp, Mus musculus
agcgtcaggttggatatg

SEQ ID NO: 209635 - DNA, 18 bp, Mus musculus
tgactacagccaggagtg

SEQ ID NO: 209636 - DNA, 23 bp, Mus musculus
tcagctcacactctctgtgcgtg

SEQ ID NO: 209637 - DNA, 23 bp, Mus musculus
gactcactgcgtgcctctatgag

SEQ ID NO: 209638 - DNA, 23 bp, Mus musculus
tctcagcctgcctgtgtgtctgc

SEQ ID NO: 209639 - DNA, 23 bp, Mus musculus
aggaggacctacacataccaact

SEQ ID NO: 209640 - DNA, 23 bp, Mus musculus
gctgcctcactgagtgtctctga

SEQ ID NO: 209641 - DNA, 23 bp, Mus musculus
gctcagtggctgagtgcttgcct

SEQ ID NO: 209642 - DNA, 19 bp, Mus musculus
tgtcactgtgtcactccct

SEQ ID NO: 209643 - DNA, 23 bp, Mus musculus
caggggtctgtctgtctgtgtag

SEQ ID NO: 209644 - DNA, 23 bp, Mus musculus
tcacgctgagtctctgtgtgtcc

SEQ ID NO: 209645 - DNA, 20 bp, Mus musculus
tgtcagatgtgagtgagcgc

SEQ ID NO: 209646 - DNA, 19 bp, Mus musculus
ggggtctctctctctctct

SEQ ID NO: 209647 - DNA, 19 bp, Mus musculus
gccccactctctgactctg

SEQ ID NO: 209648 - DNA, 21 bp, Mus musculus
agtaacagtggtcaggctgcc

SEQ ID NO: 209649 - DNA, 23 bp, Mus musculus
tgtcagcctgtgtctctcctggt

SEQ ID NO: 209650 - DNA, 23 bp, Mus musculus
acttagggtctgtctgtctcaca

SEQ ID NO: 209651 - DNA, 23 bp, Mus musculus
agtctggctcactgattccctgc

SEQ ID NO: 209652 - DNA, 19 bp, Mus musculus
tgtatgtgtggtttgcatg

SEQ ID NO: 209653 - DNA, 21 bp, Mus musculus
atgtatatatatatgtgtgtg

SEQ ID NO: 209654 - DNA, 23 bp, Mus musculus
tgtgtgtgtgcatgtgtatgtgc

SEQ ID NO: 209655 - DNA, 23 bp, Mus musculus
tctggagtagtttggtgttagaa

SEQ ID NO: 209656 - DNA, 19 bp, Mus musculus
taaaggaagactattccta

SEQ ID NO: 209657 - DNA, 23 bp, Mus musculus
tctctcactgagcaaatgacctc

SEQ ID NO: 209658 - DNA, 22 bp, Mus musculus
tctcacccaacactgagtctct

SEQ ID NO: 209659 - DNA, 23 bp, Mus musculus
actctgggagggtctcttgggtc

SEQ ID NO: 209660 - DNA, 18 bp, Mus musculus
aaattctcagctactcct

SEQ ID NO: 209661 - DNA, 22 bp, Mus musculus
tgttttgtgaccaattatatgg

SEQ ID NO: 209662 - DNA, 23 bp, Mus musculus
tctctgcacatcttctagttgtg

SEQ ID NO: 209663 - DNA, 23 bp, Mus musculus
tgtctgtctgtccgtctctgtcg

SEQ ID NO: 209664 - DNA, 21 bp, Mus musculus
tgtgggtcggtctcgggagtc

SEQ ID NO: 209665 - DNA, 23 bp, Mus musculus
acactctctcgctgagtctccag

SEQ ID NO: 209666 - DNA, 20 bp, Mus musculus
tatacatatatatgcatatg

SEQ ID NO: 209667 - DNA, 23 bp, Mus musculus
tgtgtgtgtatttgcatgtgcat

SEQ ID NO: 209668 - DNA, 23 bp, Mus musculus
agactgggtgagtctctctctgt

SEQ ID NO: 209669 - DNA, 23 bp, Mus musculus
taagagcactgactgctcttcca

SEQ ID NO: 209670 - DNA, 23 bp, Mus musculus
catgggtgcctgtctgcctgttt

SEQ ID NO: 209671 - DNA, 19 bp, Mus musculus
acagtcaaactcactctct

SEQ ID NO: 209672 - DNA, 23 bp, Mus musculus
tcacacagaggcttttctgtgca

SEQ ID NO: 209673 - DNA, 20 bp, Mus musculus
atgtatgtgtgcatacatgt

SEQ ID NO: 209674 - DNA, 23 bp, Mus musculus
gccagtctcactgcctctctgac

SEQ ID NO: 209675 - DNA, 23 bp, Mus musculus
agcccagatctacgttctgagct

SEQ ID NO: 209676 - DNA, 23 bp, Mus musculus
aacaggagagattgagttgtggt

SEQ ID NO: 209677 - DNA, 21 bp, Mus musculus
tatatgtatatgtatatgtat

SEQ ID NO: 209678 - DNA, 23 bp, Mus musculus
tctctctgtgtggtatgcatgtg

SEQ ID NO: 209679 - DNA, 23 bp, Mus musculus
tgactctgtcacttgtttgcacc

SEQ ID NO: 209680 - DNA, 23 bp, Mus musculus
tgaagtagctgtttttgtagttc

SEQ ID NO: 209681 - DNA, 23 bp, Mus musculus
tgtatacatgtatgtgtgtgaga

SEQ ID NO: 209682 - DNA, 23 bp, Mus musculus
tctgtgaatgatgtacatgtgta

SEQ ID NO: 209683 - DNA, 22 bp, Mus musculus
tctgtgcttgatgtttaagtgt

SEQ ID NO: 209684 - DNA, 22 bp, Mus musculus
acagacagaagacagaagccac

SEQ ID NO: 209685 - DNA, 23 bp, Mus musculus
aaaaggtcttttgtaacctgtat

SEQ ID NO: 209686 - DNA, 21 bp, Mus musculus
tgcagaagatatgggtttggt

SEQ ID NO: 209687 - DNA, 22 bp, Mus musculus
acacagtgcctcacaatcatct

SEQ ID NO: 209688 - DNA, 23 bp, Mus musculus
tgtccctctgtgtctgttcctca

SEQ ID NO: 209689 - DNA, 21 bp, Mus musculus
ttttaagtatttgtctatgtg

SEQ ID NO: 209690 - DNA, 23 bp, Mus musculus
gggtcccactgtggctctgtcta

SEQ ID NO: 209691 - DNA, 23 bp, Mus musculus
ggtcactgtgtgaatagtgtgtg

SEQ ID NO: 209692 - DNA, 23 bp, Mus musculus
tgagctcactgtcactctcagag

SEQ ID NO: 209693 - DNA, 23 bp, Mus musculus
tattgtgtatatgtatatgtgtg

SEQ ID NO: 209694 - DNA, 20 bp, Mus musculus
tgtgtatatatatatgtatg

SEQ ID NO: 209695 - DNA, 19 bp, Mus musculus
ccctgtgtacacacataga

SEQ ID NO: 209696 - DNA, 23 bp, Mus musculus
tatacacagggagatatatgtat

SEQ ID NO: 209697 - DNA, 20 bp, Mus musculus
acacattttctctgtctgtc

SEQ ID NO: 209698 - DNA, 23 bp, Mus musculus
tgtgtgtatctgcatgtatatgt

SEQ ID NO: 209699 - DNA, 18 bp, Mus musculus
aggttggagaacttatgg

SEQ ID NO: 209700 - DNA, 23 bp, Mus musculus
tatactgaggagcaggaagccac

SEQ ID NO: 209701 - DNA, 22 bp, Mus musculus
tctctctctctctctctggaac

SEQ ID NO: 209702 - DNA, 23 bp, Mus musculus
ccactcactctgtctcaaggtct

SEQ ID NO: 209703 - DNA, 18 bp, Mus musculus
tcagagtcaaccccagcc

SEQ ID NO: 209704 - DNA, 19 bp, Mus musculus
gactttagactccaagagc

SEQ ID NO: 209705 - DNA, 22 bp, Mus musculus
ccagacagaagaaggtgaggag

SEQ ID NO: 209706 - DNA, 19 bp, Mus musculus
gatgacacatctttccttt

SEQ ID NO: 209707 - DNA, 23 bp, Mus musculus
tctctgtctctctgtcccttgta

SEQ ID NO: 209708 - DNA, 23 bp, Mus musculus
tctgtgtgtgcatatgcatgtac

SEQ ID NO: 209709 - DNA, 23 bp, Mus musculus
tgcactctgagtcagaagtgact

SEQ ID NO: 209710 - DNA, 23 bp, Mus musculus
gagttcttctaactctccaggga

SEQ ID NO: 209711 - DNA, 23 bp, Mus musculus
tatttgtgcatacatatatgtgt

SEQ ID NO: 209712 - DNA, 23 bp, Mus musculus
gtgtgtgtgtgagtatgtgcgtg

SEQ ID NO: 209713 - DNA, 20 bp, Mus musculus
gaagtgtgtcactggggttg

SEQ ID NO: 209714 - DNA, 21 bp, Mus musculus
tatgtgtgtgtgcatgtgtgt

SEQ ID NO: 209715 - DNA, 23 bp, Mus musculus
atctgtgtctctgtttcaggtta

SEQ ID NO: 209716 - DNA, 20 bp, Mus musculus
ataggctgatgtatgtcctt

SEQ ID NO: 209717 - DNA, 23 bp, Mus musculus
aagcactgactgctcttccagag

SEQ ID NO: 209718 - DNA, 23 bp, Mus musculus
tatgtttgtgtgatatgtgtgca

SEQ ID NO: 209719 - DNA, 23 bp, Mus musculus
tgtgagcagagtgaggagtgact

SEQ ID NO: 209720 - DNA, 23 bp, Mus musculus
agactcagtgagaccctgtctca

SEQ ID NO: 209721 - DNA, 22 bp, Mus musculus
aaactgacatcactatcagtct

SEQ ID NO: 209722 - DNA, 23 bp, Mus musculus
caggctgactggctgactgacac

SEQ ID NO: 209723 - DNA, 22 bp, Mus musculus
tatgtatgtatgtatgtgtgtg

SEQ ID NO: 209724 - DNA, 23 bp, Mus musculus
atgtatgtatgtatgtatgtgtg

SEQ ID NO: 209725 - DNA, 23 bp, Mus musculus
tatgtatgtatgtatgtgtgatg

SEQ ID NO: 209726 - DNA, 23 bp, Mus musculus
tgagtctctgtcatagtttttag

SEQ ID NO: 209727 - DNA, 21 bp, Mus musculus
tccacaagcagggcaggtgct

SEQ ID NO: 209728 - DNA, 20 bp, Mus musculus
ctggttcagtgtcagcagac

SEQ ID NO: 209729 - DNA, 23 bp, Mus musculus
tacagagagaagagtcagaggtg

SEQ ID NO: 209730 - DNA, 23 bp, Mus musculus
cagactagagagatggttcagca

SEQ ID NO: 209731 - DNA, 23 bp, Mus musculus
ctcacagagtctcacttgcctct

SEQ ID NO: 209732 - DNA, 20 bp, Mus musculus
tggctcagtggttaggagca

SEQ ID NO: 209733 - DNA, 23 bp, Mus musculus
tctcctgtgtctgtctgtctccc

SEQ ID NO: 209734 - DNA, 19 bp, Mus musculus
agtatagagatttttttga

SEQ ID NO: 209735 - DNA, 18 bp, Mus musculus
taaactgcccagtgtggt

SEQ ID NO: 209736 - DNA, 23 bp, Mus musculus
cttcatttattttgagacagcgt

SEQ ID NO: 209737 - DNA, 23 bp, Mus musculus
taagagcactgactgctcttcca

SEQ ID NO: 209738 - DNA, 23 bp, Mus musculus
actgacactgatttgcgaaaggt

SEQ ID NO: 209739 - DNA, 23 bp, Mus musculus
tgtatgtatgtgtatatgtgtgt

SEQ ID NO: 209740 - DNA, 22 bp, Mus musculus
gaacatgtttcctctaggtggc

SEQ ID NO: 209741 - DNA, 22 bp, Mus musculus
acagatccttgaaagcagagtg

SEQ ID NO: 209742 - DNA, 19 bp, Mus musculus
atacatatgtgtgagtgca

SEQ ID NO: 209743 - DNA, 22 bp, Mus musculus
ttctgtctaaatgtttttgttt

SEQ ID NO: 209744 - DNA, 21 bp, Mus musculus
atatgaggctgctttagatcg

SEQ ID NO: 209745 - DNA, 23 bp, Mus musculus
tatgtgtatgtgtatatgtatat

SEQ ID NO: 209746 - DNA, 21 bp, Mus musculus
agaggttgtttgtaggagact

SEQ ID NO: 209747 - DNA, 23 bp, Mus musculus
ttcccacagttttccttttagag

SEQ ID NO: 209748 - DNA, 23 bp, Mus musculus
gtgtctgtgtgtctgtcccctct

SEQ ID NO: 209749 - DNA, 20 bp, Mus musculus
tgtgtagtgtaaagtatggt

SEQ ID NO: 209750 - DNA, 19 bp, Mus musculus
ctttcatctgtcaagctga

SEQ ID NO: 209751 - DNA, 19 bp, Mus musculus
ctttcatctgtcaagctga

SEQ ID NO: 209752 - DNA, 23 bp, Mus musculus
gtatcagtcagtcagtcagtcag

SEQ ID NO: 209753 - DNA, 23 bp, Mus musculus
aggaagtctactcattttgatga

SEQ ID NO: 209754 - DNA, 22 bp, Mus musculus
tgttttgtgaccaattatatgg

SEQ ID NO: 209755 - DNA, 23 bp, Mus musculus
atataggtatatatatgtgtgtt

SEQ ID NO: 209756 - DNA, 23 bp, Mus musculus
atgtgtgtacatacatacatgta

SEQ ID NO: 209757 - DNA, 22 bp, Mus musculus
ttgaaagatttataaaggggct

SEQ ID NO: 209758 - DNA, 22 bp, Mus musculus
ctgcctgcctgcctgcctgcat

SEQ ID NO: 209759 - DNA, 19 bp, Mus musculus
tatgtatatgtatatgtat

SEQ ID NO: 209760 - DNA, 23 bp, Mus musculus
tctgtctgtctgtctgtctgcct

SEQ ID NO: 209761 - DNA, 20 bp, Mus musculus
acacaggtgagtgtgtacag

SEQ ID NO: 209762 - DNA, 20 bp, Mus musculus
aacacaggtgagtgtgtgca

SEQ ID NO: 209763 - DNA, 20 bp, Mus musculus
acacaggtgagtgtgtgcag

SEQ ID NO: 209764 - DNA, 23 bp, Mus musculus
tagacacaggtgagtgtgtgcag

SEQ ID NO: 209765 - DNA, 21 bp, Mus musculus
cactgctcactcactctggtc

SEQ ID NO: 209766 - DNA, 20 bp, Mus musculus
accctgtagattctggagta

SEQ ID NO: 209767 - DNA, 23 bp, Mus musculus
acacacagtgcctacaggctgtg

SEQ ID NO: 209768 - DNA, 23 bp, Mus musculus
tatgcatgaatgtgtgtatgtgt

SEQ ID NO: 209769 - DNA, 23 bp, Mus musculus
ttcacagcctggtatgagaggcc

SEQ ID NO: 209770 - DNA, 23 bp, Mus musculus
atgtgtgtgcatgtggatctgga

SEQ ID NO: 209771 - DNA, 22 bp, Mus musculus
tgttttgtgaccaattatatgg

SEQ ID NO: 209772 - DNA, 21 bp, Mus musculus
atatttgggtgcatgtgcatg

SEQ ID NO: 209773 - DNA, 23 bp, Mus musculus
agtgctgactgctcttccagagg

SEQ ID NO: 209774 - DNA, 23 bp, Mus musculus
cactctctctgcgtgtctgctgc

SEQ ID NO: 209775 - DNA, 23 bp, Mus musculus
tgactgggtgtgtgtccttaact

SEQ ID NO: 209776 - DNA, 18 bp, Mus musculus
agggagtgatctgagagg

SEQ ID NO: 209777 - DNA, 23 bp, Mus musculus
tctgtctgtctgtctgtctccct

SEQ ID NO: 209778 - DNA, 23 bp, Mus musculus
taaatgtggatatgcagctgtct

SEQ ID NO: 209779 - DNA, 23 bp, Mus musculus
tatgtgtatgtatgtatatatgt

SEQ ID NO: 209780 - DNA, 22 bp, Mus musculus
tgttttgtgaccaattatatgg

SEQ ID NO: 209781 - DNA, 22 bp, Mus musculus
tatgtgattgtattattttctg

SEQ ID NO: 209782 - DNA, 19 bp, Mus musculus
gaggtatagatagatgatt

SEQ ID NO: 209783 - DNA, 23 bp, Mus musculus
gaaacaggttgttggttgtttag

SEQ ID NO: 209784 - DNA, 23 bp, Mus musculus
aacctcctccagagaaatttaag

SEQ ID NO: 209785 - DNA, 23 bp, Mus musculus
tgtgagtcactctgtgggtgaga

SEQ ID NO: 209786 - DNA, 20 bp, Mus musculus
atgtatgtatgtatgtatgt

SEQ ID NO: 209787 - DNA, 23 bp, Mus musculus
agtgctgtatgtgcatatacacc

SEQ ID NO: 209788 - DNA, 23 bp, Mus musculus
atgtatgataatgtccatgaaac

SEQ ID NO: 209789 - DNA, 23 bp, Mus musculus
ctgtgcctcagacggtccctgcc

SEQ ID NO: 209790 - DNA, 23 bp, Mus musculus
tctgccactgactcagactgtcc

SEQ ID NO: 209791 - DNA, 23 bp, Mus musculus
tagctctctctctgtctggcagg

SEQ ID NO: 209792 - DNA, 22 bp, Mus musculus
cactgtcggtctgtgttccagc

SEQ ID NO: 209793 - DNA, 23 bp, Mus musculus
tctgcctcactctgttacttcag

SEQ ID NO: 209794 - DNA, 19 bp, Mus musculus
tgtatgaagctatgtatgt

SEQ ID NO: 209795 - DNA, 20 bp, Mus musculus
gaggttggctctgctgagtg

SEQ ID NO: 209796 - DNA, 23 bp, Mus musculus
atttgagactgggtgagaatttg

SEQ ID NO: 209797 - DNA, 23 bp, Mus musculus
gtctgtctgtctgtctgtctgtc

SEQ ID NO: 209798 - DNA, 19 bp, Mus musculus
aggaaggtttcccatgctt

SEQ ID NO: 209799 - DNA, 20 bp, Mus musculus
tctgtgtatatatggtgtat

SEQ ID NO: 209800 - DNA, 23 bp, Mus musculus
tatatctgtatatggtagtcaga

SEQ ID NO: 209801 - DNA, 23 bp, Mus musculus
gtgtgtctgtgtgcctgtctgtg

SEQ ID NO: 209802 - DNA, 18 bp, Mus musculus
cagggcaggttgtgtggc

SEQ ID NO: 209803 - DNA, 23 bp, Mus musculus
tctttcacactggatcatttggc

SEQ ID NO: 209804 - DNA, 23 bp, Mus musculus
tgcctgcctgtctgtctgcctgt

SEQ ID NO: 209805 - DNA, 22 bp, Mus musculus
tgaggctgcccttgaagacgct

SEQ ID NO: 209806 - DNA, 23 bp, Mus musculus
acagtagcaccttcaggtgcagc

SEQ ID NO: 209807 - DNA, 23 bp, Mus musculus
tcctcacagcctgtgtctgtcag

SEQ ID NO: 209808 - DNA, 23 bp, Mus musculus
agtcattctgtccctccctcaag

SEQ ID NO: 209809 - DNA, 23 bp, Mus musculus
tgtgtgtcagggacagacactgg

SEQ ID NO: 209810 - DNA, 22 bp, Mus musculus
tgtgtgcgtgaatatgtggtgt

SEQ ID NO: 209811 - DNA, 23 bp, Mus musculus
ttgacacacgtagactagtgttt

SEQ ID NO: 209812 - DNA, 23 bp, Mus musculus
gtctgtctgtgtattttactgtg

SEQ ID NO: 209813 - DNA, 19 bp, Mus musculus
ggaaagttggatgtctgtg

SEQ ID NO: 209814 - DNA, 23 bp, Mus musculus
actctctcacagcctctcttgtc

SEQ ID NO: 209815 - DNA, 18 bp, Mus musculus
tagtcctcagagaggagg

SEQ ID NO: 209816 - DNA, 22 bp, Mus musculus
tcttgactgtggatgagatgtg

SEQ ID NO: 209817 - DNA, 22 bp, Mus musculus
atgccttattttatgagagaca

SEQ ID NO: 209818 - DNA, 23 bp, Mus musculus
agaacactgactgctcttccaga

SEQ ID NO: 209819 - DNA, 23 bp, Mus musculus
ttgcttgtagatctgtctgttaa

SEQ ID NO: 209820 - DNA, 23 bp, Mus musculus
aactgtcagaacagactgagatg

SEQ ID NO: 209821 - DNA, 21 bp, Mus musculus
atgtatgtatgcatgtgtgtg

SEQ ID NO: 209822 - DNA, 22 bp, Mus musculus
tgtgtgtatgtatatatctctg

SEQ ID NO: 209823 - DNA, 23 bp, Mus musculus
atgtgtgcgtgtgcatctgcatg

SEQ ID NO: 209824 - DNA, 23 bp, Mus musculus
ttatgctgtatattgcattgtct

SEQ ID NO: 209825 - DNA, 23 bp, Mus musculus
tttcacatagaaattgatgatgg

SEQ ID NO: 209826 - DNA, 23 bp, Mus musculus
tctgcttcttctttgacctcagt

SEQ ID NO: 209827 - DNA, 18 bp, Mus musculus
gctggcactctgtattcc

SEQ ID NO: 209828 - DNA, 20 bp, Mus musculus
tggtggtctgataggattca

SEQ ID NO: 209829 - DNA, 22 bp, Mus musculus
tgttttgtgaccaattatatgg

SEQ ID NO: 209830 - DNA, 18 bp, Mus musculus
ctctgctctgaactctgt

SEQ ID NO: 209831 - DNA, 23 bp, Mus musculus
cttacactgaaacctcttgtctc

SEQ ID NO: 209832 - DNA, 22 bp, Mus musculus
ctgtctgtgtctctggctgagg

SEQ ID NO: 209833 - DNA, 23 bp, Mus musculus
cacagagacagagagagagactc

SEQ ID NO: 209834 - DNA, 23 bp, Mus musculus
gagaggctctgtcagtgcctgac

SEQ ID NO: 209835 - DNA, 23 bp, Mus musculus
aacaatggatttgaaatgatttc

SEQ ID NO: 209836 - DNA, 18 bp, Mus musculus
tatcctgattcaagaggc

SEQ ID NO: 209837 - DNA, 21 bp, Mus musculus
ttctgctatattatttgattc

SEQ ID NO: 209838 - DNA, 23 bp, Mus musculus
ttactgtctctgactttgtcatg

SEQ ID NO: 209839 - DNA, 23 bp, Mus musculus
taaacattgcatttgaaatgttt

SEQ ID NO: 209840 - DNA, 22 bp, Mus musculus
tcaagtgtttgcttattatagg

SEQ ID NO: 209841 - DNA, 23 bp, Mus musculus
tatgctatgcatatgtatatata

SEQ ID NO: 209842 - DNA, 20 bp, Mus musculus
tgtaaagcacatggaagtag

SEQ ID NO: 209843 - DNA, 21 bp, Mus musculus
attgagaatgcttcctgagag

SEQ ID NO: 209844 - DNA, 22 bp, Mus musculus
tgttttgtgaccaattatatgg

SEQ ID NO: 209845 - DNA, 22 bp, Mus musculus
tgttttgtgaccaattatatgg

SEQ ID NO: 209846 - DNA, 23 bp, Mus musculus
tacatgatcattgtttttcaaat

SEQ ID NO: 209847 - DNA, 22 bp, Mus musculus
aaaattattcatgaagaagtgg

SEQ ID NO: 209848 - DNA, 23 bp, Mus musculus
tatgtatatgaagtatatgagaa

SEQ ID NO: 209849 - DNA, 23 bp, Mus musculus
tgatgtatgtgtgtatatgtata

SEQ ID NO: 209850 - DNA, 23 bp, Mus musculus
ttcacagagactgatcttcctgt

SEQ ID NO: 209851 - DNA, 23 bp, Mus musculus
ctttcaggaattcttttgtgtgt

SEQ ID NO: 209852 - DNA, 23 bp, Mus musculus
atggtagcttgagtttaggaaag

SEQ ID NO: 209853 - DNA, 22 bp, Mus musculus
tgttttgtgaccaattatatgg

SEQ ID NO: 209854 - DNA, 19 bp, Mus musculus
tgcatatatatatatatgt

SEQ ID NO: 209855 - DNA, 22 bp, Mus musculus
tgttttgtgaccaattatatgg

SEQ ID NO: 209856 - DNA, 23 bp, Mus musculus
tgatactttgttatgcttgtgga

SEQ ID NO: 209857 - DNA, 23 bp, Mus musculus
gaatgtgtgagtgctaaagttca

SEQ ID NO: 209858 - DNA, 23 bp, Mus musculus
gtttgaaattttctttttcactg

SEQ ID NO: 209859 - DNA, 20 bp, Mus musculus
tgagagatgaaagtcacaac

SEQ ID NO: 209860 - DNA, 23 bp, Mus musculus
atatgtatctatatatgtatgta

SEQ ID NO: 209861 - DNA, 18 bp, Mus musculus
actggattggtgttcatc

SEQ ID NO: 209862 - DNA, 23 bp, Mus musculus
tcagtctatttctgtctcatatt

SEQ ID NO: 209863 - DNA, 21 bp, Mus musculus
atgcagaaatcctggacaggg

SEQ ID NO: 209864 - DNA, 23 bp, Mus musculus
ctttctctgactggtcactttgt

SEQ ID NO: 209865 - DNA, 23 bp, Mus musculus
atgcctgcctgcctgcctgcctg

SEQ ID NO: 209866 - DNA, 22 bp, Mus musculus
atataggtgtgctagaatagtg

SEQ ID NO: 209867 - DNA, 23 bp, Mus musculus
tggctggcttacaactcacagac

SEQ ID NO: 209868 - DNA, 23 bp, Mus musculus
ttccatggtggtctgaaaggatg

SEQ ID NO: 209869 - DNA, 23 bp, Mus musculus
agtcctttcgatttgagtaatca

SEQ ID NO: 209870 - DNA, 22 bp, Mus musculus
tttctctttttcaaagaaagtg

SEQ ID NO: 209871 - DNA, 22 bp, Mus musculus
tttatggcacagtatgatattt

SEQ ID NO: 209872 - DNA, 23 bp, Mus musculus
ttagatgtgtagttgtaaggctt

SEQ ID NO: 209873 - DNA, 22 bp, Mus musculus
tgttttgtgaccaattatatgg

SEQ ID NO: 209874 - DNA, 20 bp, Mus musculus
atgtatgtatgtatgtgtat

SEQ ID NO: 209875 - DNA, 23 bp, Mus musculus
gactcagctatggtaatgagaga

SEQ ID NO: 209876 - DNA, 20 bp, Mus musculus
tatcagataggtaagcattt

SEQ ID NO: 209877 - DNA, 23 bp, Mus musculus
tcacactgagtcactaagctgta

SEQ ID NO: 209878 - DNA, 20 bp, Mus musculus
ggagtcatgtaacgcagcag

SEQ ID NO: 209879 - DNA, 22 bp, Mus musculus
tgttttgtgaccaattatatgg

SEQ ID NO: 209880 - DNA, 23 bp, Mus musculus
ttatgaccaattatatgatcaat

SEQ ID NO: 209881 - DNA, 21 bp, Mus musculus
catcacaagtgtgtgagcaca

SEQ ID NO: 209882 - DNA, 23 bp, Mus musculus
tcacaagctgcttgtctgaacat

SEQ ID NO: 209883 - DNA, 23 bp, Mus musculus
ctatgtctgtgtgtctgggtgtg

SEQ ID NO: 209884 - DNA, 22 bp, Mus musculus
tctgacagtcactcacccatca

SEQ ID NO: 209885 - DNA, 23 bp, Mus musculus
tactgtctggctgtgtgtctctt

SEQ ID NO: 209886 - DNA, 19 bp, Mus musculus
gtgtgatgtttgtgtgcac

SEQ ID NO: 209887 - DNA, 18 bp, Mus musculus
catgcaggtgtagatgct

SEQ ID NO: 209888 - DNA, 22 bp, Mus musculus
ctcagtctcactggggctgtca

SEQ ID NO: 209889 - DNA, 23 bp, Mus musculus
gaataccagtgctattgttggga

SEQ ID NO: 209890 - DNA, 22 bp, Mus musculus
tgttttgtgaccaattatatgg

SEQ ID NO: 209891 - DNA, 23 bp, Mus musculus
ttatgcttctttgtctctgtcat

SEQ ID NO: 209892 - DNA, 23 bp, Mus musculus
gtctctgtgtgtatgttatatac

SEQ ID NO: 209893 - DNA, 23 bp, Mus musculus
tttatgtgttttgtaaatgtaca

SEQ ID NO: 209894 - DNA, 23 bp, Mus musculus
atgtatgcatatatgtatgtatg

SEQ ID NO: 209895 - DNA, 23 bp, Mus musculus
tatgtatgtatccatctatctgc

SEQ ID NO: 209896 - DNA, 19 bp, Mus musculus
tggtcgaagctctttggat

SEQ ID NO: 209897 - DNA, 18 bp, Mus musculus
aatgatgttcctcattcc

SEQ ID NO: 209898 - DNA, 21 bp, Mus musculus
ttcacagagcatgcccatgtg

SEQ ID NO: 209899 - DNA, 18 bp, Mus musculus
tgagagggagaattattg

SEQ ID NO: 209900 - DNA, 23 bp, Mus musculus
atatgtgtgtgtgagagtgtgtg

SEQ ID NO: 209901 - DNA, 23 bp, Mus musculus
atatatcaggtatacataatctg

SEQ ID NO: 209902 - DNA, 23 bp, Mus musculus
tagtactggagatgaacctggaa

SEQ ID NO: 209903 - DNA, 23 bp, Mus musculus
ctctccctctgactctctaaatt

SEQ ID NO: 209904 - DNA, 22 bp, Mus musculus
tgttttgtgaccaattatatgg

SEQ ID NO: 209905 - DNA, 23 bp, Mus musculus
atgtatgtatgtatgtatgtatg

SEQ ID NO: 209906 - DNA, 22 bp, Mus musculus
atgcatgtgtatatgtatatgt

SEQ ID NO: 209907 - DNA, 23 bp, Mus musculus
aaaaggtgtgtagagacgggcct

SEQ ID NO: 209908 - DNA, 21 bp, Mus musculus
tttgtgcatattttcatgaag

SEQ ID NO: 209909 - DNA, 23 bp, Mus musculus
tgtgcatatgtatgcatttctgt

SEQ ID NO: 209910 - DNA, 23 bp, Mus musculus
aggaactctcaggataaaactgt

SEQ ID NO: 209911 - DNA, 20 bp, Mus musculus
taggtgtgactttttctatt

SEQ ID NO: 209912 - DNA, 20 bp, Mus musculus
ttcttcagggaactgggaga

SEQ ID NO: 209913 - DNA, 22 bp, Mus musculus
ttgaaccatttgattacagtat

SEQ ID NO: 209914 - DNA, 23 bp, Mus musculus
actctgagactctgagaatgggc

SEQ ID NO: 209915 - DNA, 23 bp, Mus musculus
gtgcgtgtgcgtgtgcatgtgca

SEQ ID NO: 209916 - DNA, 23 bp, Mus musculus
tctgtctgcctgtctgcctgcct

SEQ ID NO: 209917 - DNA, 20 bp, Mus musculus
tgcatgtatgtaagtatgaa

SEQ ID NO: 209918 - DNA, 23 bp, Mus musculus
acatgccagtgcatatgtgtgtg

SEQ ID NO: 209919 - DNA, 18 bp, Mus musculus
gtgggttctgtgctggag

SEQ ID NO: 209920 - DNA, 19 bp, Mus musculus
tgtatgtatttatatatgt

SEQ ID NO: 209921 - DNA, 23 bp, Mus musculus
tgtctcagtctctatgattcccc

SEQ ID NO: 209922 - DNA, 21 bp, Mus musculus
actgtcactgtcattgtctga

SEQ ID NO: 209923 - DNA, 23 bp, Mus musculus
acagtctctccctatctctctgt

SEQ ID NO: 209924 - DNA, 22 bp, Mus musculus
cagagctttgaaatagtcttga

SEQ ID NO: 209925 - DNA, 22 bp, Mus musculus
tctgatgaagctgactgtcact

SEQ ID NO: 209926 - DNA, 23 bp, Mus musculus
ctgactcactcacttactagtgt

SEQ ID NO: 209927 - DNA, 23 bp, Mus musculus
tgtacatttgtgtggtagtcaga

SEQ ID NO: 209928 - DNA, 23 bp, Mus musculus
tgactctctgaaaagcggaatga

SEQ ID NO: 209929 - DNA, 19 bp, Mus musculus
cagtcatgttacagagcac

SEQ ID NO: 209930 - DNA, 22 bp, Mus musculus
cactgtggctctctgcctggct

SEQ ID NO: 209931 - DNA, 21 bp, Mus musculus
ggctgtgtggttctctctctg

SEQ ID NO: 209932 - DNA, 21 bp, Mus musculus
aggtacatactcaggtatgca

SEQ ID NO: 209933 - DNA, 23 bp, Mus musculus
cagactgctcttccagaggtcct

SEQ ID NO: 209934 - DNA, 23 bp, Mus musculus
atgtaagatcatgtgagtgctcc

SEQ ID NO: 209935 - DNA, 21 bp, Mus musculus
atgtacttcctggggatggag

SEQ ID NO: 209936 - DNA, 23 bp, Mus musculus
tgagacagtagaatgagtgctcc

SEQ ID NO: 209937 - DNA, 23 bp, Mus musculus
ggctgactgtcactcactcttgg

SEQ ID NO: 209938 - DNA, 18 bp, Mus musculus
tcacaggcacatgttttt

SEQ ID NO: 209939 - DNA, 23 bp, Mus musculus
catgtctcactgtcaaaaaagcc

SEQ ID NO: 209940 - DNA, 23 bp, Mus musculus
ggctttctgtgtctgtctctgtc

SEQ ID NO: 209941 - DNA, 22 bp, Mus musculus
agagatggttatgcattgttaa

SEQ ID NO: 209942 - DNA, 18 bp, Mus musculus
tgggaccagccttctttc

SEQ ID NO: 209943 - DNA, 22 bp, Mus musculus
attctatctgttctgttcctct

SEQ ID NO: 209944 - DNA, 20 bp, Mus musculus
atatatatatatgcttcctg

SEQ ID NO: 209945 - DNA, 23 bp, Mus musculus
ttactgtttttctttagaagtag

SEQ ID NO: 209946 - DNA, 18 bp, Mus musculus
gtgtgtctctggctgtcc

SEQ ID NO: 209947 - DNA, 23 bp, Mus musculus
tgtagaccagactgtcctcagac

SEQ ID NO: 209948 - DNA, 23 bp, Mus musculus
taagagcactgactgctcttcca

SEQ ID NO: 209949 - DNA, 22 bp, Mus musculus
aatatgcctgtaattcttggga

SEQ ID NO: 209950 - DNA, 22 bp, Mus musculus
tgtgagtcagaactactccaga

SEQ ID NO: 209951 - DNA, 22 bp, Mus musculus
gtgtgatgtgtgtgatgtctca

SEQ ID NO: 209952 - DNA, 21 bp, Mus musculus
aattctacaggaggactggag

SEQ ID NO: 209953 - DNA, 23 bp, Mus musculus
tgtgtctgtctgtgtctgtgtgg

SEQ ID NO: 209954 - DNA, 23 bp, Mus musculus
gggcttgaggaactcagaagagg

SEQ ID NO: 209955 - DNA, 21 bp, Mus musculus
tgtcctagaacttgctgtgca

SEQ ID NO: 209956 - DNA, 22 bp, Mus musculus
cctgtctgtgtgactctggctc

SEQ ID NO: 209957 - DNA, 23 bp, Mus musculus
tttgtgtctgtatctcacagctt

SEQ ID NO: 209958 - DNA, 23 bp, Mus musculus
aggtgctgcagaaagaggattgt

SEQ ID NO: 209959 - DNA, 23 bp, Mus musculus
agcatgactgcacttcagattct

SEQ ID NO: 209960 - DNA, 23 bp, Mus musculus
gtgtctgcctgtgtgccaggctc

SEQ ID NO: 209961 - DNA, 21 bp, Mus musculus
tcagtccgtctgtccctgcga

SEQ ID NO: 209962 - DNA, 23 bp, Mus musculus
caaaggagtgcacggacttagag

SEQ ID NO: 209963 - DNA, 23 bp, Mus musculus
atctgtgtgtctctgtctgtatt

SEQ ID NO: 209964 - DNA, 20 bp, Mus musculus
gtgtgcatgcatgtgtgtgt

SEQ ID NO: 209965 - DNA, 23 bp, Mus musculus
cgtgtatctgtgtgtctgtgtgt

SEQ ID NO: 209966 - DNA, 22 bp, Mus musculus
tgtgcaaacacacacataagtg

SEQ ID NO: 209967 - DNA, 23 bp, Mus musculus
tcttacactcactcttttggctc

SEQ ID NO: 209968 - DNA, 23 bp, Mus musculus
cagtatctgtctctctgcctctg

SEQ ID NO: 209969 - DNA, 23 bp, Mus musculus
agccggtgttcatcagggtatga

SEQ ID NO: 209970 - DNA, 23 bp, Mus musculus
tgtaggtgtctgtctgtctgtct

SEQ ID NO: 209971 - DNA, 23 bp, Mus musculus
cagtgtctgtgtgtctgtgtggc

SEQ ID NO: 209972 - DNA, 23 bp, Mus musculus
tgagccagtgggtcaggtaggag

SEQ ID NO: 209973 - DNA, 20 bp, Mus musculus
tgcctctctgggtctctcca

SEQ ID NO: 209974 - DNA, 22 bp, Mus musculus
taattgatgtctgctctttgct

SEQ ID NO: 209975 - DNA, 23 bp, Mus musculus
tatacacattatatatatgtgtg

SEQ ID NO: 209976 - DNA, 23 bp, Mus musculus
tatgtataagtatgtgtatgtat

SEQ ID NO: 209977 - DNA, 23 bp, Mus musculus
agtcataggtgaccgtctctggc

SEQ ID NO: 209978 - DNA, 21 bp, Mus musculus
ttaaagcttgattagttctga

SEQ ID NO: 209979 - DNA, 22 bp, Mus musculus
ttcagttctatgcttaagctac

SEQ ID NO: 209980 - DNA, 23 bp, Mus musculus
tctgtgtgtgcatgtgtgtatgt

SEQ ID NO: 209981 - DNA, 18 bp, Mus musculus
cagaagtgacagtggact

SEQ ID NO: 209982 - DNA, 23 bp, Mus musculus
tctctcacacactttattttgtg

SEQ ID NO: 209983 - DNA, 22 bp, Mus musculus
atacctttactgaagtaataca

SEQ ID NO: 209984 - DNA, 23 bp, Mus musculus
ctgttgtccatgtgatatgtgta

SEQ ID NO: 209985 - DNA, 22 bp, Mus musculus
aatattcacaggttttgggggt

SEQ ID NO: 209986 - DNA, 23 bp, Mus musculus
tgtatgtatatatgtgtgtatgt

SEQ ID NO: 209987 - DNA, 21 bp, Mus musculus
tatatgtatatatatgtatgt

SEQ ID NO: 209988 - DNA, 23 bp, Mus musculus
tctgtctgtctgcctgcctgcct

SEQ ID NO: 209989 - DNA, 23 bp, Mus musculus
ttgagagcgtgcacacacacaca

SEQ ID NO: 209990 - DNA, 18 bp, Mus musculus
aggatggactggaatctg

SEQ ID NO: 209991 - DNA, 23 bp, Mus musculus
cgagtcagtctcagtctctgccc

SEQ ID NO: 209992 - DNA, 23 bp, Mus musculus
tcaggatctctcagtgtcagaat

SEQ ID NO: 209993 - DNA, 23 bp, Mus musculus
tctctcactgacagactggctgg

SEQ ID NO: 209994 - DNA, 23 bp, Mus musculus
tatcagtggatcctgttactctg

SEQ ID NO: 209995 - DNA, 23 bp, Mus musculus
acactgagatgacagcagtgggt

SEQ ID NO: 209996 - DNA, 21 bp, Mus musculus
aggtcctcatgatggtacaga

SEQ ID NO: 209997 - DNA, 23 bp, Mus musculus
atgtatatgtgtatatatgtgtg

SEQ ID NO: 209998 - DNA, 23 bp, Mus musculus
atgtgtatatatgtatatatgtg

SEQ ID NO: 209999 - DNA, 23 bp, Mus musculus
actcagtgagtctatgttctgtg

SEQ ID NO: 210000 - DNA, 23 bp, Mus musculus
cctttgttgaagccttggactgt

SEQ ID NO: 210001 - DNA, 23 bp, Mus musculus
tgtatacatcctgcactggtcct

SEQ ID NO: 210002 - DNA, 22 bp, Mus musculus
tatgactgaactcacagaggac

SEQ ID NO: 210003 - DNA, 23 bp, Mus musculus
atacacagagaacagtgtgctca

SEQ ID NO: 210004 - DNA, 20 bp, Mus musculus
catcactgaaggaagtgagg

SEQ ID NO: 210005 - DNA, 18 bp, Mus musculus
tggaggggctgagagtct

SEQ ID NO: 210006 - DNA, 23 bp, Mus musculus
tggtgtgagttgagactggccag

SEQ ID NO: 210007 - DNA, 22 bp, Mus musculus
aagtctagatactggaggatct

SEQ ID NO: 210008 - DNA, 19 bp, Mus musculus
gtcaacagcctgcagccta

SEQ ID NO: 210009 - DNA, 20 bp, Mus musculus
aagtttgagagctgggaatg

SEQ ID NO: 210010 - DNA, 21 bp, Mus musculus
aggtcagaggacagcctgcac

SEQ ID NO: 210011 - DNA, 23 bp, Mus musculus
tatatctatatgtttatatgtgt

SEQ ID NO: 210012 - DNA, 23 bp, Mus musculus
tgcgtgcgtgcgtgtgtacgtgc

SEQ ID NO: 210013 - DNA, 22 bp, Mus musculus
atgtgtgcgtgcgtgcgtgcgt

SEQ ID NO: 210014 - DNA, 23 bp, Mus musculus
gcttagagaagacacagtgctga

SEQ ID NO: 210015 - DNA, 22 bp, Mus musculus
catgaacgtgtgtggctgactc

SEQ ID NO: 210016 - DNA, 22 bp, Mus musculus
ttgatcagttccagctgaggag

SEQ ID NO: 210017 - DNA, 23 bp, Mus musculus
cactgactgctcttccagaggtc

SEQ ID NO: 210018 - DNA, 23 bp, Mus musculus
ctctgtgtcagtcagtatttagg

SEQ ID NO: 210019 - DNA, 23 bp, Mus musculus
agttctgtcagactctgtctaag

SEQ ID NO: 210020 - DNA, 19 bp, Mus musculus
gtctatcactcactgtcat

SEQ ID NO: 210021 - DNA, 23 bp, Mus musculus
gactggctctgtccctgcctgtg

SEQ ID NO: 210022 - DNA, 23 bp, Mus musculus
tagagacctctgggtccctgggt

SEQ ID NO: 210023 - DNA, 22 bp, Mus musculus
tgacacaacagtcacagcactt

SEQ ID NO: 210024 - DNA, 22 bp, Mus musculus
tgtcagcatcctgaaagcaaca

SEQ ID NO: 210025 - DNA, 23 bp, Mus musculus
taggtgctaaagtatacagaatg

SEQ ID NO: 210026 - DNA, 19 bp, Mus musculus
tgtatctacttaagggtat

SEQ ID NO: 210027 - DNA, 22 bp, Mus musculus
ttagtccatggtgatctgatag

SEQ ID NO: 210028 - DNA, 23 bp, Mus musculus
tgtgtctgtctgctttactttgg

SEQ ID NO: 210029 - DNA, 23 bp, Mus musculus
attgtcagccattttgatgagta

SEQ ID NO: 210030 - DNA, 21 bp, Mus musculus
tctgtgcttcatcatggtttt

SEQ ID NO: 210031 - DNA, 23 bp, Mus musculus
gtatgtgtgtgtatatgtgtgtg

SEQ ID NO: 210032 - DNA, 23 bp, Mus musculus
tctgtctcagtactttacctgtg

SEQ ID NO: 210033 - DNA, 23 bp, Mus musculus
tcattttcctctctgtgtctgtc

SEQ ID NO: 210034 - DNA, 23 bp, Mus musculus
gaccatctgtctgtgactctgtg

SEQ ID NO: 210035 - DNA, 23 bp, Mus musculus
tgtgtgtgcatgtgtatgtgtgc

SEQ ID NO: 210036 - DNA, 23 bp, Mus musculus
tatgtatgtgtatatgtatacgt

SEQ ID NO: 210037 - DNA, 23 bp, Mus musculus
gctgcctccctggttccctctca

SEQ ID NO: 210038 - DNA, 23 bp, Mus musculus
agtgagtggtgagtgtggagaag

SEQ ID NO: 210039 - DNA, 23 bp, Mus musculus
ggtctctcagactgacttctcac

SEQ ID NO: 210040 - DNA, 23 bp, Mus musculus
taaactaagcccagtgtctcact

SEQ ID NO: 210041 - DNA, 19 bp, Mus musculus
gacgctgcagagatgctgt

SEQ ID NO: 210042 - DNA, 23 bp, Mus musculus
agtgcatgtatgtatgtatgtat

SEQ ID NO: 210043 - DNA, 23 bp, Mus musculus
gtctgtctctctctctgtgtccc

SEQ ID NO: 210044 - DNA, 23 bp, Mus musculus
acatggtcatgtgttctctctct

SEQ ID NO: 210045 - DNA, 22 bp, Mus musculus
tgtctcagtcagggtttctatt

SEQ ID NO: 210046 - DNA, 23 bp, Mus musculus
tggttgtatgtatgtatgtatgt

SEQ ID NO: 210047 - DNA, 21 bp, Mus musculus
tgtatgcatgcatgcatgtgc

SEQ ID NO: 210048 - DNA, 23 bp, Mus musculus
tgtgtgctacctgggactggaga

SEQ ID NO: 210049 - DNA, 23 bp, Mus musculus
aagaccactgactgctcttccag

SEQ ID NO: 210050 - DNA, 23 bp, Mus musculus
tatgtgtgtatatgtatatatat

SEQ ID NO: 210051 - DNA, 22 bp, Mus musculus
atatacacacacatataaatat

SEQ ID NO: 210052 - DNA, 23 bp, Mus musculus
cttagtgcagggactataggtgt

SEQ ID NO: 210053 - DNA, 23 bp, Mus musculus
tttggtagatttaggtagcatac

SEQ ID NO: 210054 - DNA, 19 bp, Mus musculus
tgtatgactgtagtaggcc

SEQ ID NO: 210055 - DNA, 19 bp, Mus musculus
tgatccacccaatagctga

SEQ ID NO: 210056 - DNA, 23 bp, Mus musculus
agattctcactatttttgtgtcc

SEQ ID NO: 210057 - DNA, 23 bp, Mus musculus
agatgaatagttggatgaatggg

SEQ ID NO: 210058 - DNA, 23 bp, Mus musculus
ttgtactgtatatatatatgtgt

SEQ ID NO: 210059 - DNA, 23 bp, Mus musculus
tataatgatgtatatgtagatgt

SEQ ID NO: 210060 - DNA, 18 bp, Mus musculus
taaagcatacatatgttt

SEQ ID NO: 210061 - DNA, 23 bp, Mus musculus
tcatagcagtggttttcctgtct

SEQ ID NO: 210062 - DNA, 20 bp, Mus musculus
gtgtgtgtgtgtgtgtgtgt

SEQ ID NO: 210063 - DNA, 23 bp, Mus musculus
gtacatgtgctatacatttgttt

SEQ ID NO: 210064 - DNA, 21 bp, Mus musculus
atgtgtgtgtgtatgtatata

SEQ ID NO: 210065 - DNA, 23 bp, Mus musculus
ctcagtagaaagtgaccagtggt

SEQ ID NO: 210066 - DNA, 20 bp, Mus musculus
acagtattgatctacataca

SEQ ID NO: 210067 - DNA, 23 bp, Mus musculus
gtctgtctgtatgtctgtctcct

SEQ ID NO: 210068 - DNA, 23 bp, Mus musculus
tgactgctcttccagaggtcctg

SEQ ID NO: 210069 - DNA, 23 bp, Mus musculus
ggctcatgaccatctgtaagaga

SEQ ID NO: 210070 - DNA, 22 bp, Mus musculus
caagtcacttgtgcttctgtaa

SEQ ID NO: 210071 - DNA, 22 bp, Mus musculus
acgcatgcatgtatgtatatat

SEQ ID NO: 210072 - DNA, 23 bp, Mus musculus
tgtctctgtctctgtctctgtct

SEQ ID NO: 210073 - DNA, 23 bp, Mus musculus
atctagatagatgtagaacactt

SEQ ID NO: 210074 - DNA, 21 bp, Mus musculus
tgagtggtgagtgaggagaca

SEQ ID NO: 210075 - DNA, 19 bp, Mus musculus
gtatgtatgcatgtatgta

SEQ ID NO: 210076 - DNA, 22 bp, Mus musculus
actgggtccctgtcttcactgt

SEQ ID NO: 210077 - DNA, 23 bp, Mus musculus
aagactgaagttcaatgtcccag

SEQ ID NO: 210078 - DNA, 21 bp, Mus musculus
ggcagcctcactgtcccactg

SEQ ID NO: 210079 - DNA, 23 bp, Mus musculus
tggctgactgactggctggctgg

SEQ ID NO: 210080 - DNA, 23 bp, Mus musculus
aaaagcactgactgctcttccag

SEQ ID NO: 210081 - DNA, 23 bp, Mus musculus
acacacacagtgtttaagcagcc

SEQ ID NO: 210082 - DNA, 23 bp, Mus musculus
tggatttatttacttctgtgtgt

SEQ ID NO: 210083 - DNA, 23 bp, Mus musculus
agagcaggtggaagagtcagaga

SEQ ID NO: 210084 - DNA, 23 bp, Mus musculus
cgtgcgtgcctgcgtgcgtgcat

SEQ ID NO: 210085 - DNA, 23 bp, Mus musculus
tgtctgtctgtctgtctgtcttt

SEQ ID NO: 210086 - DNA, 21 bp, Mus musculus
caagagtggtagaggttcagc

SEQ ID NO: 210087 - DNA, 23 bp, Mus musculus
gaggtacattcatgtagctggac

SEQ ID NO: 210088 - DNA, 23 bp, Mus musculus
actgagtcaacactcagacctca

SEQ ID NO: 210089 - DNA, 23 bp, Mus musculus
tcctggcttactgtctctgtctc

SEQ ID NO: 210090 - DNA, 19 bp, Mus musculus
tcatctctctatctcagca

SEQ ID NO: 210091 - DNA, 18 bp, Mus musculus
agaggagacataggtgtt

SEQ ID NO: 210092 - DNA, 23 bp, Mus musculus
gtctgtgtcgctctctgtcttga

SEQ ID NO: 210093 - DNA, 23 bp, Mus musculus
tcatttctgtctgtctgtctgtc

SEQ ID NO: 210094 - DNA, 23 bp, Mus musculus
ctatggtgtagttacttctttgt

SEQ ID NO: 210095 - DNA, 19 bp, Mus musculus
tatgtgtatatatatacat

SEQ ID NO: 210096 - DNA, 23 bp, Mus musculus
tctgtgacacactcactcctcca

SEQ ID NO: 210097 - DNA, 22 bp, Mus musculus
tgtatgttcatgtgcatgtgga

SEQ ID NO: 210098 - DNA, 23 bp, Mus musculus
tctctctatctgtctgtctgtct

SEQ ID NO: 210099 - DNA, 22 bp, Mus musculus
acacacacacacatatgtatgt

SEQ ID NO: 210100 - DNA, 23 bp, Mus musculus
aagagcactgactgctcttctag

SEQ ID NO: 210101 - DNA, 20 bp, Mus musculus
tgcttgtatgtatgtatgta

SEQ ID NO: 210102 - DNA, 18 bp, Mus musculus
tgtatggtgtacatcctg

SEQ ID NO: 210103 - DNA, 23 bp, Mus musculus
ctctcagtctgtctgtggctctg

SEQ ID NO: 210104 - DNA, 19 bp, Mus musculus
tggagatgcagaatttgga

SEQ ID NO: 210105 - DNA, 23 bp, Mus musculus
ctgtctgtctgtctgtctgtctg

SEQ ID NO: 210106 - DNA, 21 bp, Mus musculus
aatgcacatttgggctggaga

SEQ ID NO: 210107 - DNA, 23 bp, Mus musculus
catacctgtggctccctctcgcc

SEQ ID NO: 210108 - DNA, 23 bp, Mus musculus
tagtccatggtgatctgatagga

SEQ ID NO: 210109 - DNA, 21 bp, Mus musculus
tgttttgtcaccaattatatg

SEQ ID NO: 210110 - DNA, 19 bp, Mus musculus
cacacacttactcactcac

SEQ ID NO: 210111 - DNA, 18 bp, Mus musculus
tatggctttggatatcat

SEQ ID NO: 210112 - DNA, 21 bp, Mus musculus
agagaagtcattttgttgttg

SEQ ID NO: 210113 - DNA, 18 bp, Mus musculus
tggagaaggacagtcact

SEQ ID NO: 210114 - DNA, 23 bp, Mus musculus
actgcttgtttctctgactctgt

SEQ ID NO: 210115 - DNA, 23 bp, Mus musculus
tctcagtgtctctgtctccttga

SEQ ID NO: 210116 - DNA, 23 bp, Mus musculus
gtgtgtgcatgtgtatgtatatg

SEQ ID NO: 210117 - DNA, 23 bp, Mus musculus
tatgcatatctatgtatttgtgt

SEQ ID NO: 210118 - DNA, 21 bp, Mus musculus
ttagatttgaagataacatag

SEQ ID NO: 210119 - DNA, 23 bp, Mus musculus
cagaagagagcttttctgatggt

SEQ ID NO: 210120 - DNA, 21 bp, Mus musculus
tccatggtggtctgataggat

SEQ ID NO: 210121 - DNA, 22 bp, Mus musculus
tgttttgtgaccaattatatgg

SEQ ID NO: 210122 - DNA, 20 bp, Mus musculus
tggatatatgtgtgcacata

SEQ ID NO: 210123 - DNA, 19 bp, Mus musculus
atgtatgtaggtatgtatg

SEQ ID NO: 210124 - DNA, 20 bp, Mus musculus
tatgtattgtgtatgcatgt

SEQ ID NO: 210125 - DNA, 23 bp, Mus musculus
agaaaactgtttttctagttcta

SEQ ID NO: 210126 - DNA, 20 bp, Mus musculus
ctctgtctatgtctctgttt

SEQ ID NO: 210127 - DNA, 21 bp, Mus musculus
tccttggacactcacaggctg

SEQ ID NO: 210128 - DNA, 23 bp, Mus musculus
atgtctgtatatatgtgtatgca

SEQ ID NO: 210129 - DNA, 23 bp, Mus musculus
tctctgtgtgtctgtgtgtctgt

SEQ ID NO: 210130 - DNA, 23 bp, Mus musculus
acagaacacagacaggagactgc

SEQ ID NO: 210131 - DNA, 22 bp, Mus musculus
tgcaatgcactaggtccagcca

SEQ ID NO: 210132 - DNA, 19 bp, Mus musculus
tgtgtgtctgtttctctct

SEQ ID NO: 210133 - DNA, 22 bp, Mus musculus
tgttttgtgaccaattatatgg

SEQ ID NO: 210134 - DNA, 22 bp, Mus musculus
tgttttgtgaccaattatatgg

SEQ ID NO: 210135 - DNA, 22 bp, Mus musculus
atgtttgtgtacatgcatatac

SEQ ID NO: 210136 - DNA, 18 bp, Mus musculus
tttatgtatatatgcata

SEQ ID NO: 210137 - DNA, 22 bp, Mus musculus
ttagagttgcatttccattgca

SEQ ID NO: 210138 - DNA, 20 bp, Mus musculus
tgaggtagtaggattattag

SEQ ID NO: 210139 - DNA, 23 bp, Mus musculus
cttctgctacctagtaagactct

SEQ ID NO: 210140 - DNA, 22 bp, Mus musculus
tgttttgtgaccaattatatgg

SEQ ID NO: 210141 - DNA, 23 bp, Mus musculus
tatcagagagggagattgctatt

SEQ ID NO: 210142 - DNA, 23 bp, Mus musculus
agtctgtctgtctgtctgcctgt

SEQ ID NO: 210143 - DNA, 22 bp, Mus musculus
tcagggagttggttcaatagtt

SEQ ID NO: 210144 - DNA, 23 bp, Mus musculus
tatatctatatatatgtatgtgt

SEQ ID NO: 210145 - DNA, 23 bp, Mus musculus
gaggaagcagcaagaaactgtag

SEQ ID NO: 210146 - DNA, 23 bp, Mus musculus
ggtgagtctctctctctatggag

SEQ ID NO: 210147 - DNA, 22 bp, Mus musculus
tgttttgtgaccaattatatgg

SEQ ID NO: 210148 - DNA, 23 bp, Mus musculus
tgagtggtacttaaattctctga

SEQ ID NO: 210149 - DNA, 20 bp, Mus musculus
acacaccctctcacactggt

SEQ ID NO: 210150 - DNA, 20 bp, Mus musculus
tagaggtatttgattctcgg

SEQ ID NO: 210151 - DNA, 23 bp, Mus musculus
aattaatgtgatattcatgtgtt

SEQ ID NO: 210152 - DNA, 22 bp, Mus musculus
tgttttgtgaccaattatatgg

SEQ ID NO: 210153 - DNA, 22 bp, Mus musculus
tgttttgtgaccaattatatgg

SEQ ID NO: 210154 - DNA, 21 bp, Mus musculus
ttctgcttgaacttaagaaca

SEQ ID NO: 210155 - DNA, 23 bp, Mus musculus
tatacatgtgtgtgtctgtgtgt

SEQ ID NO: 210156 - DNA, 21 bp, Mus musculus
ataggacctgtcccagaagct

SEQ ID NO: 210157 - DNA, 23 bp, Mus musculus
tctgtagatcctacactctcacc

SEQ ID NO: 210158 - DNA, 21 bp, Mus musculus
tatgtgtatatatatgcatat

SEQ ID NO: 210159 - DNA, 23 bp, Mus musculus
tatcagctagtgtatgatgtctg

SEQ ID NO: 210160 - DNA, 23 bp, Mus musculus
agttgagactgaatttggtctgt

SEQ ID NO: 210161 - DNA, 23 bp, Mus musculus
ggaatgtatagctttgtgtatct

SEQ ID NO: 210162 - DNA, 22 bp, Mus musculus
ttgtccttaagtatatgtttct

SEQ ID NO: 210163 - DNA, 23 bp, Mus musculus
atcagggtgtggtagctgtttgt

SEQ ID NO: 210164 - DNA, 21 bp, Mus musculus
tatgaactatcaggctgcaga

SEQ ID NO: 210165 - DNA, 23 bp, Mus musculus
tctatttgtctacatgtatgtgt

SEQ ID NO: 210166 - DNA, 22 bp, Mus musculus
aatgtagaagttagggcaagga

SEQ ID NO: 210167 - DNA, 21 bp, Mus musculus
gatcagagatgtgactgagga

SEQ ID NO: 210168 - DNA, 20 bp, Mus musculus
aagttactttcagaaatgct

SEQ ID NO: 210169 - DNA, 22 bp, Mus musculus
atagaacattctagaacatgct

SEQ ID NO: 210170 - DNA, 22 bp, Mus musculus
tgttttgtgaccaattatatgg

SEQ ID NO: 210171 - DNA, 22 bp, Mus musculus
tgttttgtgaccaattatatgg

SEQ ID NO: 210172 - DNA, 22 bp, Mus musculus
tgttttgtgaccaattatatgg

SEQ ID NO: 210173 - DNA, 23 bp, Mus musculus
ctgtctgtctgtctgtctgtgtg

SEQ ID NO: 210174 - DNA, 22 bp, Mus musculus
tgttttgtgaccaattatatgg

SEQ ID NO: 210175 - DNA, 23 bp, Mus musculus
gatgtcctggagctgctctgtaa

SEQ ID NO: 210176 - DNA, 22 bp, Mus musculus
tttctcacaggctgattccctg

SEQ ID NO: 210177 - DNA, 19 bp, Mus musculus
tgagcatagtctctctctg

SEQ ID NO: 210178 - DNA, 22 bp, Mus musculus
tgttttgtgaccaattatatgg

SEQ ID NO: 210179 - DNA, 23 bp, Mus musculus
tatgtgtatgtatgtatgtatgt

SEQ ID NO: 210180 - DNA, 23 bp, Mus musculus
tacatatacattgtatatatgta

SEQ ID NO: 210181 - DNA, 23 bp, Mus musculus
ttgtctgtgagcatctgcatctg

SEQ ID NO: 210182 - DNA, 23 bp, Mus musculus
ctatgtgaaactgtctcaaaaac

SEQ ID NO: 210183 - DNA, 22 bp, Mus musculus
taaacagagagtcaatctgcag

SEQ ID NO: 210184 - DNA, 22 bp, Mus musculus
ttgtactaggttgtgtctgtct

SEQ ID NO: 210185 - DNA, 20 bp, Mus musculus
tgttttgtgacctattatgt

SEQ ID NO: 210186 - DNA, 22 bp, Mus musculus
tgttttgtgaccaattatatgg

SEQ ID NO: 210187 - DNA, 22 bp, Mus musculus
tgttttgtgaccaattatatgg

SEQ ID NO: 210188 - DNA, 22 bp, Mus musculus
tgttttgtgaccaattatatgg

SEQ ID NO: 210189 - DNA, 22 bp, Mus musculus
tgttttgtgaccaattatatgg

SEQ ID NO: 210190 - DNA, 23 bp, Mus musculus
tgtgtgtatgtatatatatgtgt

SEQ ID NO: 210191 - DNA, 21 bp, Mus musculus
tcagttcagtctctatgtgct

SEQ ID NO: 210192 - DNA, 22 bp, Mus musculus
tgttttgtgaccaattatatgg

SEQ ID NO: 210193 - DNA, 23 bp, Mus musculus
atagagtgtggacatggtgcaga

SEQ ID NO: 210194 - DNA, 23 bp, Mus musculus
tcctttggttttcttatctgtat

SEQ ID NO: 210195 - DNA, 23 bp, Mus musculus
tcacagtcagtgtgctgagaagg

SEQ ID NO: 210196 - DNA, 21 bp, Mus musculus
ccagtctctcaggctgtctgt

SEQ ID NO: 210197 - DNA, 23 bp, Mus musculus
gaaggtgcttgcttgcttctttc

SEQ ID NO: 210198 - DNA, 23 bp, Mus musculus
tgtgtatatatgtatatgtatat

SEQ ID NO: 210199 - DNA, 23 bp, Mus musculus
tgtgtctgttactcactctcaaa

SEQ ID NO: 210200 - DNA, 18 bp, Mus musculus
agagttacagttattgtt

SEQ ID NO: 210201 - DNA, 23 bp, Mus musculus
ttcagctggtattctatccagta

SEQ ID NO: 210202 - DNA, 23 bp, Mus musculus
acagtgtgtattccctgagcttc

SEQ ID NO: 210203 - DNA, 22 bp, Mus musculus
ggagagctgctagttagtgcag

SEQ ID NO: 210204 - DNA, 22 bp, Mus musculus
taaagatttcttctatggggta

SEQ ID NO: 210205 - DNA, 23 bp, Mus musculus
gtgtgtatgtgtatgtatgtata

SEQ ID NO: 210206 - DNA, 23 bp, Mus musculus
tccctgtctctgtgtgtccctgc

SEQ ID NO: 210207 - DNA, 23 bp, Mus musculus
tgtgagcctgtgtccctgggtgt

SEQ ID NO: 210208 - DNA, 22 bp, Mus musculus
tgagtagttagtgaacacaaaa

SEQ ID NO: 210209 - DNA, 20 bp, Mus musculus
aaccttcatcctcacgggca

SEQ ID NO: 210210 - DNA, 23 bp, Mus musculus
gtgcatgtgtgtgtgtgtgtgtg

SEQ ID NO: 210211 - DNA, 19 bp, Mus musculus
aaaagtgataggaatggag

SEQ ID NO: 210212 - DNA, 23 bp, Mus musculus
tctcatgctctctctctctctaa

SEQ ID NO: 210213 - DNA, 23 bp, Mus musculus
aattatcagaatgtgaaagcatg

SEQ ID NO: 210214 - DNA, 21 bp, Mus musculus
tatatgtatatgtatatatgt

SEQ ID NO: 210215 - DNA, 23 bp, Mus musculus
gtcagtcactgtgtggctcccag

SEQ ID NO: 210216 - DNA, 23 bp, Mus musculus
tccctgagagattaatttctttt

SEQ ID NO: 210217 - DNA, 23 bp, Mus musculus
ttagattgttttgtctattaggc

SEQ ID NO: 210218 - DNA, 21 bp, Mus musculus
ttacagagggtccaatccatt

SEQ ID NO: 210219 - DNA, 23 bp, Mus musculus
gtatatgtgtgaggtatgcatat

SEQ ID NO: 210220 - DNA, 22 bp, Mus musculus
atattagtgttctattgatgtg

SEQ ID NO: 210221 - DNA, 23 bp, Mus musculus
tgtcttggtcaggctctgacagt

SEQ ID NO: 210222 - DNA, 22 bp, Mus musculus
tattgcacagaatttgtactga

SEQ ID NO: 210223 - DNA, 21 bp, Mus musculus
gacagtggatctctatttgtt

SEQ ID NO: 210224 - DNA, 22 bp, Mus musculus
taaggaattcatgatgtccctg

SEQ ID NO: 210225 - DNA, 18 bp, Mus musculus
aaagcactgtctgctctt

SEQ ID NO: 210226 - DNA, 23 bp, Mus musculus
gattactgtcactatctctgagc

SEQ ID NO: 210227 - DNA, 23 bp, Mus musculus
actgtcagtctgtcattgaggac

SEQ ID NO: 210228 - DNA, 23 bp, Mus musculus
actgtatatttatatatgtgtgc

SEQ ID NO: 210229 - DNA, 23 bp, Mus musculus
agagatgacactggtaccagtga

SEQ ID NO: 210230 - DNA, 23 bp, Mus musculus
tcaagtgacagaggaaaggttta

SEQ ID NO: 210231 - DNA, 19 bp, Mus musculus
tgagtgactaaaggcaggc

SEQ ID NO: 210232 - DNA, 23 bp, Mus musculus
acgcagtctggttaagtggatgg

SEQ ID NO: 210233 - DNA, 23 bp, Mus musculus
ctcaggcagtgaccatcttgttt

SEQ ID NO: 210234 - DNA, 23 bp, Mus musculus
gggtctctcactggctgagaact

SEQ ID NO: 210235 - DNA, 19 bp, Mus musculus
gtatgtatgtatatgtgtg

SEQ ID NO: 210236 - DNA, 23 bp, Mus musculus
atgtatatatgtatgtgcatgtg

SEQ ID NO: 210237 - DNA, 23 bp, Mus musculus
agcgaagatgaagactcactcga

SEQ ID NO: 210238 - DNA, 21 bp, Mus musculus
tgattgtctctgtgtgtctgt

SEQ ID NO: 210239 - DNA, 23 bp, Mus musculus
tgtggctggctgaattcctgcga

SEQ ID NO: 210240 - DNA, 23 bp, Mus musculus
gacactacagactctctgtgacc

SEQ ID NO: 210241 - DNA, 18 bp, Mus musculus
tgagtctcattctgtctg

SEQ ID NO: 210242 - DNA, 23 bp, Mus musculus
aagtcacactgtgtctgtgccag

SEQ ID NO: 210243 - DNA, 23 bp, Mus musculus
ggtgtgagttctgtgagagcaga

SEQ ID NO: 210244 - DNA, 23 bp, Mus musculus
ctgtttatcatcttcaggatggg

SEQ ID NO: 210245 - DNA, 23 bp, Mus musculus
accgtgactcagtcttagaggtg

SEQ ID NO: 210246 - DNA, 23 bp, Mus musculus
tatctgatagcttagcatctttg

SEQ ID NO: 210247 - DNA, 23 bp, Mus musculus
cctctgtgagcctgtctgagtgc

SEQ ID NO: 210248 - DNA, 23 bp, Mus musculus
ctgcttgctgactcactctcagg

SEQ ID NO: 210249 - DNA, 20 bp, Mus musculus
ctattctctggctcttacat

SEQ ID NO: 210250 - DNA, 23 bp, Mus musculus
agggtctgtctcagagtgtggct

SEQ ID NO: 210251 - DNA, 21 bp, Mus musculus
tatgtttgtatgtatacatgt

SEQ ID NO: 210252 - DNA, 23 bp, Mus musculus
atatgtgtgtgtgtatatcaagt

SEQ ID NO: 210253 - DNA, 23 bp, Mus musculus
tgtccttgatagatttgggttag

SEQ ID NO: 210254 - DNA, 23 bp, Mus musculus
tttctggaactatctgtctctga

SEQ ID NO: 210255 - DNA, 20 bp, Mus musculus
tatgtctgtgttactgtgtg

SEQ ID NO: 210256 - DNA, 23 bp, Mus musculus
atctcagtgacaattttaacagt

SEQ ID NO: 210257 - DNA, 23 bp, Mus musculus
acacagtgagactctgtctcaaa

SEQ ID NO: 210258 - DNA, 22 bp, Mus musculus
tacattgaggcagtgttaccgg

SEQ ID NO: 210259 - DNA, 23 bp, Mus musculus
agttctctttttgttaatggctg

SEQ ID NO: 210260 - DNA, 23 bp, Mus musculus
tcatagcatcatgtgctaaagat

SEQ ID NO: 210261 - DNA, 20 bp, Mus musculus
tactgcattaggatatgtat

SEQ ID NO: 210262 - DNA, 23 bp, Mus musculus
agtgcatggtgatctgataggat

SEQ ID NO: 210263 - DNA, 22 bp, Mus musculus
tgttttgtgacctattatgtgg

SEQ ID NO: 210264 - DNA, 22 bp, Mus musculus
atatttatggttagatacgaat

SEQ ID NO: 210265 - DNA, 23 bp, Mus musculus
aagttcatgccattcccagttaa

SEQ ID NO: 210266 - DNA, 20 bp, Mus musculus
tgcatgtatcgttatctgta

SEQ ID NO: 210267 - DNA, 22 bp, Mus musculus
tcttatgtatcttaaattagga

SEQ ID NO: 210268 - DNA, 23 bp, Mus musculus
aaatcacaggaattttgaaattt

SEQ ID NO: 210269 - DNA, 23 bp, Mus musculus
ttggtcaatgcagttgctgtggt

SEQ ID NO: 210270 - DNA, 19 bp, Mus musculus
agcattctctgcatgttgg

SEQ ID NO: 210271 - DNA, 19 bp, Mus musculus
gaatatatgtatatgtata

SEQ ID NO: 210272 - DNA, 23 bp, Mus musculus
tatgtatatatgtatgtgtatat

SEQ ID NO: 210273 - DNA, 23 bp, Mus musculus
tcagcctctctcaatctgtggga

SEQ ID NO: 210274 - DNA, 19 bp, Mus musculus
tctcatttattccacctct

SEQ ID NO: 210275 - DNA, 23 bp, Mus musculus
tctatatctctgtctggtaggaa

SEQ ID NO: 210276 - DNA, 23 bp, Mus musculus
aatccatgatgatctgataggat

SEQ ID NO: 210277 - DNA, 23 bp, Mus musculus
tttgtgaccaattatgttgtcaa

SEQ ID NO: 210278 - DNA, 23 bp, Mus musculus
tatatgcatatatatagtgtgtg

SEQ ID NO: 210279 - DNA, 23 bp, Mus musculus
tatgtgtgtgtatatgtatgtgc

SEQ ID NO: 210280 - DNA, 22 bp, Mus musculus
tgttttgtgaccaattatatgg

SEQ ID NO: 210281 - DNA, 22 bp, Mus musculus
tgttttgtgaccaattatatgg

SEQ ID NO: 210282 - DNA, 23 bp, Mus musculus
tgtctctgtgtgtaagtttattc

SEQ ID NO: 210283 - DNA, 23 bp, Mus musculus
tagtccatggtgatctgatagga

SEQ ID NO: 210284 - DNA, 22 bp, Mus musculus
tgttttgtgacctattatgtgg

SEQ ID NO: 210285 - DNA, 22 bp, Mus musculus
tgttttgtgaccaattatatgg

SEQ ID NO: 210286 - DNA, 23 bp, Mus musculus
tgtatatgtatatgtatatgtat

SEQ ID NO: 210287 - DNA, 23 bp, Mus musculus
gcatatgcatatgttcatgtatg

SEQ ID NO: 210288 - DNA, 22 bp, Mus musculus
tgttttgtgaccaattatatgg

SEQ ID NO: 210289 - DNA, 23 bp, Mus musculus
ttacatgtccaaatgatttcata

SEQ ID NO: 210290 - DNA, 21 bp, Mus musculus
tgaaatgtatacaagactgca

SEQ ID NO: 210291 - DNA, 19 bp, Mus musculus
agactggatagtgaaagta

SEQ ID NO: 210292 - DNA, 22 bp, Mus musculus
gccttagtccatggtgatctga

SEQ ID NO: 210293 - DNA, 23 bp, Mus musculus
tcactctcttgctctctcttggt

SEQ ID NO: 210294 - DNA, 19 bp, Mus musculus
agtctctttgtctctctcc

SEQ ID NO: 210295 - DNA, 23 bp, Mus musculus
tgagcatcaggatttgatgggaa

SEQ ID NO: 210296 - DNA, 21 bp, Mus musculus
ctaatgttttcaacctgatca

SEQ ID NO: 210297 - DNA, 21 bp, Mus musculus
atggtaaattttgtagaaggt

SEQ ID NO: 210298 - DNA, 23 bp, Mus musculus
aaatgttctattagatacctgat

SEQ ID NO: 210299 - DNA, 22 bp, Mus musculus
tgttttgtgaccaattatatgg

SEQ ID NO: 210300 - DNA, 19 bp, Mus musculus
ggatgtatgtatgtatgta

SEQ ID NO: 210301 - DNA, 23 bp, Mus musculus
gccacagtgaaaggagctactga

SEQ ID NO: 210302 - DNA, 22 bp, Mus musculus
tagtgctttcttctgtgggtcg

SEQ ID NO: 210303 - DNA, 23 bp, Mus musculus
tctccaggacatcttctccatct

SEQ ID NO: 210304 - DNA, 23 bp, Mus musculus
ctagtgagagtcagctctcaggg

SEQ ID NO: 210305 - DNA, 23 bp, Mus musculus
caatgaccatatgttttcatttt

SEQ ID NO: 210306 - DNA, 22 bp, Mus musculus
tgttttgtgaccaattatatgg

SEQ ID NO: 210307 - DNA, 22 bp, Mus musculus
ttgggccagttgaaccagcaga

SEQ ID NO: 210308 - DNA, 23 bp, Mus musculus
gatgaacttgaggagataggtca

SEQ ID NO: 210309 - DNA, 19 bp, Mus musculus
tgacaattctggttgggtt

SEQ ID NO: 210310 - DNA, 20 bp, Mus musculus
aacacagaaaagctataaga

SEQ ID NO: 210311 - DNA, 23 bp, Mus musculus
ggtgaaccagcttctgtgtcctg

SEQ ID NO: 210312 - DNA, 23 bp, Mus musculus
tcactgtctgggattcatttcat

SEQ ID NO: 210313 - DNA, 23 bp, Mus musculus
atcttacagaacagtgtgtggtc

SEQ ID NO: 210314 - DNA, 21 bp, Mus musculus
catatcactctgaaaggttac

SEQ ID NO: 210315 - DNA, 22 bp, Mus musculus
tacttggccctttatgaagtct

SEQ ID NO: 210316 - DNA, 22 bp, Mus musculus
tgttttgtgaccaattatatgg

SEQ ID NO: 210317 - DNA, 20 bp, Mus musculus
actgaggtagctgtctgtct

SEQ ID NO: 210318 - DNA, 20 bp, Mus musculus
tatggagatgtagatggtga

SEQ ID NO: 210319 - DNA, 23 bp, Mus musculus
ttggttatgtgagtgctcgcatg

SEQ ID NO: 210320 - DNA, 23 bp, Mus musculus
tttaatgcacattaacaatatct

SEQ ID NO: 210321 - DNA, 23 bp, Mus musculus
gtggctgtgtgtctgcctcactg

SEQ ID NO: 210322 - DNA, 23 bp, Mus musculus
ctggctctctcactctcaagcct

SEQ ID NO: 210323 - DNA, 22 bp, Mus musculus
tgttttgtgaccaattatatgg

SEQ ID NO: 210324 - DNA, 22 bp, Mus musculus
tgttttgtgaccaattatatgg

SEQ ID NO: 210325 - DNA, 22 bp, Mus musculus
tgttttgatgcatgtatgtatg

SEQ ID NO: 210326 - DNA, 23 bp, Mus musculus
tttactacatgcatgctttgtgc

SEQ ID NO: 210327 - DNA, 23 bp, Mus musculus
aaagtgttctgtgtttgctgatg

SEQ ID NO: 210328 - DNA, 19 bp, Mus musculus
aacacacacatatatatat

SEQ ID NO: 210329 - DNA, 23 bp, Mus musculus
gtgtgtgtgcatgtgtatacctg

SEQ ID NO: 210330 - DNA, 23 bp, Mus musculus
atgtatatgtatatgtatatgta

SEQ ID NO: 210331 - DNA, 23 bp, Mus musculus
tcacagaccaaagagagcagtta

SEQ ID NO: 210332 - DNA, 19 bp, Mus musculus
tgtgtggacagagtgagca

SEQ ID NO: 210333 - DNA, 22 bp, Mus musculus
ttgggtctggaagttttaactg

SEQ ID NO: 210334 - DNA, 23 bp, Mus musculus
tgtgtgtctatgtgtgtctgtgt

SEQ ID NO: 210335 - DNA, 23 bp, Mus musculus
taacacagtgatcagagacaccg

SEQ ID NO: 210336 - DNA, 22 bp, Mus musculus
aatgttgttgtagcagccatga

SEQ ID NO: 210337 - DNA, 23 bp, Mus musculus
tctctatctctgtctgcctgtct

SEQ ID NO: 210338 - DNA, 23 bp, Mus musculus
aacacaggctgactcaatgcctc

SEQ ID NO: 210339 - DNA, 19 bp, Mus musculus
tgcattcaaagaaaacagc

SEQ ID NO: 210340 - DNA, 23 bp, Mus musculus
tatcatgatagagactgagctga

SEQ ID NO: 210341 - DNA, 23 bp, Mus musculus
gactcacatcaggcttgtgtcag

SEQ ID NO: 210342 - DNA, 21 bp, Mus musculus
tttttcatagaaaagatacga

SEQ ID NO: 210343 - DNA, 18 bp, Mus musculus
aggaaagtaattgatttg

SEQ ID NO: 210344 - DNA, 22 bp, Mus musculus
agaggcagttggatctatagat

SEQ ID NO: 210345 - DNA, 23 bp, Mus musculus
tgtatatgagtgtgtatatgtat

SEQ ID NO: 210346 - DNA, 20 bp, Mus musculus
tacagagcaagggtagcatg

SEQ ID NO: 210347 - DNA, 22 bp, Mus musculus
tgttttgtgaccaattatatgg

SEQ ID NO: 210348 - DNA, 23 bp, Mus musculus
cctccctgagagcctgtctgggc

SEQ ID NO: 210349 - DNA, 23 bp, Mus musculus
accagactggttgtcatctcagg

SEQ ID NO: 210350 - DNA, 23 bp, Mus musculus
atttagtgtgcatgtattctggt

SEQ ID NO: 210351 - DNA, 18 bp, Mus musculus
tgactgactactatagat

SEQ ID NO: 210352 - DNA, 23 bp, Mus musculus
tagtccatggtgatctgatagga

SEQ ID NO: 210353 - DNA, 23 bp, Mus musculus
tatatatatatgtgtgtgtgtga

SEQ ID NO: 210354 - DNA, 22 bp, Mus musculus
atgtgcattttctatgttttta

SEQ ID NO: 210355 - DNA, 22 bp, Mus musculus
tttaattgagaatttggagaag

SEQ ID NO: 210356 - DNA, 22 bp, Mus musculus
tgttttgtgaccaattatatgg

SEQ ID NO: 210357 - DNA, 22 bp, Mus musculus
tgtcaccctttcattacagatt

SEQ ID NO: 210358 - DNA, 22 bp, Mus musculus
tgttttgtgaccaattatatgg

SEQ ID NO: 210359 - DNA, 22 bp, Mus musculus
tgttttgtgaccaattatatgg

SEQ ID NO: 210360 - DNA, 23 bp, Mus musculus
ggttgcaggtgagcaagggtcag

SEQ ID NO: 210361 - DNA, 22 bp, Mus musculus
cacagttctgacagtgcacagc

SEQ ID NO: 210362 - DNA, 21 bp, Mus musculus
gagctttagggtttcaaatgt

SEQ ID NO: 210363 - DNA, 23 bp, Mus musculus
cagaaagaccacatcccagtacc

SEQ ID NO: 210364 - DNA, 22 bp, Mus musculus
tgttttgtgaccaattatatgg

SEQ ID NO: 210365 - DNA, 23 bp, Mus musculus
ggaagagaagtgagtcaggtcta

SEQ ID NO: 210366 - DNA, 23 bp, Mus musculus
tgtcagtataaggtagagttcag

SEQ ID NO: 210367 - DNA, 23 bp, Mus musculus
tataagcaggaatatgtatattt

SEQ ID NO: 210368 - DNA, 23 bp, Mus musculus
tgtctcagtgtgagtatgaagac

SEQ ID NO: 210369 - DNA, 23 bp, Mus musculus
ttccagctttagaattgataatc

SEQ ID NO: 210370 - DNA, 23 bp, Mus musculus
gtatgtatgtatgtgtgtatgtg

SEQ ID NO: 210371 - DNA, 23 bp, Mus musculus
tgtatgcatgcatgtgtgtatgt

SEQ ID NO: 210372 - DNA, 21 bp, Mus musculus
atgtatgtatgcatgtgtgtg

SEQ ID NO: 210373 - DNA, 23 bp, Mus musculus
atactctctgtttatcactgaag

SEQ ID NO: 210374 - DNA, 21 bp, Mus musculus
gtgtgggtgagacaggccctg

SEQ ID NO: 210375 - DNA, 21 bp, Mus musculus
atcttgtccttttgttaaagt

SEQ ID NO: 210376 - DNA, 18 bp, Mus musculus
cactgggaaagtacagag

SEQ ID NO: 210377 - DNA, 20 bp, Mus musculus
ggaatgttgaagaattagga

SEQ ID NO: 210378 - DNA, 23 bp, Mus musculus
cacaagtgttttctaaggttgta

SEQ ID NO: 210379 - DNA, 23 bp, Mus musculus
tgtgtgcctgtgtgtgcctgtgc

SEQ ID NO: 210380 - DNA, 22 bp, Mus musculus
tactcacacacactgtgtaaac

SEQ ID NO: 210381 - DNA, 22 bp, Mus musculus
tctttgagttaaaggctgtgtt

SEQ ID NO: 210382 - DNA, 21 bp, Mus musculus
tgtgttatggtttgttatgac

SEQ ID NO: 210383 - DNA, 23 bp, Mus musculus
atgaatatatgtatgtatatgta

SEQ ID NO: 210384 - DNA, 21 bp, Mus musculus
tctacatatatatacatatat

SEQ ID NO: 210385 - DNA, 20 bp, Mus musculus
tatgtgtgcaaagtatgtgt

SEQ ID NO: 210386 - DNA, 22 bp, Mus musculus
atatctctgtgtgtatatgtgt

SEQ ID NO: 210387 - DNA, 22 bp, Mus musculus
tactgcttttaatattctgtct

SEQ ID NO: 210388 - DNA, 23 bp, Mus musculus
ctggaacagtctatttggagttc

SEQ ID NO: 210389 - DNA, 20 bp, Mus musculus
tatggtgatctgataggatg

SEQ ID NO: 210390 - DNA, 22 bp, Mus musculus
atatatgtatatgtatatgtat

SEQ ID NO: 210391 - DNA, 22 bp, Mus musculus
ttaagtacagtatttgaagttg

SEQ ID NO: 210392 - DNA, 23 bp, Mus musculus
acacatgagtgtgtggtcagagg

SEQ ID NO: 210393 - DNA, 23 bp, Mus musculus
gtgctttcagtcaccgctgatcg

SEQ ID NO: 210394 - DNA, 23 bp, Mus musculus
tgaagtagctcagcccttctgct

SEQ ID NO: 210395 - DNA, 23 bp, Mus musculus
cagtcactgtgagtgtggctgtt

SEQ ID NO: 210396 - DNA, 22 bp, Mus musculus
actcagctggttgacttggggt

SEQ ID NO: 210397 - DNA, 18 bp, Mus musculus
gtgcagccatttcccact

SEQ ID NO: 210398 - DNA, 23 bp, Mus musculus
ctgtctgagattggtgttcttgt

SEQ ID NO: 210399 - DNA, 21 bp, Mus musculus
tatatgtatatatgcatgtgt

SEQ ID NO: 210400 - DNA, 23 bp, Mus musculus
gttttctatgctttgtgtgtgtg

SEQ ID NO: 210401 - DNA, 23 bp, Mus musculus
tatgtgtgtacattacatgtgta

SEQ ID NO: 210402 - DNA, 22 bp, Mus musculus
tttctgctccacactttgtctc

SEQ ID NO: 210403 - DNA, 22 bp, Mus musculus
gttgcacatactgattttgctg

SEQ ID NO: 210404 - DNA, 23 bp, Mus musculus
caattcctgctttttcttctgca

SEQ ID NO: 210405 - DNA, 23 bp, Mus musculus
tatggaaaagttcctgtatgaaa

SEQ ID NO: 210406 - DNA, 23 bp, Mus musculus
atgtatgtatgtatgtatgtatg

SEQ ID NO: 210407 - DNA, 23 bp, Mus musculus
acacacaacattgtgtgcatgtg

SEQ ID NO: 210408 - DNA, 23 bp, Mus musculus
cttctgacaggctctttcactga

SEQ ID NO: 210409 - DNA, 22 bp, Mus musculus
tatgacctggctggtgttcctg

SEQ ID NO: 210410 - DNA, 23 bp, Mus musculus
aagagcactgactgctcttccag

SEQ ID NO: 210411 - DNA, 23 bp, Mus musculus
ggaagagcagtcagtgctcggtt

SEQ ID NO: 210412 - DNA, 22 bp, Mus musculus
tgttttgtgaccaattatatgg

SEQ ID NO: 210413 - DNA, 23 bp, Mus musculus
attggagctgagaggctctctct

SEQ ID NO: 210414 - DNA, 23 bp, Mus musculus
aggatggctgagaggttggctgg

SEQ ID NO: 210415 - DNA, 22 bp, Mus musculus
ttcaggctctcagtctctctgt

SEQ ID NO: 210416 - DNA, 23 bp, Mus musculus
tgcctctctgtgtctcacttgaa

SEQ ID NO: 210417 - DNA, 23 bp, Mus musculus
agatgtgagtgtctcagtctgtg

SEQ ID NO: 210418 - DNA, 23 bp, Mus musculus
tatatgaatatctatatgtctgt

SEQ ID NO: 210419 - DNA, 23 bp, Mus musculus
atgtctgcctgtctgactggctc

SEQ ID NO: 210420 - DNA, 18 bp, Mus musculus
tcactctgagctggttct

SEQ ID NO: 210421 - DNA, 23 bp, Mus musculus
agaactcagtgagctaatgtgca

SEQ ID NO: 210422 - DNA, 21 bp, Mus musculus
aggtggataagacagaggtat

SEQ ID NO: 210423 - DNA, 23 bp, Mus musculus
tgtctgtctgtctgtctgtctgt

SEQ ID NO: 210424 - DNA, 23 bp, Mus musculus
gtctgcctggctctgtctctcgg

SEQ ID NO: 210425 - DNA, 23 bp, Mus musculus
agagagtgtgtgaagagtgtctg

SEQ ID NO: 210426 - DNA, 19 bp, Mus musculus
tgctcacttctgatggatc

SEQ ID NO: 210427 - DNA, 22 bp, Mus musculus
atggcactgctaattatgaatc

SEQ ID NO: 210428 - DNA, 23 bp, Mus musculus
tgtgtcactcagtgtgtgctcgc

SEQ ID NO: 210429 - DNA, 21 bp, Mus musculus
aggaaaggtgagtagagatgc

SEQ ID NO: 210430 - DNA, 22 bp, Mus musculus
aggcagtaggttgtattgtgaa

SEQ ID NO: 210431 - DNA, 23 bp, Mus musculus
ctgtgtgtgtgcttgtgcatgtg

SEQ ID NO: 210432 - DNA, 20 bp, Mus musculus
tgccatgcatgtgtgtaagg

SEQ ID NO: 210433 - DNA, 23 bp, Mus musculus
gctctctgactcagtgacctgct

SEQ ID NO: 210434 - DNA, 22 bp, Mus musculus
tgtgcatatatgtacatatgta

SEQ ID NO: 210435 - DNA, 19 bp, Mus musculus
acatacatatgtatacata

SEQ ID NO: 210436 - DNA, 22 bp, Mus musculus
tcacacactcatgcctgccttt

SEQ ID NO: 210437 - DNA, 23 bp, Mus musculus
ttgttcatgtgcacatgcatgtg

SEQ ID NO: 210438 - DNA, 22 bp, Mus musculus
ttgtatgtgtgcatgtgcatgc

SEQ ID NO: 210439 - DNA, 22 bp, Mus musculus
agacacacacatatatatgtgt

SEQ ID NO: 210440 - DNA, 21 bp, Mus musculus
tatgtgtgtgtgtatgtgcat

SEQ ID NO: 210441 - DNA, 21 bp, Mus musculus
tgacagaactgagtgggctct

SEQ ID NO: 210442 - DNA, 23 bp, Mus musculus
agagacatgtctgattctgtgct

SEQ ID NO: 210443 - DNA, 23 bp, Mus musculus
gcctcacacactccctctctgat

SEQ ID NO: 210444 - DNA, 21 bp, Mus musculus
tatcacaagtcagtgaccact

SEQ ID NO: 210445 - DNA, 21 bp, Mus musculus
gagtatgtggctgacggtgtg

SEQ ID NO: 210446 - DNA, 20 bp, Mus musculus
acagagcacagtgagcacac

SEQ ID NO: 210447 - DNA, 21 bp, Mus musculus
tgaagctgggagctagatcta

SEQ ID NO: 210448 - DNA, 23 bp, Mus musculus
gagtctcccagtctgtggtgttt

SEQ ID NO: 210449 - DNA, 21 bp, Mus musculus
ctgagactcctgactctgcag

SEQ ID NO: 210450 - DNA, 18 bp, Mus musculus
aaaggttctgagttcaaa

SEQ ID NO: 210451 - DNA, 20 bp, Mus musculus
agagttgatgcacagatgat

SEQ ID NO: 210452 - DNA, 21 bp, Mus musculus
cacagctttcttgctctgtgg

SEQ ID NO: 210453 - DNA, 23 bp, Mus musculus
tgtccctctctgcctgtgacctt

SEQ ID NO: 210454 - DNA, 21 bp, Mus musculus
gtactgactgtactgtgtctg

SEQ ID NO: 210455 - DNA, 23 bp, Mus musculus
agcttctgtgtgtctgtctgagt

SEQ ID NO: 210456 - DNA, 20 bp, Mus musculus
tgcatgatagtagctaagga

SEQ ID NO: 210457 - DNA, 23 bp, Mus musculus
tatgtgtgcatgtgaatctttgt

SEQ ID NO: 210458 - DNA, 22 bp, Mus musculus
tagaaagtatacatgtatatgc

SEQ ID NO: 210459 - DNA, 19 bp, Mus musculus
gaagagtttgtggattgat

SEQ ID NO: 210460 - DNA, 23 bp, Mus musculus
ctccacctctggctctcttcagt

SEQ ID NO: 210461 - DNA, 23 bp, Mus musculus
agatcagccttagtttgtggtga

SEQ ID NO: 210462 - DNA, 23 bp, Mus musculus
actgacagcttgttgatttctgt

SEQ ID NO: 210463 - DNA, 22 bp, Mus musculus
agagactgaccactgttgggac

SEQ ID NO: 210464 - DNA, 23 bp, Mus musculus
acatgtgtgtgtgcctgtgcatg

SEQ ID NO: 210465 - DNA, 18 bp, Mus musculus
acctccattaattttgag

SEQ ID NO: 210466 - DNA, 22 bp, Mus musculus
acacacacgtagatatgtgaac

SEQ ID NO: 210467 - DNA, 22 bp, Mus musculus
agaatccagaagaagaagctca

SEQ ID NO: 210468 - DNA, 23 bp, Mus musculus
gttctgtctctgtctctccgact

SEQ ID NO: 210469 - DNA, 18 bp, Mus musculus
tctctgaacaaaggattg

SEQ ID NO: 210470 - DNA, 23 bp, Mus musculus
tgtgtctgtgtgtatatatgtat

SEQ ID NO: 210471 - DNA, 18 bp, Mus musculus
atggaacttcacaatgga

SEQ ID NO: 210472 - DNA, 23 bp, Mus musculus
atgtatgaatgtgtggatgtgct

SEQ ID NO: 210473 - DNA, 23 bp, Mus musculus
ggtgatcacttggagtattgtat

SEQ ID NO: 210474 - DNA, 23 bp, Mus musculus
ctgctacctactctgtctgactg

SEQ ID NO: 210475 - DNA, 21 bp, Mus musculus
tgagtctgactcactctcgtt

SEQ ID NO: 210476 - DNA, 19 bp, Mus musculus
gagagaagggactgtcctc

SEQ ID NO: 210477 - DNA, 18 bp, Mus musculus
ctgtcacttttctatgtg

SEQ ID NO: 210478 - DNA, 19 bp, Mus musculus
tgagtgtggagggttagag

SEQ ID NO: 210479 - DNA, 23 bp, Mus musculus
tctgtcccttcactctgtcaatc

SEQ ID NO: 210480 - DNA, 22 bp, Mus musculus
aatcagactgagctatgcatta

SEQ ID NO: 210481 - DNA, 22 bp, Mus musculus
ctatctgtctcagtttctcaca

SEQ ID NO: 210482 - DNA, 19 bp, Mus musculus
tatgtgctagtattgagct

SEQ ID NO: 210483 - DNA, 20 bp, Mus musculus
tgacagaagacagacaggac

SEQ ID NO: 210484 - DNA, 23 bp, Mus musculus
tctgtctgtctgtctgtgcggcc

SEQ ID NO: 210485 - DNA, 22 bp, Mus musculus
gtaatcccatggctatgtcaca

SEQ ID NO: 210486 - DNA, 22 bp, Mus musculus
ttttatgtgcatgaatgttttg

SEQ ID NO: 210487 - DNA, 22 bp, Mus musculus
tgttttgtgaccaattatatgg

SEQ ID NO: 210488 - DNA, 18 bp, Mus musculus
gtgaagtgtcagtggact

SEQ ID NO: 210489 - DNA, 23 bp, Mus musculus
tctgtctgtctgtctacctcttt

SEQ ID NO: 210490 - DNA, 23 bp, Mus musculus
tttagacagtatgtagaatgctg

SEQ ID NO: 210491 - DNA, 21 bp, Mus musculus
tctcactggcactttcctgag

SEQ ID NO: 210492 - DNA, 20 bp, Mus musculus
tgctctcagatatcagagag

SEQ ID NO: 210493 - DNA, 22 bp, Mus musculus
tatttagtctgtagtgagttgc

SEQ ID NO: 210494 - DNA, 21 bp, Mus musculus
ttcgatgtgcaatatctaagt

SEQ ID NO: 210495 - DNA, 23 bp, Mus musculus
tgttacactgtctgatatcctcg

SEQ ID NO: 210496 - DNA, 23 bp, Mus musculus
agttacagacagttgtaaactgc

SEQ ID NO: 210497 - DNA, 20 bp, Mus musculus
atcatctctggctggtggtc

SEQ ID NO: 210498 - DNA, 23 bp, Mus musculus
tgtgtgtgtgtgtgcatgtgtat

SEQ ID NO: 210499 - DNA, 22 bp, Mus musculus
atgcgtgtgcatgtgtgtgagt

SEQ ID NO: 210500 - DNA, 23 bp, Mus musculus
caagacacactgagataggtgct

SEQ ID NO: 210501 - DNA, 23 bp, Mus musculus
ctctgtctgtctgtttgtctgtc

SEQ ID NO: 210502 - DNA, 23 bp, Mus musculus
gtatgtatgtatgtatgtatgta

SEQ ID NO: 210503 - DNA, 23 bp, Mus musculus
tctgcataagatgtacatgctat

SEQ ID NO: 210504 - DNA, 22 bp, Mus musculus
aggctctctgggtccctctcag

SEQ ID NO: 210505 - DNA, 22 bp, Mus musculus
tgttttgtgaccaattatatgg

SEQ ID NO: 210506 - DNA, 23 bp, Mus musculus
tgtgtctgtgtgtctatgtgtgt

SEQ ID NO: 210507 - DNA, 18 bp, Mus musculus
tgagatcctggagctgta

SEQ ID NO: 210508 - DNA, 18 bp, Mus musculus
agcacctggagttgtttc

SEQ ID NO: 210509 - DNA, 23 bp, Mus musculus
gaacagttgtatggaattatgtg

SEQ ID NO: 210510 - DNA, 23 bp, Mus musculus
tggctctcagagtcacaccctgt

SEQ ID NO: 210511 - DNA, 18 bp, Mus musculus
cagtgtgcctatgtagcc

SEQ ID NO: 210512 - DNA, 20 bp, Mus musculus
cagcttgttacacagtctct

SEQ ID NO: 210513 - DNA, 23 bp, Mus musculus
gtttctgaatctccaacactttg

SEQ ID NO: 210514 - DNA, 23 bp, Mus musculus
tgtctgtctcagtcagctgttgg

SEQ ID NO: 210515 - DNA, 23 bp, Mus musculus
tatatgtgcatgtgtatacatgt

SEQ ID NO: 210516 - DNA, 23 bp, Mus musculus
acactgagttttaattatgaact

SEQ ID NO: 210517 - DNA, 23 bp, Mus musculus
gggcctcagtgtgactctgtgta

SEQ ID NO: 210518 - DNA, 22 bp, Mus musculus
ttagagagagatttggcaaaga

SEQ ID NO: 210519 - DNA, 18 bp, Mus musculus
agactagactctctacca

SEQ ID NO: 210520 - DNA, 23 bp, Mus musculus
gtatgtatatatgtatatgtgtg

SEQ ID NO: 210521 - DNA, 21 bp, Mus musculus
atatgtacacacatatgtgta

SEQ ID NO: 210522 - DNA, 23 bp, Mus musculus
tgcctctggcactctctgggtga

SEQ ID NO: 210523 - DNA, 22 bp, Mus musculus
agtaggtggagagaaagataac

SEQ ID NO: 210524 - DNA, 23 bp, Mus musculus
tttatgaactttcaggatggtgg

SEQ ID NO: 210525 - DNA, 23 bp, Mus musculus
tgtggctgtctggctgtctgaga

SEQ ID NO: 210526 - DNA, 23 bp, Mus musculus
tgtgcatgtgcttgtgtgtgcct

SEQ ID NO: 210527 - DNA, 23 bp, Mus musculus
atgtatgtgtgcatgtgcttgtg

SEQ ID NO: 210528 - DNA, 23 bp, Mus musculus
tgtgctgtcacagctcttgtctc

SEQ ID NO: 210529 - DNA, 23 bp, Mus musculus
tatgtatgtatgtgtgtacatag

SEQ ID NO: 210530 - DNA, 23 bp, Mus musculus
tatagtacacattgcattagaat

SEQ ID NO: 210531 - DNA, 23 bp, Mus musculus
aggagggcacagagagtgttcac

SEQ ID NO: 210532 - DNA, 21 bp, Mus musculus
tctggatgctagtgactgtct

SEQ ID NO: 210533 - DNA, 18 bp, Mus musculus
tttgaactgatgaccctc

SEQ ID NO: 210534 - DNA, 23 bp, Mus musculus
agtcactgtgaacaccttgggat

SEQ ID NO: 210535 - DNA, 23 bp, Mus musculus
tgctcatacatgtatgagtggag

SEQ ID NO: 210536 - DNA, 21 bp, Mus musculus
agtgtctggcagagatgaggc

SEQ ID NO: 210537 - DNA, 18 bp, Mus musculus
tgctgtctctccattgag

SEQ ID NO: 210538 - DNA, 22 bp, Mus musculus
agagatctgagtctgttgttct

SEQ ID NO: 210539 - DNA, 22 bp, Mus musculus
tggcagtctgcttttctcatgt

SEQ ID NO: 210540 - DNA, 22 bp, Mus musculus
agagtctcaggacttgttagtg

SEQ ID NO: 210541 - DNA, 22 bp, Mus musculus
ttttctgtccaagagaatgggg

SEQ ID NO: 210542 - DNA, 23 bp, Mus musculus
actgactgactgactgactgact

SEQ ID NO: 210543 - DNA, 23 bp, Mus musculus
tatgtctgtgcatatgtatgtgc

SEQ ID NO: 210544 - DNA, 22 bp, Mus musculus
tgttttgtgaccaattatatgg

SEQ ID NO: 210545 - DNA, 23 bp, Mus musculus
tcagtgtcacagtggtagccagt

SEQ ID NO: 210546 - DNA, 18 bp, Mus musculus
ttagcttagtagaatgta

SEQ ID NO: 210547 - DNA, 22 bp, Mus musculus
tgttttgtgaccaattatatgg

SEQ ID NO: 210548 - DNA, 22 bp, Mus musculus
tgttttgtgaccaattatatgg

SEQ ID NO: 210549 - DNA, 20 bp, Mus musculus
aagtttctgtaggcatgtgt

SEQ ID NO: 210550 - DNA, 23 bp, Mus musculus
aatacagagaactcactgaggtc

SEQ ID NO: 210551 - DNA, 23 bp, Mus musculus
ctttgagaaaagagactgtggtc

SEQ ID NO: 210552 - DNA, 22 bp, Mus musculus
tgttttgtgaccaattatatgg

SEQ ID NO: 210553 - DNA, 22 bp, Mus musculus
ttgaggaactgttgcaataaac

SEQ ID NO: 210554 - DNA, 21 bp, Mus musculus
tcacatgatccttgtatcagg

SEQ ID NO: 210555 - DNA, 20 bp, Mus musculus
tatgcatctgtatatgtatg

SEQ ID NO: 210556 - DNA, 22 bp, Mus musculus
tgttttgtgaccaattatatgg

SEQ ID NO: 210557 - DNA, 23 bp, Mus musculus
tatttgtttctggttgtggtcag

SEQ ID NO: 210558 - DNA, 23 bp, Mus musculus
ctgtgactcagtgtctctgtgtt

SEQ ID NO: 210559 - DNA, 23 bp, Mus musculus
aatgcagtcttctgtctctgtaa

SEQ ID NO: 210560 - DNA, 23 bp, Mus musculus
tgtctctgtgccaatactatgtg

SEQ ID NO: 210561 - DNA, 23 bp, Mus musculus
ctttgtagtacagcttgaggtca

SEQ ID NO: 210562 - DNA, 22 bp, Mus musculus
aattcaggcagtcaagcttggt

SEQ ID NO: 210563 - DNA, 23 bp, Mus musculus
tctgcatctttcttgttgtgtga

SEQ ID NO: 210564 - DNA, 23 bp, Mus musculus
tttctctctctgcttatcatcag

SEQ ID NO: 210565 - DNA, 23 bp, Mus musculus
agactgtactttgagaggtcttg

SEQ ID NO: 210566 - DNA, 22 bp, Mus musculus
ataacaccaggtccttaggagt

SEQ ID NO: 210567 - DNA, 23 bp, Mus musculus
gtcagacacatgagtctgaggag

SEQ ID NO: 210568 - DNA, 23 bp, Mus musculus
ggaagagaggaacagtcagggat

SEQ ID NO: 210569 - DNA, 19 bp, Mus musculus
cacaggagtgggggtgctg

SEQ ID NO: 210570 - DNA, 20 bp, Mus musculus
atggttgatgacattgaggt

SEQ ID NO: 210571 - DNA, 23 bp, Mus musculus
tcacactcagtctgtactatggg

SEQ ID NO: 210572 - DNA, 20 bp, Mus musculus
taacagcagtttcaatatgg

SEQ ID NO: 210573 - DNA, 23 bp, Mus musculus
tgtagagagtgtacagactcagc

SEQ ID NO: 210574 - DNA, 23 bp, Mus musculus
ttaatgtgtgcatatttaggcat

SEQ ID NO: 210575 - DNA, 23 bp, Mus musculus
aaaggtaagaaggaagactcatg

SEQ ID NO: 210576 - DNA, 23 bp, Mus musculus
atgtatgtatagatgtatgtatg

SEQ ID NO: 210577 - DNA, 23 bp, Mus musculus
tgtatgcatgcatgtatgtgtgt

SEQ ID NO: 210578 - DNA, 22 bp, Mus musculus
tagtgctacaataagcttgcat

SEQ ID NO: 210579 - DNA, 19 bp, Mus musculus
taacaaggtcatagtctag

SEQ ID NO: 210580 - DNA, 23 bp, Mus musculus
acactggcactagaaggcttact

SEQ ID NO: 210581 - DNA, 23 bp, Mus musculus
tctgtgactctctttgaccagtg

SEQ ID NO: 210582 - DNA, 23 bp, Mus musculus
agactctcttttgagtacctcat

SEQ ID NO: 210583 - DNA, 22 bp, Mus musculus
tattaatgtttactctcagaga

SEQ ID NO: 210584 - DNA, 23 bp, Mus musculus
tcctccaatgctgctgtgtctct

SEQ ID NO: 210585 - DNA, 23 bp, Mus musculus
tttttgcatatctagctctacta

SEQ ID NO: 210586 - DNA, 23 bp, Mus musculus
atgtatatatacatatgtgtgtg

SEQ ID NO: 210587 - DNA, 22 bp, Mus musculus
tggtgtgaatgtacatatgagt

SEQ ID NO: 210588 - DNA, 20 bp, Mus musculus
tgtctggttcataaactcag

SEQ ID NO: 210589 - DNA, 23 bp, Mus musculus
gagagaagacactgcctgaagta

SEQ ID NO: 210590 - DNA, 23 bp, Mus musculus
ctcactctgtttgtctgtgcatt

SEQ ID NO: 210591 - DNA, 23 bp, Mus musculus
acacagaacagagagtcctgagt

SEQ ID NO: 210592 - DNA, 21 bp, Mus musculus
tccatttccatccctgtaatt

SEQ ID NO: 210593 - DNA, 20 bp, Mus musculus
tgccagaagatagagaggac

SEQ ID NO: 210594 - DNA, 23 bp, Mus musculus
tacactgctacatttgtgaactt

SEQ ID NO: 210595 - DNA, 18 bp, Mus musculus
atgcacatacacacacat

SEQ ID NO: 210596 - DNA, 22 bp, Mus musculus
tatgtgtgtgtgtatgcatgtg

SEQ ID NO: 210597 - DNA, 20 bp, Mus musculus
actaatgctgtttcagaaac

SEQ ID NO: 210598 - DNA, 23 bp, Mus musculus
ttccatccagagactgtcagctc

SEQ ID NO: 210599 - DNA, 23 bp, Mus musculus
tgtagtctcaaggtggaagctag

SEQ ID NO: 210600 - DNA, 23 bp, Mus musculus
tccatgtgtagactccagactgc

SEQ ID NO: 210601 - DNA, 18 bp, Mus musculus
cctgactggctctcactg

SEQ ID NO: 210602 - DNA, 23 bp, Mus musculus
agatgagagggagcacaggttgt

SEQ ID NO: 210603 - DNA, 23 bp, Mus musculus
agtgggaagtctgagacttcttg

SEQ ID NO: 210604 - DNA, 23 bp, Mus musculus
tgtgagtatatgtatatataggt

SEQ ID NO: 210605 - DNA, 23 bp, Mus musculus
tatgcacaggtatatatgtcttt

SEQ ID NO: 210606 - DNA, 21 bp, Mus musculus
tataggtatatatgtatatgt

SEQ ID NO: 210607 - DNA, 23 bp, Mus musculus
tatatgtgtatatgtatatgtat

SEQ ID NO: 210608 - DNA, 23 bp, Mus musculus
tatgtacatgtaaagatatgtat

SEQ ID NO: 210609 - DNA, 23 bp, Mus musculus
tctagcagttactcactctcaca

SEQ ID NO: 210610 - DNA, 23 bp, Mus musculus
ccaatctctgtctctgtcactcc

SEQ ID NO: 210611 - DNA, 21 bp, Mus musculus
caatccagtttttccagtatc

SEQ ID NO: 210612 - DNA, 23 bp, Mus musculus
gagcagtgagtgtatgtgctgag

SEQ ID NO: 210613 - DNA, 23 bp, Mus musculus
tgtatgtgtgcatgtgtgtgtgt

SEQ ID NO: 210614 - DNA, 20 bp, Mus musculus
gtatgtatgcatgtgtgtgc

SEQ ID NO: 210615 - DNA, 23 bp, Mus musculus
tgtgcatgtgtgtgtgtgcatgt

SEQ ID NO: 210616 - DNA, 23 bp, Mus musculus
tgtgtgtgtgtgagtgcgcatgt

SEQ ID NO: 210617 - DNA, 22 bp, Mus musculus
tgttttgtgaccaattatatgg

SEQ ID NO: 210618 - DNA, 23 bp, Mus musculus
atttcttagcacacactctctct

SEQ ID NO: 210619 - DNA, 20 bp, Mus musculus
tgaggttttggaggtgaact

SEQ ID NO: 210620 - DNA, 23 bp, Mus musculus
tgtgtgtatgtgtgtatgcaggt

SEQ ID NO: 210621 - DNA, 21 bp, Mus musculus
agtgctagaaggttctatgag

SEQ ID NO: 210622 - DNA, 23 bp, Mus musculus
ctgcctcagcctctgactcactt

SEQ ID NO: 210623 - DNA, 22 bp, Mus musculus
agagagctccttgttgatgagc

SEQ ID NO: 210624 - DNA, 20 bp, Mus musculus
gacattgtcttttgcatggt

SEQ ID NO: 210625 - DNA, 23 bp, Mus musculus
ttcctcagtgtctctctttgtgg

SEQ ID NO: 210626 - DNA, 23 bp, Mus musculus
tcagaaatctgtctgtctctgcc

SEQ ID NO: 210627 - DNA, 22 bp, Mus musculus
atagaccttgctttttcactct

SEQ ID NO: 210628 - DNA, 23 bp, Mus musculus
aatgaagaagatgggctggagag

SEQ ID NO: 210629 - DNA, 23 bp, Mus musculus
tgtgtgtatatatatgtgtgtgt

SEQ ID NO: 210630 - DNA, 23 bp, Mus musculus
tgagagatgagactgaggagagg

SEQ ID NO: 210631 - DNA, 23 bp, Mus musculus
tgtatgtgtacatgtgcatgtgt

SEQ ID NO: 210632 - DNA, 20 bp, Mus musculus
tctatgtttctgtgtgtata

SEQ ID NO: 210633 - DNA, 23 bp, Mus musculus
agtatagaagtttgcttttgggc

SEQ ID NO: 210634 - DNA, 23 bp, Mus musculus
tctgtctgtctgtctgtctgtct

SEQ ID NO: 210635 - DNA, 22 bp, Mus musculus
tgttttgtgaccaattatatgg

SEQ ID NO: 210636 - DNA, 23 bp, Mus musculus
tgtgtctctgtgtctctgtgtgt

SEQ ID NO: 210637 - DNA, 23 bp, Mus musculus
agttctgtttttcttgaaatgga

SEQ ID NO: 210638 - DNA, 22 bp, Mus musculus
tgttttgtgaccaattatatgg

SEQ ID NO: 210639 - DNA, 21 bp, Mus musculus
agagcaatcatcatttactac

SEQ ID NO: 210640 - DNA, 19 bp, Mus musculus
aaatgcagcaatatcattg

SEQ ID NO: 210641 - DNA, 23 bp, Mus musculus
gatgtgtataaatgatgaagtac

SEQ ID NO: 210642 - DNA, 23 bp, Mus musculus
aacagtgagttcagaaagagctg

SEQ ID NO: 210643 - DNA, 23 bp, Mus musculus
acagtgactgacagtggattggc

SEQ ID NO: 210644 - DNA, 23 bp, Mus musculus
tactgtgtcactcagtgtggtct

SEQ ID NO: 210645 - DNA, 22 bp, Mus musculus
agagagagagagcatgtagttg

SEQ ID NO: 210646 - DNA, 23 bp, Mus musculus
gtgtctgtgtctgtgtgttataa

SEQ ID NO: 210647 - DNA, 22 bp, Mus musculus
gcctgtctgcctgcctgcctgt

SEQ ID NO: 210648 - DNA, 23 bp, Mus musculus
tcagagagtattaaagatgtttt

SEQ ID NO: 210649 - DNA, 23 bp, Mus musculus
tggaacatttttgatgttgtagt

SEQ ID NO: 210650 - DNA, 20 bp, Mus musculus
taccatagacagacagctga

SEQ ID NO: 210651 - DNA, 20 bp, Mus musculus
tgtgtgtgtgtgtgtatata

SEQ ID NO: 210652 - DNA, 21 bp, Mus musculus
tatgtgtgtatatatgtgtgt

SEQ ID NO: 210653 - DNA, 19 bp, Mus musculus
agagacacagtgaagaagg

SEQ ID NO: 210654 - DNA, 23 bp, Mus musculus
tgtgtggctccctctctgacctg

SEQ ID NO: 210655 - DNA, 23 bp, Mus musculus
cattctcttctctctgtctcacc

SEQ ID NO: 210656 - DNA, 23 bp, Mus musculus
tgtcagcctctctgaatcttgtt

SEQ ID NO: 210657 - DNA, 23 bp, Mus musculus
atatgtatatatgtatgtgtgtg

SEQ ID NO: 210658 - DNA, 23 bp, Mus musculus
tctccatccctccctctgtctgt

SEQ ID NO: 210659 - DNA, 19 bp, Mus musculus
aagtggaaaatgatggcat

SEQ ID NO: 210660 - DNA, 23 bp, Mus musculus
cactctgtgtcacactgtgttct

SEQ ID NO: 210661 - DNA, 22 bp, Mus musculus
tctcagactcactgttaccttg

SEQ ID NO: 210662 - DNA, 19 bp, Mus musculus
atgtttaagaatagacttg

SEQ ID NO: 210663 - DNA, 23 bp, Mus musculus
ctcagtggatgctctatgactca

SEQ ID NO: 210664 - DNA, 23 bp, Mus musculus
gcctctgtctctgcctctgcctc

SEQ ID NO: 210665 - DNA, 20 bp, Mus musculus
tgtgagagctgacagacgtc

SEQ ID NO: 210666 - DNA, 18 bp, Mus musculus
acattgaagaaacttgga

SEQ ID NO: 210667 - DNA, 23 bp, Mus musculus
tgtgcatatgtattatatatgtg

SEQ ID NO: 210668 - DNA, 23 bp, Mus musculus
aaacagggtctgcttctccagac

SEQ ID NO: 210669 - DNA, 23 bp, Mus musculus
tgtgtatatgtatatatgcctgt

SEQ ID NO: 210670 - DNA, 23 bp, Mus musculus
tctctgactgactcactatgtac

SEQ ID NO: 210671 - DNA, 19 bp, Mus musculus
gcctgtctgtcagtgcctc

SEQ ID NO: 210672 - DNA, 23 bp, Mus musculus
caaagacagaagtgagtctgggc

SEQ ID NO: 210673 - DNA, 18 bp, Mus musculus
agcaactacatgatggct

SEQ ID NO: 210674 - DNA, 23 bp, Mus musculus
attgaggattagacatcctatgt

SEQ ID NO: 210675 - DNA, 21 bp, Mus musculus
ttctccaattcttgctaacag

SEQ ID NO: 210676 - DNA, 23 bp, Mus musculus
agagtagagagagagcagtgaca

SEQ ID NO: 210677 - DNA, 21 bp, Mus musculus
tatacacacatgtataaatgt

SEQ ID NO: 210678 - DNA, 23 bp, Mus musculus
gtaaaggttgatgtccataccat

SEQ ID NO: 210679 - DNA, 23 bp, Mus musculus
agagtgagagtttagagagtgag

SEQ ID NO: 210680 - DNA, 23 bp, Mus musculus
tcttatagtatttgaggttatgg

SEQ ID NO: 210681 - DNA, 21 bp, Mus musculus
tctgtggtgatctgataggat

SEQ ID NO: 210682 - DNA, 22 bp, Mus musculus
tgttttgttaccaattatatgg

SEQ ID NO: 210683 - DNA, 19 bp, Mus musculus
tagaggttcattagaaatg

SEQ ID NO: 210684 - DNA, 21 bp, Mus musculus
tgcatcatagtcaatgtcatc

SEQ ID NO: 210685 - DNA, 23 bp, Mus musculus
ttgacataggaaatgaaatgtta

SEQ ID NO: 210686 - DNA, 23 bp, Mus musculus
aagactaatgttagtgtcagagc

SEQ ID NO: 210687 - DNA, 23 bp, Mus musculus
tttagtggaagaaatagataggt

SEQ ID NO: 210688 - DNA, 23 bp, Mus musculus
tatctgtctctgctttttttaac

SEQ ID NO: 210689 - DNA, 23 bp, Mus musculus
aacagcactgactgctcttccag

SEQ ID NO: 210690 - DNA, 23 bp, Mus musculus
ctaggctttctctgatctcttgg

SEQ ID NO: 210691 - DNA, 23 bp, Mus musculus
aatgacagcattaatctctggct

SEQ ID NO: 210692 - DNA, 23 bp, Mus musculus
tttggatatatgcacatatgtga

SEQ ID NO: 210693 - DNA, 23 bp, Mus musculus
aatgtgtacttatgagtgtgcat

SEQ ID NO: 210694 - DNA, 23 bp, Mus musculus
ttgaaggactttttggtatagaa

SEQ ID NO: 210695 - DNA, 23 bp, Mus musculus
agggagtggtaacaaagtctctc

SEQ ID NO: 210696 - DNA, 23 bp, Mus musculus
tctgtctctctatgtttctgcat

SEQ ID NO: 210697 - DNA, 23 bp, Mus musculus
atacgtgtggttttcattttatg

SEQ ID NO: 210698 - DNA, 19 bp, Mus musculus
tgacagtcacagatgtgga

SEQ ID NO: 210699 - DNA, 23 bp, Mus musculus
caagccttcctcagtcatcttgg

SEQ ID NO: 210700 - DNA, 23 bp, Mus musculus
gagtccctgcgagcctcacttgt

SEQ ID NO: 210701 - DNA, 21 bp, Mus musculus
tgtgcctgtgtgagtgcctat

SEQ ID NO: 210702 - DNA, 18 bp, Mus musculus
gaggaaaatagatccttg

SEQ ID NO: 210703 - DNA, 23 bp, Mus musculus
agatgagagaagtttctgaacac

SEQ ID NO: 210704 - DNA, 23 bp, Mus musculus
tagtgcatggtgatctgatagga

SEQ ID NO: 210705 - DNA, 19 bp, Mus musculus
tttgtgacctattatgtgg

SEQ ID NO: 210706 - DNA, 23 bp, Mus musculus
ttgtcaatgcctgtacttagggg

SEQ ID NO: 210707 - DNA, 23 bp, Mus musculus
ttttctcagagttcagcatcttg

SEQ ID NO: 210708 - DNA, 20 bp, Mus musculus
tgtgtgtgtgtgtgcctgtg

SEQ ID NO: 210709 - DNA, 23 bp, Mus musculus
tatgtatggtagtatactgaaca

SEQ ID NO: 210710 - DNA, 18 bp, Mus musculus
tgcatatgtattcatgca

SEQ ID NO: 210711 - DNA, 22 bp, Mus musculus
ttctgtgtgcatgtgcatgtgc

SEQ ID NO: 210712 - DNA, 19 bp, Mus musculus
actgcttccagaatgacaa

SEQ ID NO: 210713 - DNA, 18 bp, Mus musculus
gtctgagtctctctctag

SEQ ID NO: 210714 - DNA, 23 bp, Mus musculus
tctatgtatgtatgtatatgtgt

SEQ ID NO: 210715 - DNA, 21 bp, Mus musculus
tatgtgcatttatatatgtgt

SEQ ID NO: 210716 - DNA, 22 bp, Mus musculus
atacagaaatacttttgatttt

SEQ ID NO: 210717 - DNA, 23 bp, Mus musculus
ctaaccttgaacatgcagtcctc

SEQ ID NO: 210718 - DNA, 20 bp, Mus musculus
tttcagaggcatctgttcag

SEQ ID NO: 210719 - DNA, 23 bp, Mus musculus
tgtgtgtctgtcagttgtgtatc

SEQ ID NO: 210720 - DNA, 18 bp, Mus musculus
agcatcttgaagctactg

SEQ ID NO: 210721 - DNA, 19 bp, Mus musculus
agaggaggtgtgttgttgg

SEQ ID NO: 210722 - DNA, 23 bp, Mus musculus
aggagagtgtgaactgagtgtga

SEQ ID NO: 210723 - DNA, 23 bp, Mus musculus
ctctgtcactggctcacttgtct

SEQ ID NO: 210724 - DNA, 21 bp, Mus musculus
ttttttcaacttgttacagca

SEQ ID NO: 210725 - DNA, 23 bp, Mus musculus
atgaagctagtttacaattccag

SEQ ID NO: 210726 - DNA, 22 bp, Mus musculus
tgaaactggcatagaattcact

SEQ ID NO: 210727 - DNA, 22 bp, Mus musculus
gacaggagagtgacaggagagg

SEQ ID NO: 210728 - DNA, 20 bp, Mus musculus
caggagagagagtgcagtga

SEQ ID NO: 210729 - DNA, 22 bp, Mus musculus
agtcaggcactctcagaaatct

SEQ ID NO: 210730 - DNA, 20 bp, Mus musculus
aaagcatgtagaatgaagaa

SEQ ID NO: 210731 - DNA, 21 bp, Mus musculus
tgtgtgtgtgtgtgcatgtac

SEQ ID NO: 210732 - DNA, 19 bp, Mus musculus
acagacagagagatagagg

SEQ ID NO: 210733 - DNA, 19 bp, Mus musculus
tagaaccattccatctcca

SEQ ID NO: 210734 - DNA, 21 bp, Mus musculus
aaagtgtacagtgtgtgctca

SEQ ID NO: 210735 - DNA, 23 bp, Mus musculus
aaaagtgacatgattgttttgag

SEQ ID NO: 210736 - DNA, 22 bp, Mus musculus
tgttttgtgaccaattatatgg

SEQ ID NO: 210737 - DNA, 22 bp, Mus musculus
tgttttgtgaccaattatatgg

SEQ ID NO: 210738 - DNA, 18 bp, Mus musculus
aagtcaaagcttggcctt

SEQ ID NO: 210739 - DNA, 23 bp, Mus musculus
atctcacagtgcctgttttaatt

SEQ ID NO: 210740 - DNA, 23 bp, Mus musculus
tcttactgcttaggttttgtcta

SEQ ID NO: 210741 - DNA, 23 bp, Mus musculus
attgtttttatacatatgtgaca

SEQ ID NO: 210742 - DNA, 23 bp, Mus musculus
tgttcatggcacagcctcagtct

SEQ ID NO: 210743 - DNA, 21 bp, Mus musculus
tgtgcatgcatgtgtgtgtgt

SEQ ID NO: 210744 - DNA, 23 bp, Mus musculus
gtgttcatgcatgtgtctgtgtg

SEQ ID NO: 210745 - DNA, 18 bp, Mus musculus
gaacagttttaaagattt

SEQ ID NO: 210746 - DNA, 23 bp, Mus musculus
tcaccatcatcatcttcttcatc

SEQ ID NO: 210747 - DNA, 21 bp, Mus musculus
aaaggaggatatgatgagaga

SEQ ID NO: 210748 - DNA, 23 bp, Mus musculus
tgtgcatgtgtcttgctcatgtg

SEQ ID NO: 210749 - DNA, 22 bp, Mus musculus
tctatctgtctctaattctctg

SEQ ID NO: 210750 - DNA, 18 bp, Mus musculus
tatgtacatgtgcgtgtg

SEQ ID NO: 210751 - DNA, 18 bp, Mus musculus
tatgtatgtatatatgtg

SEQ ID NO: 210752 - DNA, 23 bp, Mus musculus
ctcagacaagaatgcatcatgat

SEQ ID NO: 210753 - DNA, 23 bp, Mus musculus
ctgtgtgtgtgactcacaggctg

SEQ ID NO: 210754 - DNA, 23 bp, Mus musculus
tctgggtctctctgtgcctgagc

SEQ ID NO: 210755 - DNA, 23 bp, Mus musculus
acatccagtctcactcactgact

SEQ ID NO: 210756 - DNA, 23 bp, Mus musculus
tgagtatgtatgtgtgtgtgcgt

SEQ ID NO: 210757 - DNA, 22 bp, Mus musculus
atgtgtatatatgtatatgtgt

SEQ ID NO: 210758 - DNA, 23 bp, Mus musculus
tatgtgtgtatatgtattcgtgt

SEQ ID NO: 210759 - DNA, 20 bp, Mus musculus
agccccagtgattctcctgt

SEQ ID NO: 210760 - DNA, 23 bp, Mus musculus
cagagcagatgtttccatactct

SEQ ID NO: 210761 - DNA, 23 bp, Mus musculus
atctatctatgttgagggtgagt

SEQ ID NO: 210762 - DNA, 21 bp, Mus musculus
ttgaaagtagatgtggggatg

SEQ ID NO: 210763 - DNA, 23 bp, Mus musculus
ctctctcagtcagccagtctatt

SEQ ID NO: 210764 - DNA, 20 bp, Mus musculus
cctgagtgactttttttttt

SEQ ID NO: 210765 - DNA, 21 bp, Mus musculus
tttctgcaagagatatgtgtg

SEQ ID NO: 210766 - DNA, 23 bp, Mus musculus
ttcctgtcctacatgtagatatc

SEQ ID NO: 210767 - DNA, 23 bp, Mus musculus
cagtctctctgtgtgtatgggga

SEQ ID NO: 210768 - DNA, 23 bp, Mus musculus
aaatgggagagcaaggagttatc

SEQ ID NO: 210769 - DNA, 23 bp, Mus musculus
agctgtgtgtctctttctgttta

SEQ ID NO: 210770 - DNA, 23 bp, Mus musculus
ctactgtgtgtctgtgtgtgtcc

SEQ ID NO: 210771 - DNA, 23 bp, Mus musculus
tctggtagtactatgtccaagtt

SEQ ID NO: 210772 - DNA, 18 bp, Mus musculus
agactgctttccagagtg

SEQ ID NO: 210773 - DNA, 22 bp, Mus musculus
tgacagcagagagtgctctgag

SEQ ID NO: 210774 - DNA, 22 bp, Mus musculus
tgttttgtgaccaattatatgg

SEQ ID NO: 210775 - DNA, 22 bp, Mus musculus
tgttttgtgaccaattatatgg

SEQ ID NO: 210776 - DNA, 21 bp, Mus musculus
tgtcttggtgttcataaggga

SEQ ID NO: 210777 - DNA, 23 bp, Mus musculus
tggtcagtgttttagaacagtag

SEQ ID NO: 210778 - DNA, 23 bp, Mus musculus
tgtctgcctccctgtcaccattc

SEQ ID NO: 210779 - DNA, 23 bp, Mus musculus
agtctctctcattttgttttcta

SEQ ID NO: 210780 - DNA, 22 bp, Mus musculus
atttagagttgtttgctgtcag

SEQ ID NO: 210781 - DNA, 23 bp, Mus musculus
tttatgtggagttccttgatcca

SEQ ID NO: 210782 - DNA, 21 bp, Mus musculus
ttgagctttgtacaggggtat

SEQ ID NO: 210783 - DNA, 22 bp, Mus musculus
tggtttcagttttctttggttt

SEQ ID NO: 210784 - DNA, 23 bp, Mus musculus
agactgagagtggtaaaggagag

SEQ ID NO: 210785 - DNA, 22 bp, Mus musculus
ttctctgcatttagtttggtgt

SEQ ID NO: 210786 - DNA, 21 bp, Mus musculus
tatgtgtgtatatatatgtat

SEQ ID NO: 210787 - DNA, 23 bp, Mus musculus
tcagacatgacattttgaagttc

SEQ ID NO: 210788 - DNA, 22 bp, Mus musculus
tgttttgtgaccaattatatgg

SEQ ID NO: 210789 - DNA, 21 bp, Mus musculus
ctcacaagtgtgtctgcactc

SEQ ID NO: 210790 - DNA, 23 bp, Mus musculus
cagaatctgtgtcactctgcctg

SEQ ID NO: 210791 - DNA, 23 bp, Mus musculus
ggtctatgtctgtctgagtcagc

SEQ ID NO: 210792 - DNA, 21 bp, Mus musculus
tccagggactcacagttaaga

SEQ ID NO: 210793 - DNA, 23 bp, Mus musculus
ctaagaagagactgtggactttg

SEQ ID NO: 210794 - DNA, 23 bp, Mus musculus
tgtgtctctcagtgtgtgcatgt

SEQ ID NO: 210795 - DNA, 18 bp, Mus musculus
tatgcatgaaaacatgtg

SEQ ID NO: 210796 - DNA, 22 bp, Mus musculus
tgttttgtgaccaattatatgg

SEQ ID NO: 210797 - DNA, 23 bp, Mus musculus
tgtctgcctcagtgtgtgagata

SEQ ID NO: 210798 - DNA, 23 bp, Mus musculus
ttatcacaaatagaatatgtcag

SEQ ID NO: 210799 - DNA, 22 bp, Mus musculus
tatgtatgtatgtatatgtata

SEQ ID NO: 210800 - DNA, 23 bp, Mus musculus
tgaggttttctctttctaggtga

SEQ ID NO: 210801 - DNA, 22 bp, Mus musculus
tgttttgtgaccaattatatgg

SEQ ID NO: 210802 - DNA, 18 bp, Mus musculus
gctttagcttcagatgtc

SEQ ID NO: 210803 - DNA, 23 bp, Mus musculus
cgcattgtgtgtctcctaaggaa

SEQ ID NO: 210804 - DNA, 23 bp, Mus musculus
tctcgcagagaagcgtgtgagct

SEQ ID NO: 210805 - DNA, 23 bp, Mus musculus
cagagtgttctccatgtgttctg

SEQ ID NO: 210806 - DNA, 22 bp, Mus musculus
cagggtctctcactctctgtgc

SEQ ID NO: 210807 - DNA, 23 bp, Mus musculus
tgtgtctctgtgtctgtctgtct

SEQ ID NO: 210808 - DNA, 23 bp, Mus musculus
atgtcagaagagagagagtgaac

SEQ ID NO: 210809 - DNA, 23 bp, Mus musculus
acacacacacatatagaagaggg

SEQ ID NO: 210810 - DNA, 23 bp, Mus musculus
ctttgtgggtcacatatcagcta

SEQ ID NO: 210811 - DNA, 23 bp, Mus musculus
agggtggagaagagtaaggctgt

SEQ ID NO: 210812 - DNA, 23 bp, Mus musculus
aatctcctgctttttgatgtctt

SEQ ID NO: 210813 - DNA, 20 bp, Mus musculus
acactgaggaagccactttg

SEQ ID NO: 210814 - DNA, 22 bp, Mus musculus
tctgagtgacttaggacggaga

SEQ ID NO: 210815 - DNA, 21 bp, Mus musculus
tttgtccttcagtctctctga

SEQ ID NO: 210816 - DNA, 23 bp, Mus musculus
acagtgctcatgtgttaagactg

SEQ ID NO: 210817 - DNA, 22 bp, Mus musculus
tgttttgtgaccaattatatgg

SEQ ID NO: 210818 - DNA, 22 bp, Mus musculus
tgttttgtgaccaattatatgg

SEQ ID NO: 210819 - DNA, 22 bp, Mus musculus
tgttttgtgaccaattatatgg

SEQ ID NO: 210820 - DNA, 21 bp, Mus musculus
taaacaatgttgtgactgtga

SEQ ID NO: 210821 - DNA, 22 bp, Mus musculus
tgttttgtgaccaattatatgg

SEQ ID NO: 210822 - DNA, 21 bp, Mus musculus
aattggaaaaaatgctattct

SEQ ID NO: 210823 - DNA, 21 bp, Mus musculus
cagagctgttgtcagggtttg

SEQ ID NO: 210824 - DNA, 22 bp, Mus musculus
tcactgactcaagagactcagc

SEQ ID NO: 210825 - DNA, 21 bp, Mus musculus
actgcatccctgtctcctctc

SEQ ID NO: 210826 - DNA, 23 bp, Mus musculus
ttttagttgttgagtaagaacat

SEQ ID NO: 210827 - DNA, 22 bp, Mus musculus
tgcatatataattagtatgtat

SEQ ID NO: 210828 - DNA, 23 bp, Mus musculus
tatatagtatatatattagtgtg

SEQ ID NO: 210829 - DNA, 21 bp, Mus musculus
tccaattaaataggtattaga

SEQ ID NO: 210830 - DNA, 23 bp, Mus musculus
tcgtactctctctccctctttct

SEQ ID NO: 210831 - DNA, 23 bp, Mus musculus
tgtatatatgtatgtctgtgtgt

SEQ ID NO: 210832 - DNA, 22 bp, Mus musculus
agtatgcaagttgatgcattaa

SEQ ID NO: 210833 - DNA, 23 bp, Mus musculus
gatctgtattgattttcatgttg

SEQ ID NO: 210834 - DNA, 20 bp, Mus musculus
tctgcgtctctgtgtctctg

SEQ ID NO: 210835 - DNA, 23 bp, Mus musculus
atggtggtctgataggatgtatg

SEQ ID NO: 210836 - DNA, 22 bp, Mus musculus
tgttttgtgaccaattatatgg

SEQ ID NO: 210837 - DNA, 22 bp, Mus musculus
tgttttgtgaccaattatatgg

SEQ ID NO: 210838 - DNA, 22 bp, Mus musculus
tgttttgtgaccaattatatgg

SEQ ID NO: 210839 - DNA, 23 bp, Mus musculus
ggtccatggtgatcagataggat

SEQ ID NO: 210840 - DNA, 23 bp, Mus musculus
caatatttttgtatctgttgagg

SEQ ID NO: 210841 - DNA, 22 bp, Mus musculus
agacagaggacactctggtcag

SEQ ID NO: 210842 - DNA, 22 bp, Mus musculus
tgttttgtgaccaattatatgg

SEQ ID NO: 210843 - DNA, 23 bp, Mus musculus
tgtgtgtgtgtaacatagtagca

SEQ ID NO: 210844 - DNA, 23 bp, Mus musculus
gtccatggtggtctgataggatg

SEQ ID NO: 210845 - DNA, 23 bp, Mus musculus
ctttgagaggctcagtctctgtc

SEQ ID NO: 210846 - DNA, 18 bp, Mus musculus
tcacagtgagctctcagc

SEQ ID NO: 210847 - DNA, 22 bp, Mus musculus
gttctcaggcagtttctgtgtg

SEQ ID NO: 210848 - DNA, 20 bp, Mus musculus
actccaagagttagacatgt

SEQ ID NO: 210849 - DNA, 18 bp, Mus musculus
agagccttctgtctgaca

SEQ ID NO: 210850 - DNA, 23 bp, Mus musculus
ggctctctcagactcagtacttg

SEQ ID NO: 210851 - DNA, 23 bp, Mus musculus
tatatatgtgtggtatacatgag

SEQ ID NO: 210852 - DNA, 21 bp, Mus musculus
aacttgcaggagggagtctgc

SEQ ID NO: 210853 - DNA, 23 bp, Mus musculus
aatatgtacatatacatatgtgt

SEQ ID NO: 210854 - DNA, 22 bp, Mus musculus
agagattacagagagctcaaga

SEQ ID NO: 210855 - DNA, 22 bp, Mus musculus
aatcttggctctgaatttgtaa

SEQ ID NO: 210856 - DNA, 23 bp, Mus musculus
ttgtgtgtgtgtatacatgtaca

SEQ ID NO: 210857 - DNA, 21 bp, Mus musculus
tgggaacatgcaggctatact

SEQ ID NO: 210858 - DNA, 23 bp, Mus musculus
attgacacagagctatgaccgcc

SEQ ID NO: 210859 - DNA, 23 bp, Mus musculus
ttgtatctgagtgcttgccttca

SEQ ID NO: 210860 - DNA, 21 bp, Mus musculus
ttcacagtgcactcagggcct

SEQ ID NO: 210861 - DNA, 22 bp, Mus musculus
atctcacagacagctttagagt

SEQ ID NO: 210862 - DNA, 22 bp, Mus musculus
tgttttgtgaccaattatatgg

SEQ ID NO: 210863 - DNA, 23 bp, Mus musculus
ttcttgtactgtgtggaatagtt

SEQ ID NO: 210864 - DNA, 23 bp, Mus musculus
tggctgtctctctctccgtcttg

SEQ ID NO: 210865 - DNA, 20 bp, Mus musculus
tgcttgtatgtatgtatgta

SEQ ID NO: 210866 - DNA, 18 bp, Mus musculus
gatgtatgtatgtatgta

SEQ ID NO: 210867 - DNA, 23 bp, Mus musculus
tatgtatgtatatatgatgtata

SEQ ID NO: 210868 - DNA, 23 bp, Mus musculus
tttatgtatgtatgtatgtatgt

SEQ ID NO: 210869 - DNA, 23 bp, Mus musculus
tctcactgcctctgttgctgtga

SEQ ID NO: 210870 - DNA, 19 bp, Mus musculus
tcacagcctctgtcatcac

SEQ ID NO: 210871 - DNA, 19 bp, Mus musculus
gaaagtgcttctagtgttg

SEQ ID NO: 210872 - DNA, 18 bp, Mus musculus
tacaagttgtaggtcttg

SEQ ID NO: 210873 - DNA, 18 bp, Mus musculus
tcagtcctattgtgtctg

SEQ ID NO: 210874 - DNA, 22 bp, Mus musculus
ataagggtggttaacttggggt

SEQ ID NO: 210875 - DNA, 18 bp, Mus musculus
tctctcagtggtatggct

SEQ ID NO: 210876 - DNA, 23 bp, Mus musculus
catctgctctctcagactgtcac

SEQ ID NO: 210877 - DNA, 22 bp, Mus musculus
tgtttaggtgtgcatgtatgtg

SEQ ID NO: 210878 - DNA, 23 bp, Mus musculus
tgtgtgtgtgcatgtgcttgtgc

SEQ ID NO: 210879 - DNA, 23 bp, Mus musculus
ttttgcctgcatatgtatacata

SEQ ID NO: 210880 - DNA, 23 bp, Mus musculus
gaatatgtatatatgtatatcac

SEQ ID NO: 210881 - DNA, 19 bp, Mus musculus
gcatatgctggctcagctg

SEQ ID NO: 210882 - DNA, 18 bp, Mus musculus
ttgtcagttgaaagtctg

SEQ ID NO: 210883 - DNA, 22 bp, Mus musculus
agcacactgcatgagcactcag

SEQ ID NO: 210884 - DNA, 18 bp, Mus musculus
atgagaactcagcacact

SEQ ID NO: 210885 - DNA, 22 bp, Mus musculus
taaggcagtcttaggggtttgt

SEQ ID NO: 210886 - DNA, 22 bp, Mus musculus
tgttttgtgaccaattatatgg

SEQ ID NO: 210887 - DNA, 18 bp, Mus musculus
atgtatgtatgtatgtac

SEQ ID NO: 210888 - DNA, 23 bp, Mus musculus
tgtatgtatgtatgtatgtatgt

SEQ ID NO: 210889 - DNA, 21 bp, Mus musculus
tatatgtatatgtgtatatgt

SEQ ID NO: 210890 - DNA, 22 bp, Mus musculus
tgttttgtgaccaattatatgg

SEQ ID NO: 210891 - DNA, 22 bp, Mus musculus
tgttttgtgaccaattatatgg

SEQ ID NO: 210892 - DNA, 18 bp, Mus musculus
tcttatgattgtatatat

SEQ ID NO: 210893 - DNA, 23 bp, Mus musculus
gtatttcctagtacatgaaactg

SEQ ID NO: 210894 - DNA, 20 bp, Mus musculus
catatgtattcaagcatttt

SEQ ID NO: 210895 - DNA, 20 bp, Mus musculus
ttcagcttgttccttgtttt

SEQ ID NO: 210896 - DNA, 22 bp, Mus musculus
gagtgaactgtcatgcaaagaa

SEQ ID NO: 210897 - DNA, 22 bp, Mus musculus
atatgtatatgtatacgtatac

SEQ ID NO: 210898 - DNA, 23 bp, Mus musculus
tatatgtatatgtatatgtgaac

SEQ ID NO: 210899 - DNA, 23 bp, Mus musculus
tttgcttgttttacaacccttta

SEQ ID NO: 210900 - DNA, 21 bp, Mus musculus
tctgtctctcagagtcgtaca

SEQ ID NO: 210901 - DNA, 23 bp, Mus musculus
tctgttctctatttgatttttac

SEQ ID NO: 210902 - DNA, 22 bp, Mus musculus
tgttttgtgaccaattatatgg

SEQ ID NO: 210903 - DNA, 23 bp, Mus musculus
tgatcctgtgtgcctgcctcact

SEQ ID NO: 210904 - DNA, 20 bp, Mus musculus
atatgtatatgtatgtgtat

SEQ ID NO: 210905 - DNA, 21 bp, Mus musculus
atgtatatatgtatatatgtg

SEQ ID NO: 210906 - DNA, 21 bp, Mus musculus
gtgtgtgtgtgtgtatgcacg

SEQ ID NO: 210907 - DNA, 19 bp, Mus musculus
tgtatgtatatgtgtgtgt

SEQ ID NO: 210908 - DNA, 21 bp, Mus musculus
tcacacacacatacacatgtg

SEQ ID NO: 210909 - DNA, 23 bp, Mus musculus
agatcctctctctctgtctgtct

SEQ ID NO: 210910 - DNA, 23 bp, Mus musculus
aaagaaagttctatgctcatttg

SEQ ID NO: 210911 - DNA, 20 bp, Mus musculus
tgtgtgaacttcagacagtg

SEQ ID NO: 210912 - DNA, 23 bp, Mus musculus
atgtatgtatatatgtatgtatg

SEQ ID NO: 210913 - DNA, 21 bp, Mus musculus
tatatgtatgatgtatgtatg

SEQ ID NO: 210914 - DNA, 23 bp, Mus musculus
atgtatgcatgtgtatgcatatg

SEQ ID NO: 210915 - DNA, 23 bp, Mus musculus
tatatgtatgtgtacatgtgaaa

SEQ ID NO: 210916 - DNA, 21 bp, Mus musculus
aggtatgtgtacatgtgtatg

SEQ ID NO: 210917 - DNA, 23 bp, Mus musculus
ccattgcatatatgtgtgtgtgt

SEQ ID NO: 210918 - DNA, 23 bp, Mus musculus
tcatagaatgaattgggtagagt

SEQ ID NO: 210919 - DNA, 19 bp, Mus musculus
gggttgatgcttggtgact

SEQ ID NO: 210920 - DNA, 22 bp, Mus musculus
tgtctctctgtgtgtatgcatg

SEQ ID NO: 210921 - DNA, 20 bp, Mus musculus
acagccaagagtttcagtac

SEQ ID NO: 210922 - DNA, 22 bp, Mus musculus
gccactgacactctggctgtct

SEQ ID NO: 210923 - DNA, 21 bp, Mus musculus
gtgtgtgtatgtatgtgtatg

SEQ ID NO: 210924 - DNA, 23 bp, Mus musculus
gccactgtgtgcttgctgggagt

SEQ ID NO: 210925 - DNA, 22 bp, Mus musculus
tttctctgcaagagcaagtgct

SEQ ID NO: 210926 - DNA, 23 bp, Mus musculus
gcctctctctgtgtgtgtggagc

SEQ ID NO: 210927 - DNA, 23 bp, Mus musculus
tatgtgtatatgtatgtatgtgt

SEQ ID NO: 210928 - DNA, 23 bp, Mus musculus
tgcctccctcactgcctctcttt

SEQ ID NO: 210929 - DNA, 22 bp, Mus musculus
tgttttgtgaccaattatatgg

SEQ ID NO: 210930 - DNA, 22 bp, Mus musculus
tgttttgtgaccaattatatgg

SEQ ID NO: 210931 - DNA, 22 bp, Mus musculus
ccaagaacagtgccagcactca

SEQ ID NO: 210932 - DNA, 23 bp, Mus musculus
tctgcaaatgtatagatccctct

SEQ ID NO: 210933 - DNA, 23 bp, Mus musculus
cagtgcctgtcacagggcatgca

SEQ ID NO: 210934 - DNA, 22 bp, Mus musculus
tctgtctgtctgtctgtctgtc

SEQ ID NO: 210935 - DNA, 23 bp, Mus musculus
caggcagtgtctgtgactgtctt

SEQ ID NO: 210936 - DNA, 23 bp, Mus musculus
agtgttcttcctgaatgcctgag

SEQ ID NO: 210937 - DNA, 19 bp, Mus musculus
aaacatcatgactaagaag

SEQ ID NO: 210938 - DNA, 23 bp, Mus musculus
ctgtctgtcagagtggatgcctt

SEQ ID NO: 210939 - DNA, 22 bp, Mus musculus
ctcctgtgaaagtcagaagatg

SEQ ID NO: 210940 - DNA, 23 bp, Mus musculus
atgtatgtatatgtacaagtatg

SEQ ID NO: 210941 - DNA, 21 bp, Mus musculus
tgtctctgtatctccttccat

SEQ ID NO: 210942 - DNA, 23 bp, Mus musculus
aaaccataggaaatgaaactgaa

SEQ ID NO: 210943 - DNA, 20 bp, Mus musculus
acagtactgggctttctcaa

SEQ ID NO: 210944 - DNA, 23 bp, Mus musculus
agaggctggagaaatggcttagt

SEQ ID NO: 210945 - DNA, 23 bp, Mus musculus
tgctctgtgtagagagtgtggtc

SEQ ID NO: 210946 - DNA, 20 bp, Mus musculus
ttactgaatgacaatcatga

SEQ ID NO: 210947 - DNA, 23 bp, Mus musculus
tcattctctctgtgtcaatgtgc

SEQ ID NO: 210948 - DNA, 20 bp, Mus musculus
ttactgaatgacaatcatga

SEQ ID NO: 210949 - DNA, 23 bp, Mus musculus
tcattctctctgtgtcaatgtgc

SEQ ID NO: 210950 - DNA, 20 bp, Mus musculus
ttactgaatgacaatcatga

SEQ ID NO: 210951 - DNA, 23 bp, Mus musculus
tcattctctctgtgtcaatgtgc

SEQ ID NO: 210952 - DNA, 23 bp, Mus musculus
tgaacaagagacagatacagcat

SEQ ID NO: 210953 - DNA, 23 bp, Mus musculus
agactgctcttccagaggtcctg

SEQ ID NO: 210954 - DNA, 21 bp, Mus musculus
tcacacatgtcacagtgcaca

SEQ ID NO: 210955 - DNA, 23 bp, Mus musculus
tgtgttttgtctctgtatatgtg

SEQ ID NO: 210956 - DNA, 20 bp, Mus musculus
tgtgtgtgtcgtactcatga

SEQ ID NO: 210957 - DNA, 19 bp, Mus musculus
agagaagtaggactggaga

SEQ ID NO: 210958 - DNA, 19 bp, Mus musculus
acacccaggtttcatgagg

SEQ ID NO: 210959 - DNA, 19 bp, Mus musculus
acctggtattatttctgag

SEQ ID NO: 210960 - DNA, 19 bp, Mus musculus
gtgcacagacagacagaca

SEQ ID NO: 210961 - DNA, 23 bp, Mus musculus
atgtgtatgtatgtatatgtata

SEQ ID NO: 210962 - DNA, 23 bp, Mus musculus
atgtatatatgtatgtatatgta

SEQ ID NO: 210963 - DNA, 23 bp, Mus musculus
ctctgtagtacagcttgaggtca

SEQ ID NO: 210964 - DNA, 21 bp, Mus musculus
tgtgagcaatactaaatgcac

SEQ ID NO: 210965 - DNA, 23 bp, Mus musculus
tgtgtacatatgtgtgtgtgtgt

SEQ ID NO: 210966 - DNA, 21 bp, Mus musculus
tggctcactgggtctctgagt

SEQ ID NO: 210967 - DNA, 21 bp, Mus musculus
tccatggtggtctgataggat

SEQ ID NO: 210968 - DNA, 22 bp, Mus musculus
tgttttgtgaccaattatatgg

SEQ ID NO: 210969 - DNA, 23 bp, Mus musculus
tgactgactgactgactgactga

SEQ ID NO: 210970 - DNA, 22 bp, Mus musculus
tgttttgtgaccaattatatgg

SEQ ID NO: 210971 - DNA, 23 bp, Mus musculus
agtgagtgctttcagagctgtta

SEQ ID NO: 210972 - DNA, 19 bp, Mus musculus
aagagctaattttttagat

SEQ ID NO: 210973 - DNA, 23 bp, Mus musculus
agaatagtgttttacatgggaat

SEQ ID NO: 210974 - DNA, 23 bp, Mus musculus
agtcactgtcttagtcactgttc

SEQ ID NO: 210975 - DNA, 23 bp, Mus musculus
acactttgaccttgtttttgaga

SEQ ID NO: 210976 - DNA, 23 bp, Mus musculus
caattctttgttcagtgggtggt

SEQ ID NO: 210977 - DNA, 19 bp, Mus musculus
tcacaagtcagagagcaga

SEQ ID NO: 210978 - DNA, 21 bp, Mus musculus
tttctctgcctctctgagcca

SEQ ID NO: 210979 - DNA, 21 bp, Mus musculus
agtctctctctgtgtgcctgc

SEQ ID NO: 210980 - DNA, 22 bp, Mus musculus
tcacagagcagtgacagcaatg

SEQ ID NO: 210981 - DNA, 22 bp, Mus musculus
atgaatatgagtacttcctgct

SEQ ID NO: 210982 - DNA, 22 bp, Mus musculus
tgcatgttcatgtgcttgctca

SEQ ID NO: 210983 - DNA, 23 bp, Mus musculus
atatgtatatatatatatgtgtg

SEQ ID NO: 210984 - DNA, 23 bp, Mus musculus
gactcactcactcactcactcac

SEQ ID NO: 210985 - DNA, 18 bp, Mus musculus
ataggcaggttttatgtc

SEQ ID NO: 210986 - DNA, 23 bp, Mus musculus
tctgcctgtctgtctgtctgtct

SEQ ID NO: 210987 - DNA, 22 bp, Mus musculus
tgagtgtctggtttcttccagt

SEQ ID NO: 210988 - DNA, 22 bp, Mus musculus
gtctctctgtctccggcacact

SEQ ID NO: 210989 - DNA, 23 bp, Mus musculus
tgtctgcctgtgagcctctgtcc

SEQ ID NO: 210990 - DNA, 23 bp, Mus musculus
tgtgggcacacactctcactctg

SEQ ID NO: 210991 - DNA, 23 bp, Mus musculus
gcatgtgtctgagtgtgtatgtg

SEQ ID NO: 210992 - DNA, 23 bp, Mus musculus
aagtatgtgtgcatgagcatgtg

SEQ ID NO: 210993 - DNA, 23 bp, Mus musculus
acaacaagctctgtgtgtgtgtg

SEQ ID NO: 210994 - DNA, 23 bp, Mus musculus
tgcagtgtgtgtgtgtgtgtgtg

SEQ ID NO: 210995 - DNA, 23 bp, Mus musculus
tcattctctgcattgggtggctt

SEQ ID NO: 210996 - DNA, 22 bp, Mus musculus
tatgccatcgataggattggga

SEQ ID NO: 210997 - DNA, 23 bp, Mus musculus
tttcagtggatagttgtgtgcag

SEQ ID NO: 210998 - DNA, 21 bp, Mus musculus
agggctgctgtgaaatcctgt

SEQ ID NO: 210999 - DNA, 23 bp, Mus musculus
ttacgttcagattgttttctcat

SEQ ID NO: 211000 - DNA, 22 bp, Mus musculus
tgggagtgttgtctgggaggag

SEQ ID NO: 211001 - DNA, 18 bp, Mus musculus
agagtgcactgagggcag

SEQ ID NO: 211002 - DNA, 19 bp, Mus musculus
tgtttgtgtcttcagcctc

SEQ ID NO: 211003 - DNA, 22 bp, Mus musculus
tgaagtgctttcagttgtgaat

SEQ ID NO: 211004 - DNA, 23 bp, Mus musculus
aggggaatagaaatgtgtatgca

SEQ ID NO: 211005 - DNA, 23 bp, Mus musculus
aatggtcctcttgatgacggaca

SEQ ID NO: 211006 - DNA, 23 bp, Mus musculus
tctgtgtgtctgtgtgtgtctct

SEQ ID NO: 211007 - DNA, 19 bp, Mus musculus
accctttgaaatgatgtgg

SEQ ID NO: 211008 - DNA, 19 bp, Mus musculus
tctcaggctctggctgtgt

SEQ ID NO: 211009 - DNA, 23 bp, Mus musculus
aagataagagattttcttgacca

SEQ ID NO: 211010 - DNA, 23 bp, Mus musculus
atcatttctgatattcttgattt

SEQ ID NO: 211011 - DNA, 23 bp, Mus musculus
tagccagtgaagaaggagggtaa

SEQ ID NO: 211012 - DNA, 19 bp, Mus musculus
tgcttgcctgcctgtaagc

SEQ ID NO: 211013 - DNA, 19 bp, Mus musculus
ccagcagctctaggagcag

SEQ ID NO: 211014 - DNA, 21 bp, Mus musculus
tctctcagagactcactgggt

SEQ ID NO: 211015 - DNA, 23 bp, Mus musculus
tgtgcatgtgtgtgcattgtgca

SEQ ID NO: 211016 - DNA, 18 bp, Mus musculus
acacagatagctccagga

SEQ ID NO: 211017 - DNA, 23 bp, Mus musculus
tgtgagtgcttcctgactctctg

SEQ ID NO: 211018 - DNA, 22 bp, Mus musculus
tgttttgtgaccaattatatgg

SEQ ID NO: 211019 - DNA, 21 bp, Mus musculus
tatgtggattgatgtttgggt

SEQ ID NO: 211020 - DNA, 21 bp, Mus musculus
tgacagaagtcaatttgaggt

SEQ ID NO: 211021 - DNA, 23 bp, Mus musculus
catctgactgactctgtggaagt

SEQ ID NO: 211022 - DNA, 20 bp, Mus musculus
tatgcatatatatgcatata

SEQ ID NO: 211023 - DNA, 21 bp, Mus musculus
atatatatgtcatatacatca

SEQ ID NO: 211024 - DNA, 23 bp, Mus musculus
tgtgaatgagagaaatggcaggt

SEQ ID NO: 211025 - DNA, 20 bp, Mus musculus
tctcagatgactgagtgctg

SEQ ID NO: 211026 - DNA, 23 bp, Mus musculus
gcagactcactctgccaatgtgg

SEQ ID NO: 211027 - DNA, 23 bp, Mus musculus
aaattctctgaggggctggagag

SEQ ID NO: 211028 - DNA, 19 bp, Mus musculus
aagactcactctctcccac

SEQ ID NO: 211029 - DNA, 22 bp, Mus musculus
aagtgactgtggaatgcttatc

SEQ ID NO: 211030 - DNA, 23 bp, Mus musculus
attttgattcataacaatagtaa

SEQ ID NO: 211031 - DNA, 23 bp, Mus musculus
ctcagcgtctctctctgagtggc

SEQ ID NO: 211032 - DNA, 23 bp, Mus musculus
tatgtgtatatgtatatatgtac

SEQ ID NO: 211033 - DNA, 19 bp, Mus musculus
tatctctgtctctgttatt

SEQ ID NO: 211034 - DNA, 23 bp, Mus musculus
ttttaagagcatatacgtatttt

SEQ ID NO: 211035 - DNA, 23 bp, Mus musculus
actcactgtcactgaatgggcac

SEQ ID NO: 211036 - DNA, 18 bp, Mus musculus
ggaatctaaagtagcatg

SEQ ID NO: 211037 - DNA, 23 bp, Mus musculus
ctctctctgtgtatgcatgttca

SEQ ID NO: 211038 - DNA, 23 bp, Mus musculus
aatgaacatttgcaactgaagat

SEQ ID NO: 211039 - DNA, 23 bp, Mus musculus
tctgggtctctgtctgcctctgt

SEQ ID NO: 211040 - DNA, 23 bp, Mus musculus
aactagtaggagcccagaaattt

SEQ ID NO: 211041 - DNA, 23 bp, Mus musculus
ttatggtttcttagctttacagt

SEQ ID NO: 211042 - DNA, 23 bp, Mus musculus
tgtgaatttatagaaaagtgtat

SEQ ID NO: 211043 - DNA, 23 bp, Mus musculus
tctgtgagaaaacactgtggaca

SEQ ID NO: 211044 - DNA, 22 bp, Mus musculus
atagatgttttcctgttttctg

SEQ ID NO: 211045 - DNA, 23 bp, Mus musculus
tgtgtgcatgtagtatgtatgta

SEQ ID NO: 211046 - DNA, 23 bp, Mus musculus
gtttacagttgagactctggtgt

SEQ ID NO: 211047 - DNA, 21 bp, Mus musculus
tttggagccatgtgactgaga

SEQ ID NO: 211048 - DNA, 22 bp, Mus musculus
tgttctgtctggttttatgtgt

SEQ ID NO: 211049 - DNA, 22 bp, Mus musculus
ttgacacaagttagtcaccaga

SEQ ID NO: 211050 - DNA, 21 bp, Mus musculus
tcacacacatatatatgtgtt

SEQ ID NO: 211051 - DNA, 20 bp, Mus musculus
ttcacatgtgtgtgtgcaca

SEQ ID NO: 211052 - DNA, 23 bp, Mus musculus
attgcaatccatagtagtatcaa

SEQ ID NO: 211053 - DNA, 23 bp, Mus musculus
atgatgatgatgatgtggttgtt

SEQ ID NO: 211054 - DNA, 23 bp, Mus musculus
tatatgtgcatatgtatatatgt

SEQ ID NO: 211055 - DNA, 23 bp, Mus musculus
gcactcagtaagtctagatgcag

SEQ ID NO: 211056 - DNA, 23 bp, Mus musculus
tcatcagactgggtttgacagtg

SEQ ID NO: 211057 - DNA, 23 bp, Mus musculus
tgtgagtctgtctatctgcttgt

SEQ ID NO: 211058 - DNA, 23 bp, Mus musculus
tgtctctggctccctgttataac

SEQ ID NO: 211059 - DNA, 23 bp, Mus musculus
aagtgtgtctctgtgtgcctgtg

SEQ ID NO: 211060 - DNA, 23 bp, Mus musculus
atatgtatgtgtatatgtatatg

SEQ ID NO: 211061 - DNA, 21 bp, Mus musculus
tatgtatatttgcatatgcat

SEQ ID NO: 211062 - DNA, 22 bp, Mus musculus
tagtgcagcttagtctctcaca

SEQ ID NO: 211063 - DNA, 22 bp, Mus musculus
tctcacccacagacactgcact

SEQ ID NO: 211064 - DNA, 23 bp, Mus musculus
aaccaagcatgtgaggctggaga

SEQ ID NO: 211065 - DNA, 22 bp, Mus musculus
cgctctgtctgtctctctgagc

SEQ ID NO: 211066 - DNA, 20 bp, Mus musculus
tctgtgacagtttcatgtgt

SEQ ID NO: 211067 - DNA, 23 bp, Mus musculus
tacgttcttactgtcactgtgac

SEQ ID NO: 211068 - DNA, 21 bp, Mus musculus
acagaactgctcgaggagata

SEQ ID NO: 211069 - DNA, 23 bp, Mus musculus
tgtgtgtgtctgtctgtcattca

SEQ ID NO: 211070 - DNA, 21 bp, Mus musculus
tcagactgtgactctgtgact

SEQ ID NO: 211071 - DNA, 20 bp, Mus musculus
tatatgtgtgtgcatgtgta

SEQ ID NO: 211072 - DNA, 21 bp, Mus musculus
tccatggtggtctgataggat

SEQ ID NO: 211073 - DNA, 22 bp, Mus musculus
tgttttgtgaccaattatatgg

SEQ ID NO: 211074 - DNA, 23 bp, Mus musculus
atatgtgcatgtatatatgtatg

SEQ ID NO: 211075 - DNA, 23 bp, Mus musculus
aatgtctgtgaccctgactccca

SEQ ID NO: 211076 - DNA, 23 bp, Mus musculus
tttcacaggcagctttgttttgc

SEQ ID NO: 211077 - DNA, 23 bp, Mus musculus
ccctgtgtctttgctgtctgtag

SEQ ID NO: 211078 - DNA, 20 bp, Mus musculus
acagaggctagagttgacct

SEQ ID NO: 211079 - DNA, 23 bp, Mus musculus
tgtcaacatctgtctgtctgtct

SEQ ID NO: 211080 - DNA, 20 bp, Mus musculus
gagagaggctatcttcagat

SEQ ID NO: 211081 - DNA, 23 bp, Mus musculus
actgaggatgaagctctttgagg

SEQ ID NO: 211082 - DNA, 20 bp, Mus musculus
acacaagtgtgtgtgcatat

SEQ ID NO: 211083 - DNA, 23 bp, Mus musculus
tttctgtcggtgtctctgtgggt

SEQ ID NO: 211084 - DNA, 23 bp, Mus musculus
agatggtactttcagtttctgat

SEQ ID NO: 211085 - DNA, 23 bp, Mus musculus
tcttctggatttgttgtgatgat

SEQ ID NO: 211086 - DNA, 19 bp, Mus musculus
tttgcagatgtagacctag

SEQ ID NO: 211087 - DNA, 23 bp, Mus musculus
gtatatacatgtatgtgtgtgtg

SEQ ID NO: 211088 - DNA, 23 bp, Mus musculus
tgtacgtgtgtgtgtgtgtgtgt

SEQ ID NO: 211089 - DNA, 23 bp, Mus musculus
agggctctgtgtgtctgtctgtg

SEQ ID NO: 211090 - DNA, 23 bp, Mus musculus
taaagatagatatcgtaggtaat

SEQ ID NO: 211091 - DNA, 23 bp, Mus musculus
tgtctcagtcacttgctctgttt

SEQ ID NO: 211092 - DNA, 23 bp, Mus musculus
ttgtgaggtgtgtgtgcacacag

SEQ ID NO: 211093 - DNA, 23 bp, Mus musculus
ctgtctctgacacacatacttga

SEQ ID NO: 211094 - DNA, 21 bp, Mus musculus
agactggctctgtctctccca

SEQ ID NO: 211095 - DNA, 23 bp, Mus musculus
tgtatgtatatgtatatgtatgt

SEQ ID NO: 211096 - DNA, 23 bp, Mus musculus
actgtgtgtgtgactctgtgtgt

SEQ ID NO: 211097 - DNA, 18 bp, Mus musculus
accatttttattctttga

SEQ ID NO: 211098 - DNA, 23 bp, Mus musculus
gtgtctctctgagtccttggctg

SEQ ID NO: 211099 - DNA, 21 bp, Mus musculus
ctgtgcatgcttgtgtgtgca

SEQ ID NO: 211100 - DNA, 21 bp, Mus musculus
attcacagggtaagagtgact

SEQ ID NO: 211101 - DNA, 20 bp, Mus musculus
ttctctctctgtgttatatt

SEQ ID NO: 211102 - DNA, 23 bp, Mus musculus
tgagtatgtatgtatgtatgtac

SEQ ID NO: 211103 - DNA, 22 bp, Mus musculus
gaatgcatgcatgtttatatac

SEQ ID NO: 211104 - DNA, 23 bp, Mus musculus
aggtccagactcatactctctct

SEQ ID NO: 211105 - DNA, 20 bp, Mus musculus
tgtatgtatgtatgtgtata

SEQ ID NO: 211106 - DNA, 23 bp, Mus musculus
tctgcatgtatgtatatgtgtgt

SEQ ID NO: 211107 - DNA, 20 bp, Mus musculus
tttgagaagagagtctgctc

SEQ ID NO: 211108 - DNA, 23 bp, Mus musculus
tatcagatgacagtgtgcacagc

SEQ ID NO: 211109 - DNA, 23 bp, Mus musculus
aaagagcaagctgtgactgacag

SEQ ID NO: 211110 - DNA, 23 bp, Mus musculus
tgtgtgtatatatatgtgtgtgt

SEQ ID NO: 211111 - DNA, 23 bp, Mus musculus
tgagagatcagtgtgtggactcc

SEQ ID NO: 211112 - DNA, 22 bp, Mus musculus
tgtctacagagactggcagagc

SEQ ID NO: 211113 - DNA, 23 bp, Mus musculus
gaatttgctattgatgcaggtgt

SEQ ID NO: 211114 - DNA, 22 bp, Mus musculus
tttgttcctcaccaatcgaagt

SEQ ID NO: 211115 - DNA, 23 bp, Mus musculus
tgtatgcatatgaatgtgtatgt

SEQ ID NO: 211116 - DNA, 23 bp, Mus musculus
tgtgtatacatgtacatgtgtgt

SEQ ID NO: 211117 - DNA, 18 bp, Mus musculus
aagatgtaattcagggct

SEQ ID NO: 211118 - DNA, 18 bp, Mus musculus
tgtgtatttctgtgtgtg

SEQ ID NO: 211119 - DNA, 23 bp, Mus musculus
gtctccctgtgagagtctctgca

SEQ ID NO: 211120 - DNA, 22 bp, Mus musculus
ctctgcctgcctgcctgtctgc

SEQ ID NO: 211121 - DNA, 22 bp, Mus musculus
acatgcagaggacctggtgcag

SEQ ID NO: 211122 - DNA, 21 bp, Mus musculus
ctctctgcttctgtctctgtg

SEQ ID NO: 211123 - DNA, 18 bp, Mus musculus
tgcaggctacagtggggg

SEQ ID NO: 211124 - DNA, 23 bp, Mus musculus
tgcctgcctgcctgcctgcctgc

SEQ ID NO: 211125 - DNA, 21 bp, Mus musculus
agaaacatctggatgctgcct

SEQ ID NO: 211126 - DNA, 23 bp, Mus musculus
tctgtgtgtgtatctgtctgtct

SEQ ID NO: 211127 - DNA, 23 bp, Mus musculus
atgtgcgtgtgcatgtgcatgca

SEQ ID NO: 211128 - DNA, 23 bp, Mus musculus
tctgtgaagagagtctgcaggct

SEQ ID NO: 211129 - DNA, 23 bp, Mus musculus
tcatagttcaagttcctggtctg

SEQ ID NO: 211130 - DNA, 22 bp, Mus musculus
tttgagtctgatgtttgctatt

SEQ ID NO: 211131 - DNA, 20 bp, Mus musculus
gggggagagagacacacaca

SEQ ID NO: 211132 - DNA, 21 bp, Mus musculus
atatatgtagcctttgagagg

SEQ ID NO: 211133 - DNA, 19 bp, Mus musculus
attgtacttcagaagattc

SEQ ID NO: 211134 - DNA, 23 bp, Mus musculus
tatgtatgtactgagtgtgcaca

SEQ ID NO: 211135 - DNA, 21 bp, Mus musculus
aatgctgaacttatcctgctc

SEQ ID NO: 211136 - DNA, 18 bp, Mus musculus
tctgtgtgtatcttcctg

SEQ ID NO: 211137 - DNA, 22 bp, Mus musculus
tgttttgtgaccaattatatgg

SEQ ID NO: 211138 - DNA, 21 bp, Mus musculus
tgtgtccctctctcagtggta

SEQ ID NO: 211139 - DNA, 23 bp, Mus musculus
agaggaacacttgtgtgttagat

SEQ ID NO: 211140 - DNA, 21 bp, Mus musculus
tatgtgtgtttttcatgtgta

SEQ ID NO: 211141 - DNA, 23 bp, Mus musculus
tctctggctgactgcctcagctt

SEQ ID NO: 211142 - DNA, 22 bp, Mus musculus
gagtgtctgctagatgtgagtg

SEQ ID NO: 211143 - DNA, 23 bp, Mus musculus
gtggaagtttcttttttaaagtg

SEQ ID NO: 211144 - DNA, 23 bp, Mus musculus
ctctttgtctgtctgtctgtctg

SEQ ID NO: 211145 - DNA, 20 bp, Mus musculus
tgtgagtgtgagttacctgt

SEQ ID NO: 211146 - DNA, 22 bp, Mus musculus
agtctcagtttgtctgtcctta

SEQ ID NO: 211147 - DNA, 22 bp, Mus musculus
tgactcattagaatggtgacag

SEQ ID NO: 211148 - DNA, 21 bp, Mus musculus
tctacaaccttgagagagaca

SEQ ID NO: 211149 - DNA, 23 bp, Mus musculus
atgtatgtatgtgtgtatgtatg

SEQ ID NO: 211150 - DNA, 19 bp, Mus musculus
atacacacacatgtataca

SEQ ID NO: 211151 - DNA, 18 bp, Mus musculus
atgtatatacacacacac

SEQ ID NO: 211152 - DNA, 19 bp, Mus musculus
agagagatgaccctggtct

SEQ ID NO: 211153 - DNA, 19 bp, Mus musculus
agtctacagatccttgact

SEQ ID NO: 211154 - DNA, 23 bp, Mus musculus
gagctttgcaaatcacagtcgga

SEQ ID NO: 211155 - DNA, 23 bp, Mus musculus
cagatctcactgaggagacagag

SEQ ID NO: 211156 - DNA, 23 bp, Mus musculus
tgatctccatgcctcagtctagt

SEQ ID NO: 211157 - DNA, 22 bp, Mus musculus
agaaatgtatagaagtttccag

SEQ ID NO: 211158 - DNA, 23 bp, Mus musculus
agaacactgactgctcttccaga

SEQ ID NO: 211159 - DNA, 23 bp, Mus musculus
tgtatatatgtatgtgtgtacat

SEQ ID NO: 211160 - DNA, 23 bp, Mus musculus
actacagtcgctctgacactgcc

SEQ ID NO: 211161 - DNA, 22 bp, Mus musculus
aatgagacagtaactgttgtga

SEQ ID NO: 211162 - DNA, 23 bp, Mus musculus
tcagtcagtcagtcagtctgtct

SEQ ID NO: 211163 - DNA, 23 bp, Mus musculus
taccagcacatgaacctacagtg

SEQ ID NO: 211164 - DNA, 23 bp, Mus musculus
gaggctgtgtctctcagaggtgg

SEQ ID NO: 211165 - DNA, 20 bp, Mus musculus
ttacactcaaggcagaggca

SEQ ID NO: 211166 - DNA, 20 bp, Mus musculus
ttccaagtagatttcttttt

SEQ ID NO: 211167 - DNA, 23 bp, Mus musculus
gtgtcactccctctctcggattc

SEQ ID NO: 211168 - DNA, 19 bp, Mus musculus
tcacacccagtctctctag

SEQ ID NO: 211169 - DNA, 23 bp, Mus musculus
ctgtctgagtctgttttttctga

SEQ ID NO: 211170 - DNA, 23 bp, Mus musculus
cacctcctagaatcaagtgagaa

SEQ ID NO: 211171 - DNA, 21 bp, Mus musculus
tgagtatatgtatgtgtgtgt

SEQ ID NO: 211172 - DNA, 23 bp, Mus musculus
ttccttgtagaggggtttgtgaa

SEQ ID NO: 211173 - DNA, 23 bp, Mus musculus
actctctctctctgagtgttctt

SEQ ID NO: 211174 - DNA, 23 bp, Mus musculus
tagatgacgttgtgctgtgtgtg

SEQ ID NO: 211175 - DNA, 20 bp, Mus musculus
gtgtgccacacacagcacaa

SEQ ID NO: 211176 - DNA, 23 bp, Mus musculus
cacacagcctctctgccagccgg

SEQ ID NO: 211177 - DNA, 23 bp, Mus musculus
acacctacatatgtgtatatgta

SEQ ID NO: 211178 - DNA, 23 bp, Mus musculus
tctgaggctgtgtctgaggctgt

SEQ ID NO: 211179 - DNA, 23 bp, Mus musculus
actgtgtatgggacacttgtgcc

SEQ ID NO: 211180 - DNA, 19 bp, Mus musculus
atggacagggtctggagag

SEQ ID NO: 211181 - DNA, 23 bp, Mus musculus
ctctctctctctctgttgcatct

SEQ ID NO: 211182 - DNA, 23 bp, Mus musculus
tagtgcatggtgatctgatagga

SEQ ID NO: 211183 - DNA, 22 bp, Mus musculus
tgttttgtgacctattatgtgg

SEQ ID NO: 211184 - DNA, 23 bp, Mus musculus
tgtcagcacagtgacagctgagg

SEQ ID NO: 211185 - DNA, 23 bp, Mus musculus
acagtgttacctatgcctgtcac

SEQ ID NO: 211186 - DNA, 21 bp, Mus musculus
gtgactgctgtctctctgtca

SEQ ID NO: 211187 - DNA, 23 bp, Mus musculus
acagagagaacagactcaggctt

SEQ ID NO: 211188 - DNA, 23 bp, Mus musculus
gactgcctccatgtctgtacttc

SEQ ID NO: 211189 - DNA, 21 bp, Mus musculus
gaagagatgtgtgactgtaga

SEQ ID NO: 211190 - DNA, 19 bp, Mus musculus
gagacacagacagagactg

SEQ ID NO: 211191 - DNA, 21 bp, Mus musculus
gctatgtcttgttttccctct

SEQ ID NO: 211192 - DNA, 18 bp, Mus musculus
atatgtaaatgtgtgtga

SEQ ID NO: 211193 - DNA, 23 bp, Mus musculus
tcactctgtgcctgtctcggtag

SEQ ID NO: 211194 - DNA, 23 bp, Mus musculus
ccctgtctccctgcctgtctggc

SEQ ID NO: 211195 - DNA, 23 bp, Mus musculus
ccactctctgcctcacatcccgc

SEQ ID NO: 211196 - DNA, 23 bp, Mus musculus
accacagcgagctatgaacaggt

SEQ ID NO: 211197 - DNA, 23 bp, Mus musculus
tgtctcaccctgagttctggagc

SEQ ID NO: 211198 - DNA, 18 bp, Mus musculus
cttcctgcatctgagaaa

SEQ ID NO: 211199 - DNA, 23 bp, Mus musculus
taagtctatgcatatgcacacag

SEQ ID NO: 211200 - DNA, 22 bp, Mus musculus
ttttcagtttgtacttgtgata

SEQ ID NO: 211201 - DNA, 23 bp, Mus musculus
tatgtatatgtgtatgtgtatgt

SEQ ID NO: 211202 - DNA, 19 bp, Mus musculus
tgtgtatatatgtatatac

SEQ ID NO: 211203 - DNA, 18 bp, Mus musculus
catatgtatatatgtatg

SEQ ID NO: 211204 - DNA, 23 bp, Mus musculus
tctgtcccaggctcactgtggct

SEQ ID NO: 211205 - DNA, 21 bp, Mus musculus
tttctctgccagcttgcttgc

SEQ ID NO: 211206 - DNA, 23 bp, Mus musculus
gtctgtgtgtctgtatgttctgt

SEQ ID NO: 211207 - DNA, 23 bp, Mus musculus
agaggaacagctatgtgtctcac

SEQ ID NO: 211208 - DNA, 21 bp, Mus musculus
ttcaccacgggaatggtgtga

SEQ ID NO: 211209 - DNA, 21 bp, Mus musculus
ttcaccacggaaatggtgtga

SEQ ID NO: 211210 - DNA, 23 bp, Mus musculus
gtgtgaggttcaccacgggaatg

SEQ ID NO: 211211 - DNA, 23 bp, Mus musculus
tgtgtgcctctgtgtgtgtctca

SEQ ID NO: 211212 - DNA, 20 bp, Mus musculus
ctctcccagtctctctgtct

SEQ ID NO: 211213 - DNA, 23 bp, Mus musculus
aagaatcagagcatcaggaagag

SEQ ID NO: 211214 - DNA, 23 bp, Mus musculus
ctagctcagtctgtcactgtcac

SEQ ID NO: 211215 - DNA, 23 bp, Mus musculus
atgtgtgtatatatgtatgtata

SEQ ID NO: 211216 - DNA, 23 bp, Mus musculus
tggtggtctctcaggctctctgg

SEQ ID NO: 211217 - DNA, 23 bp, Mus musculus
agttctctaatgtactttgacac

SEQ ID NO: 211218 - DNA, 22 bp, Mus musculus
actgtcatgcatttactgtgag

SEQ ID NO: 211219 - DNA, 19 bp, Mus musculus
agcattactctgctacatg

SEQ ID NO: 211220 - DNA, 23 bp, Mus musculus
agtctctctgcctgtgtccaagc

SEQ ID NO: 211221 - DNA, 23 bp, Mus musculus
atatatgtagatgacctttggat

SEQ ID NO: 211222 - DNA, 21 bp, Mus musculus
agacagtagtgagctcagtga

SEQ ID NO: 211223 - DNA, 22 bp, Mus musculus
tcacttcttgctctctctctga

SEQ ID NO: 211224 - DNA, 23 bp, Mus musculus
tgacacagactctctcgctgaac

SEQ ID NO: 211225 - DNA, 23 bp, Mus musculus
ctctctgtttctcaggcaagaaa

SEQ ID NO: 211226 - DNA, 19 bp, Mus musculus
tgtcactgtgagcctccca

SEQ ID NO: 211227 - DNA, 22 bp, Mus musculus
ttcagtgagcactgtgtgtctg

SEQ ID NO: 211228 - DNA, 23 bp, Mus musculus
cactgcacactctgggcctctgt

SEQ ID NO: 211229 - DNA, 23 bp, Mus musculus
ggctctcagtctctctgcttacc

SEQ ID NO: 211230 - DNA, 21 bp, Mus musculus
aatctgagaggactgactgtc

SEQ ID NO: 211231 - DNA, 18 bp, Mus musculus
agccataatgtagctttg

SEQ ID NO: 211232 - DNA, 18 bp, Mus musculus
acacacacatatacatat

SEQ ID NO: 211233 - DNA, 21 bp, Mus musculus
ttgactcgccaataactatct

SEQ ID NO: 211234 - DNA, 22 bp, Mus musculus
gtctctctctcactgccaagtc

SEQ ID NO: 211235 - DNA, 23 bp, Mus musculus
tgtgtgtgtgtacttgcatgtac

SEQ ID NO: 211236 - DNA, 23 bp, Mus musculus
tatacatttatgtgtgtgtatat

SEQ ID NO: 211237 - DNA, 22 bp, Mus musculus
atcctaggttttgacaaagaga

SEQ ID NO: 211238 - DNA, 23 bp, Mus musculus
tccctcactctgtgaattattgc

SEQ ID NO: 211239 - DNA, 18 bp, Mus musculus
aacaatcttcactgagca

SEQ ID NO: 211240 - DNA, 22 bp, Mus musculus
tctggttgcatgtgtatgggag

SEQ ID NO: 211241 - DNA, 18 bp, Mus musculus
atatatgttttattgaac

SEQ ID NO: 211242 - DNA, 22 bp, Mus musculus
tagggctttaagaaaaacgtgt

SEQ ID NO: 211243 - DNA, 23 bp, Mus musculus
tccctgcttcagtctctgcctca

SEQ ID NO: 211244 - DNA, 19 bp, Mus musculus
agtgtgtgcagtcaggggc

SEQ ID NO: 211245 - DNA, 21 bp, Mus musculus
gttcattgctgattatgcaga

SEQ ID NO: 211246 - DNA, 22 bp, Mus musculus
tcacacagaagagtcaccagag

SEQ ID NO: 211247 - DNA, 23 bp, Mus musculus
tgcctgtctgtctgtctgtcgtc

SEQ ID NO: 211248 - DNA, 19 bp, Mus musculus
tgtgtgtgtgctcatgttt

SEQ ID NO: 211249 - DNA, 18 bp, Mus musculus
acacagtctctatcttcc

SEQ ID NO: 211250 - DNA, 23 bp, Mus musculus
tctgttagattctcactgtgtgt

SEQ ID NO: 211251 - DNA, 23 bp, Mus musculus
gccgacctggaactcattctgta

SEQ ID NO: 211252 - DNA, 23 bp, Mus musculus
cagatctgtctgcctcaggagtg

SEQ ID NO: 211253 - DNA, 19 bp, Mus musculus
gagtgaagactgggtgcag

SEQ ID NO: 211254 - DNA, 18 bp, Mus musculus
ctgtctcttactctgcct

SEQ ID NO: 211255 - DNA, 23 bp, Mus musculus
ttatgattgctattcatatcata

SEQ ID NO: 211256 - DNA, 23 bp, Mus musculus
tatgtgtgtgtatatgtatatgt

SEQ ID NO: 211257 - DNA, 23 bp, Mus musculus
tgtgtgtatatatgtatgtgtgt

SEQ ID NO: 211258 - DNA, 22 bp, Mus musculus
tgcatgtatgtatatatctatg

SEQ ID NO: 211259 - DNA, 19 bp, Mus musculus
acagccctaggttagttgt

SEQ ID NO: 211260 - DNA, 23 bp, Mus musculus
tgggtctctgtccctgtctgcag

SEQ ID NO: 211261 - DNA, 23 bp, Mus musculus
acagaggagagagacaactgaca

SEQ ID NO: 211262 - DNA, 18 bp, Mus musculus
tttgtctcaggatttgta

SEQ ID NO: 211263 - DNA, 19 bp, Mus musculus
ctgagacaggaactgctat

SEQ ID NO: 211264 - DNA, 18 bp, Mus musculus
tcttgtagatgtttctgg

SEQ ID NO: 211265 - DNA, 18 bp, Mus musculus
tgagcgtggtgtgtgtat

SEQ ID NO: 211266 - DNA, 22 bp, Mus musculus
tacaaaacatatgtatatatga

SEQ ID NO: 211267 - DNA, 23 bp, Mus musculus
atgtctgtctatatgtatgtgtg

SEQ ID NO: 211268 - DNA, 22 bp, Mus musculus
tgtgtcagcatgtaaattcatg

SEQ ID NO: 211269 - DNA, 21 bp, Mus musculus
tcacccactgacagtccctgt

SEQ ID NO: 211270 - DNA, 23 bp, Mus musculus
agagtgttgtttgacctctcact

SEQ ID NO: 211271 - DNA, 22 bp, Mus musculus
tgccacaacatcagattatgtc

SEQ ID NO: 211272 - DNA, 23 bp, Mus musculus
agtggcaatgatgactaggtgtg

SEQ ID NO: 211273 - DNA, 22 bp, Mus musculus
tgccacaacatcagattatgtc

SEQ ID NO: 211274 - DNA, 23 bp, Mus musculus
agtggcaatgatgactaggtgtg

SEQ ID NO: 211275 - DNA, 23 bp, Mus musculus
gtctggaagtatgttctatactt

SEQ ID NO: 211276 - DNA, 20 bp, Mus musculus
gctatattttgaaatcagat

SEQ ID NO: 211277 - DNA, 23 bp, Mus musculus
gctgtctctgactaaatcctgtc

SEQ ID NO: 211278 - DNA, 23 bp, Mus musculus
atttttgttctacagatggtaac

SEQ ID NO: 211279 - DNA, 23 bp, Mus musculus
gtcacacagttaagttgcttctg

SEQ ID NO: 211280 - DNA, 23 bp, Mus musculus
atacgtgtatataggtatgtgtg

SEQ ID NO: 211281 - DNA, 23 bp, Mus musculus
cttctgtgcatgtgtatgcactt

SEQ ID NO: 211282 - DNA, 22 bp, Mus musculus
tatgtatgtatgcaagtgtgtg

SEQ ID NO: 211283 - DNA, 18 bp, Mus musculus
ttccctaatgaagtcaaa

SEQ ID NO: 211284 - DNA, 18 bp, Mus musculus
tctcagtggctctttgcc

SEQ ID NO: 211285 - DNA, 22 bp, Mus musculus
tgtcccagacagtatggccttg

SEQ ID NO: 211286 - DNA, 23 bp, Mus musculus
tgactgctcttccagaggtcctg

SEQ ID NO: 211287 - DNA, 23 bp, Mus musculus
ggttcacaaccatctgtaatgag

SEQ ID NO: 211288 - DNA, 20 bp, Mus musculus
agcatagtacagtctctggt

SEQ ID NO: 211289 - DNA, 22 bp, Mus musculus
aaagacatacctcagtgtggct

SEQ ID NO: 211290 - DNA, 23 bp, Mus musculus
tcagtgactcttacttgtagttc

SEQ ID NO: 211291 - DNA, 18 bp, Mus musculus
tgactcagatgagagaga

SEQ ID NO: 211292 - DNA, 22 bp, Mus musculus
cagagttgtgccttgccattta

SEQ ID NO: 211293 - DNA, 19 bp, Mus musculus
tcagtgtcctcacagaacc

SEQ ID NO: 211294 - DNA, 23 bp, Mus musculus
atcacattgccagggattaccac

SEQ ID NO: 211295 - DNA, 23 bp, Mus musculus
aggtgcagagcttagctgattgg

SEQ ID NO: 211296 - DNA, 23 bp, Mus musculus
ttcacagtggctaagttctgcac

SEQ ID NO: 211297 - DNA, 23 bp, Mus musculus
gtgcctactgagctgatatcagt

SEQ ID NO: 211298 - DNA, 21 bp, Mus musculus
tggctcagttcagcaggaaca

SEQ ID NO: 211299 - DNA, 22 bp, Mus musculus
ttgtggtagttggttctcttct

SEQ ID NO: 211300 - DNA, 23 bp, Mus musculus
tctgaggctctctgagtgtgagg

SEQ ID NO: 211301 - DNA, 20 bp, Mus musculus
tctacagagtgagttctaga

SEQ ID NO: 211302 - DNA, 23 bp, Mus musculus
tgtctgtctgtgtgtgtctgtgt

SEQ ID NO: 211303 - DNA, 23 bp, Mus musculus
tgtatgtttgtatgtatgtatgt

SEQ ID NO: 211304 - DNA, 21 bp, Mus musculus
agagtctcaggacatgtctgt

SEQ ID NO: 211305 - DNA, 23 bp, Mus musculus
cctgacagaaaatagtgaccaga

SEQ ID NO: 211306 - DNA, 21 bp, Mus musculus
ttgtgagaagaaacagtcctc

SEQ ID NO: 211307 - DNA, 21 bp, Mus musculus
agtccttcttggtataaatgt

SEQ ID NO: 211308 - DNA, 20 bp, Mus musculus
tatttgagaatggttagatg

SEQ ID NO: 211309 - DNA, 21 bp, Mus musculus
tgaaaatttagaattctgaga

SEQ ID NO: 211310 - DNA, 23 bp, Mus musculus
ttctttggtacttgtttgatgat

SEQ ID NO: 211311 - DNA, 23 bp, Mus musculus
atatgtggctagagagatagctc

SEQ ID NO: 211312 - DNA, 22 bp, Mus musculus
tgtgtgtatagagtgtgaatgt

SEQ ID NO: 211313 - DNA, 22 bp, Mus musculus
tcagtgcaatgtagtcagttgg

SEQ ID NO: 211314 - DNA, 23 bp, Mus musculus
gtgcagtgagtgcagtgagtgca

SEQ ID NO: 211315 - DNA, 23 bp, Mus musculus
tgagtgcagtgagtgcagtgtga

SEQ ID NO: 211316 - DNA, 19 bp, Mus musculus
gtgcagctgagtttgttca

SEQ ID NO: 211317 - DNA, 23 bp, Mus musculus
tatgtatgtatttatagattgca

SEQ ID NO: 211318 - DNA, 23 bp, Mus musculus
cctctgtcactgtgactgacagg

SEQ ID NO: 211319 - DNA, 18 bp, Mus musculus
ttcatctagagtgattta

SEQ ID NO: 211320 - DNA, 21 bp, Mus musculus
atgtccatagaattcactgac

SEQ ID NO: 211321 - DNA, 19 bp, Mus musculus
accaccattctcatgggta

SEQ ID NO: 211322 - DNA, 23 bp, Mus musculus
tgcgtgactatgtgcagaaagga

SEQ ID NO: 211323 - DNA, 19 bp, Mus musculus
tggtatttattcatgtgtg

SEQ ID NO: 211324 - DNA, 22 bp, Mus musculus
tgtatgtatgtacatgtgtatg

SEQ ID NO: 211325 - DNA, 22 bp, Mus musculus
acaatgtacagagtctggcaga

SEQ ID NO: 211326 - DNA, 23 bp, Mus musculus
gtagagagcaatgtacagagcct

SEQ ID NO: 211327 - DNA, 23 bp, Mus musculus
tcagacactgtctcactgaggct

SEQ ID NO: 211328 - DNA, 23 bp, Mus musculus
tagtccatggtgatatgatagga

SEQ ID NO: 211329 - DNA, 23 bp, Mus musculus
gtgttgactcactgactctctgc

SEQ ID NO: 211330 - DNA, 23 bp, Mus musculus
tatctggtacatatttgttcaga

SEQ ID NO: 211331 - DNA, 22 bp, Mus musculus
tgtgcatgtgtgtttgtgtgaa

SEQ ID NO: 211332 - DNA, 23 bp, Mus musculus
gattgtgcatgtgcatatgagtg

SEQ ID NO: 211333 - DNA, 23 bp, Mus musculus
gtctgtgcactgtgtgcacatgt

SEQ ID NO: 211334 - DNA, 23 bp, Mus musculus
tgtctgtgcatgtgtctgtgtgt

SEQ ID NO: 211335 - DNA, 22 bp, Mus musculus
attgagcatgtatatatgtgtg

SEQ ID NO: 211336 - DNA, 22 bp, Mus musculus
aggtcctaaagtcagagctgca

SEQ ID NO: 211337 - DNA, 22 bp, Mus musculus
tgtgtacttgtctgtgtatgtg

SEQ ID NO: 211338 - DNA, 22 bp, Mus musculus
tgactgagtcacagtaaggtga

SEQ ID NO: 211339 - DNA, 23 bp, Mus musculus
tatgtatatatgtatgtgtgtct

SEQ ID NO: 211340 - DNA, 20 bp, Mus musculus
agtctcctccttttttcttc

SEQ ID NO: 211341 - DNA, 23 bp, Mus musculus
cagtgttgatttgcatctgtgtc

SEQ ID NO: 211342 - DNA, 23 bp, Mus musculus
attgcttcatggatatggtatgt

SEQ ID NO: 211343 - DNA, 22 bp, Mus musculus
gtgagcacagactgaggagaca

SEQ ID NO: 211344 - DNA, 19 bp, Mus musculus
tgtttgtttacagcactgt

SEQ ID NO: 211345 - DNA, 18 bp, Mus musculus
tccaatcgacttcaaatg

SEQ ID NO: 211346 - DNA, 22 bp, Mus musculus
taactcatccagctttggagtg

SEQ ID NO: 211347 - DNA, 23 bp, Mus musculus
actgcctcagtgactctgtgttt

SEQ ID NO: 211348 - DNA, 23 bp, Mus musculus
agtcaagagtgaaagctgaagta

SEQ ID NO: 211349 - DNA, 20 bp, Mus musculus
tcagacacatggtgtgttat

SEQ ID NO: 211350 - DNA, 23 bp, Mus musculus
taggagtctgactttacagttct

SEQ ID NO: 211351 - DNA, 23 bp, Mus musculus
cagtttagctggagagatagctc

SEQ ID NO: 211352 - DNA, 23 bp, Mus musculus
tcactgtctcccattatgcccac

SEQ ID NO: 211353 - DNA, 20 bp, Mus musculus
aggctgagaatggtggagct

SEQ ID NO: 211354 - DNA, 23 bp, Mus musculus
aactggtagattccactagggtg

SEQ ID NO: 211355 - DNA, 22 bp, Mus musculus
atggcactgggagaagagtctg

SEQ ID NO: 211356 - DNA, 23 bp, Mus musculus
gtttatatgtatatgtgtgtgct

SEQ ID NO: 211357 - DNA, 21 bp, Mus musculus
atgtgtatgcatgtacatata

SEQ ID NO: 211358 - DNA, 23 bp, Mus musculus
tataagtgcatgcatatgtatgt

SEQ ID NO: 211359 - DNA, 21 bp, Mus musculus
tgagtgttctgtctgtggtct

SEQ ID NO: 211360 - DNA, 23 bp, Mus musculus
ctatggaactatgtatgactctt

SEQ ID NO: 211361 - DNA, 22 bp, Mus musculus
ttagtcacggtttctattcctg

SEQ ID NO: 211362 - DNA, 23 bp, Mus musculus
gattttgtttaacccaatggaag

SEQ ID NO: 211363 - DNA, 23 bp, Mus musculus
tgtacatccatatctatgtgtat

SEQ ID NO: 211364 - DNA, 23 bp, Mus musculus
tatacatatgtatgtatatatgt

SEQ ID NO: 211365 - DNA, 18 bp, Mus musculus
acctgcatctgtgatatt

SEQ ID NO: 211366 - DNA, 23 bp, Mus musculus
ctgggaagagagtttcactgacc

SEQ ID NO: 211367 - DNA, 23 bp, Mus musculus
ttctgtatgtatgtatgtatgta

SEQ ID NO: 211368 - DNA, 19 bp, Mus musculus
tgaactaagagcaatgtct

SEQ ID NO: 211369 - DNA, 22 bp, Mus musculus
tattgcacatctctggggctga

SEQ ID NO: 211370 - DNA, 19 bp, Mus musculus
tgagtgtagagagagagaa

SEQ ID NO: 211371 - DNA, 22 bp, Mus musculus
tgcctggcagcctgtgtgggtg

SEQ ID NO: 211372 - DNA, 23 bp, Mus musculus
tgaatatgtaaagatgtatgtgg

SEQ ID NO: 211373 - DNA, 23 bp, Mus musculus
gtgagtctgtccctctgtgagtg

SEQ ID NO: 211374 - DNA, 19 bp, Mus musculus
cctgcacagtatcactcag

SEQ ID NO: 211375 - DNA, 23 bp, Mus musculus
gtatatgtgcttgtgcatgtgca

SEQ ID NO: 211376 - DNA, 23 bp, Mus musculus
tctctgacattgtctctcaataa

SEQ ID NO: 211377 - DNA, 22 bp, Mus musculus
tctggaatgtagtctgctgctt

SEQ ID NO: 211378 - DNA, 23 bp, Mus musculus
gtgtctgtgtctctgtgtgtgta

SEQ ID NO: 211379 - DNA, 23 bp, Mus musculus
caagggcttttcttgtttgcaca

SEQ ID NO: 211380 - DNA, 22 bp, Mus musculus
tgcagggaagaaatggctctgt

SEQ ID NO: 211381 - DNA, 21 bp, Mus musculus
tgaggagctgatattgaggtt

SEQ ID NO: 211382 - DNA, 23 bp, Mus musculus
gtctctgtgtggaagtgttgtct

SEQ ID NO: 211383 - DNA, 23 bp, Mus musculus
tcagcgttgcttatgtatatata

SEQ ID NO: 211384 - DNA, 21 bp, Mus musculus
tgctcagcgagtttgaagagt

SEQ ID NO: 211385 - DNA, 21 bp, Mus musculus
tccatggtggtctgataggat

SEQ ID NO: 211386 - DNA, 23 bp, Mus musculus
tgttttgtgaccaattgtatggt

SEQ ID NO: 211387 - DNA, 23 bp, Mus musculus
agggactgaggacacttgctgtt

SEQ ID NO: 211388 - DNA, 23 bp, Mus musculus
atacacacacacatatgcgtgtg

SEQ ID NO: 211389 - DNA, 19 bp, Mus musculus
aagttcatgagctggagag

SEQ ID NO: 211390 - DNA, 23 bp, Mus musculus
gtctctgacactgtctgttctac

SEQ ID NO: 211391 - DNA, 21 bp, Mus musculus
cacaccctgtgtctcagccgc

SEQ ID NO: 211392 - DNA, 23 bp, Mus musculus
ttggctaaagtttcctgagtgtt

SEQ ID NO: 211393 - DNA, 23 bp, Mus musculus
tattacactcaagttatgatgat

SEQ ID NO: 211394 - DNA, 22 bp, Mus musculus
tacagaaaagcaacactaaatg

SEQ ID NO: 211395 - DNA, 21 bp, Mus musculus
tgtgatcctggttgtgtcaga

SEQ ID NO: 211396 - DNA, 22 bp, Mus musculus
tgactgagtctggatgatctgt

SEQ ID NO: 211397 - DNA, 22 bp, Mus musculus
tgtgtctctgtttagtttctgt

SEQ ID NO: 211398 - DNA, 23 bp, Mus musculus
atctgtacattgatgagagtggg

SEQ ID NO: 211399 - DNA, 21 bp, Mus musculus
agaaagagctctatctgggtc

SEQ ID NO: 211400 - DNA, 23 bp, Mus musculus
tttgacagcctctcactcactgt

SEQ ID NO: 211401 - DNA, 22 bp, Mus musculus
tcccagtgaaaaatggaagact

SEQ ID NO: 211402 - DNA, 21 bp, Mus musculus
tgaggctcactcagtgtttca

SEQ ID NO: 211403 - DNA, 18 bp, Mus musculus
aatgaattgaagtatgaa

SEQ ID NO: 211404 - DNA, 23 bp, Mus musculus
acagaggttaacagagtgttatt

SEQ ID NO: 211405 - DNA, 23 bp, Mus musculus
agaacactcagtttctgtagact

SEQ ID NO: 211406 - DNA, 22 bp, Mus musculus
gtctgtttgtgtacctgtatgt

SEQ ID NO: 211407 - DNA, 23 bp, Mus musculus
tttgtgttttcttgctttactca

SEQ ID NO: 211408 - DNA, 21 bp, Mus musculus
tacacacacgcatatatgtat

SEQ ID NO: 211409 - DNA, 22 bp, Mus musculus
tatgtatgtgtgtgtgtgtatg

SEQ ID NO: 211410 - DNA, 23 bp, Mus musculus
ctccttcacttttgattatgttt

SEQ ID NO: 211411 - DNA, 21 bp, Mus musculus
agaccttgctgccactgtgaa

SEQ ID NO: 211412 - DNA, 22 bp, Mus musculus
aattctcatattgtatatgtca

SEQ ID NO: 211413 - DNA, 22 bp, Mus musculus
catgtctgtgtgatagaatacg

SEQ ID NO: 211414 - DNA, 23 bp, Mus musculus
tctgactctgtgtctctgtatct

SEQ ID NO: 211415 - DNA, 19 bp, Mus musculus
tatgtatatatacatatgt

SEQ ID NO: 211416 - DNA, 21 bp, Mus musculus
acagactgtacagggttgagt

SEQ ID NO: 211417 - DNA, 23 bp, Mus musculus
tcaatatttttgtatctgttgag

SEQ ID NO: 211418 - DNA, 23 bp, Mus musculus
ggtccatggtgttctgataggat

SEQ ID NO: 211419 - DNA, 19 bp, Mus musculus
atcaagtgaccataggtgt

SEQ ID NO: 211420 - DNA, 23 bp, Mus musculus
tgtctcccactctccctctgtct

SEQ ID NO: 211421 - DNA, 21 bp, Mus musculus
taagcctttatttaccttact

SEQ ID NO: 211422 - DNA, 23 bp, Mus musculus
ggaaaatgtagtgatattgttgt

SEQ ID NO: 211423 - DNA, 21 bp, Mus musculus
tttgaatttggatgtatagtt

SEQ ID NO: 211424 - DNA, 19 bp, Mus musculus
tgtggctttaatttgacga

SEQ ID NO: 211425 - DNA, 23 bp, Mus musculus
aatgtctgtccaaattttttcat

SEQ ID NO: 211426 - DNA, 23 bp, Mus musculus
cacactgagaacttttcatgagt

SEQ ID NO: 211427 - DNA, 23 bp, Mus musculus
tgtctctgtgtgtgtgcatgccc

SEQ ID NO: 211428 - DNA, 23 bp, Mus musculus
aggtcagagatgagtgagtgctg

SEQ ID NO: 211429 - DNA, 22 bp, Mus musculus
tgttttgtgaccaattatatgg

SEQ ID NO: 211430 - DNA, 19 bp, Mus musculus
atacttcagagaaggcagt

SEQ ID NO: 211431 - DNA, 18 bp, Mus musculus
tgtctgcatgttcatata

SEQ ID NO: 211432 - DNA, 21 bp, Mus musculus
atgtatattttgtgcatgcag

SEQ ID NO: 211433 - DNA, 23 bp, Mus musculus
attttcttgttcacatttgcaga

SEQ ID NO: 211434 - DNA, 23 bp, Mus musculus
actgtgtctctgtttagtttctg

SEQ ID NO: 211435 - DNA, 23 bp, Mus musculus
tgtccattgatgagagtgggatg

SEQ ID NO: 211436 - DNA, 22 bp, Mus musculus
tgttttgtgaccaattatatgg

SEQ ID NO: 211437 - DNA, 22 bp, Mus musculus
tgttttgtgaccaattatatgg

SEQ ID NO: 211438 - DNA, 21 bp, Mus musculus
tcacttgatttcctttaggtg

SEQ ID NO: 211439 - DNA, 21 bp, Mus musculus
aaagtactaggttgaatagat

SEQ ID NO: 211440 - DNA, 23 bp, Mus musculus
tgtctgcatgtacatatgtatgt

SEQ ID NO: 211441 - DNA, 22 bp, Mus musculus
tatgcatttatatcaaatgtat

SEQ ID NO: 211442 - DNA, 22 bp, Mus musculus
actggctggctttgtgtgtctc

SEQ ID NO: 211443 - DNA, 20 bp, Mus musculus
agatgtggtcatagagtgtg

SEQ ID NO: 211444 - DNA, 21 bp, Mus musculus
agagtgtgtggcactggtagg

SEQ ID NO: 211445 - DNA, 23 bp, Mus musculus
tagtatcagagaatatgaagtta

SEQ ID NO: 211446 - DNA, 20 bp, Mus musculus
tatctccattcaaaacctgt

SEQ ID NO: 211447 - DNA, 23 bp, Mus musculus
agtctgggaggagatgaagtcag

SEQ ID NO: 211448 - DNA, 23 bp, Mus musculus
gcgtgtgtgtctgtctgtcattc

SEQ ID NO: 211449 - DNA, 18 bp, Mus musculus
tgtatatatgatatgcat

SEQ ID NO: 211450 - DNA, 23 bp, Mus musculus
atatatgtgcatatgtttacaca

SEQ ID NO: 211451 - DNA, 19 bp, Mus musculus
gacaacagaaggtggtggt

SEQ ID NO: 211452 - DNA, 21 bp, Mus musculus
ccccactgtctctgtctctgg

SEQ ID NO: 211453 - DNA, 22 bp, Mus musculus
tgtctcagtcagctgttggtag

SEQ ID NO: 211454 - DNA, 22 bp, Mus musculus
tccatgttgatctgataggatg

SEQ ID NO: 211455 - DNA, 21 bp, Mus musculus
tgttttgtgaccaattatgtg

SEQ ID NO: 211456 - DNA, 22 bp, Mus musculus
tgttttgtgaccaattatatgg

SEQ ID NO: 211457 - DNA, 23 bp, Mus musculus
tcttctgtatttctttaagtgag

SEQ ID NO: 211458 - DNA, 21 bp, Mus musculus
atgtaagtgtgcatgtgtgtg

SEQ ID NO: 211459 - DNA, 21 bp, Mus musculus
tgtatgcatgtatgtatgtgc

SEQ ID NO: 211460 - DNA, 23 bp, Mus musculus
tgtatgtgtgcatgtgtgtgagt

SEQ ID NO: 211461 - DNA, 22 bp, Mus musculus
tgctttggttttgactaacagg

SEQ ID NO: 211462 - DNA, 23 bp, Mus musculus
tttacggctggtttatgttgagt

SEQ ID NO: 211463 - DNA, 21 bp, Mus musculus
tgacttctgtgattttgttgt

SEQ ID NO: 211464 - DNA, 22 bp, Mus musculus
tgttttgtgaccaattatatgg

SEQ ID NO: 211465 - DNA, 23 bp, Mus musculus
atgaagctagaatttgattttgt

SEQ ID NO: 211466 - DNA, 22 bp, Mus musculus
ctgagtcactgtctttattctg

SEQ ID NO: 211467 - DNA, 23 bp, Mus musculus
tatgtgagggtgactagcaggtt

SEQ ID NO: 211468 - DNA, 23 bp, Mus musculus
tctttggttatctagctgtatga

SEQ ID NO: 211469 - DNA, 22 bp, Mus musculus
ataaagctagataaccgaaagt

SEQ ID NO: 211470 - DNA, 22 bp, Mus musculus
agaggtagtatgtatgtatgta

SEQ ID NO: 211471 - DNA, 23 bp, Mus musculus
tgtatgcatgtatgtatgtatgt

SEQ ID NO: 211472 - DNA, 22 bp, Mus musculus
aggctctgtggagatggttctg

SEQ ID NO: 211473 - DNA, 23 bp, Mus musculus
aatactggcagcatttcagactg

SEQ ID NO: 211474 - DNA, 23 bp, Mus musculus
gtgtaatcttggttttgatttct

SEQ ID NO: 211475 - DNA, 23 bp, Mus musculus
ttgagtgtttgtatttctgtaag

SEQ ID NO: 211476 - DNA, 23 bp, Mus musculus
tagtgcatggtgatctgatagga

SEQ ID NO: 211477 - DNA, 18 bp, Mus musculus
tttgtgacctattatgtg

SEQ ID NO: 211478 - DNA, 23 bp, Mus musculus
atttcctcctacagagttgactc

SEQ ID NO: 211479 - DNA, 23 bp, Mus musculus
ttttgtgaccaattgtatggtca

SEQ ID NO: 211480 - DNA, 23 bp, Mus musculus
ctactaagcctagagtctctctc

SEQ ID NO: 211481 - DNA, 22 bp, Mus musculus
tctgataggataaatgggacaa

SEQ ID NO: 211482 - DNA, 22 bp, Mus musculus
tgttttgtgaccaattatatgg

SEQ ID NO: 211483 - DNA, 22 bp, Mus musculus
tgttttgtgaccaattatatgg

SEQ ID NO: 211484 - DNA, 22 bp, Mus musculus
tgttttgtgaccaattatatgg

SEQ ID NO: 211485 - DNA, 23 bp, Mus musculus
aaaggaactatatcattctgaat

SEQ ID NO: 211486 - DNA, 23 bp, Mus musculus
tatatcaagttggtgctatgttc

SEQ ID NO: 211487 - DNA, 23 bp, Mus musculus
acaattctactgtctgtctttgt

SEQ ID NO: 211488 - DNA, 22 bp, Mus musculus
ccttctcagcaggtatcagtag

SEQ ID NO: 211489 - DNA, 20 bp, Mus musculus
agaagagagattgtctagtt

SEQ ID NO: 211490 - DNA, 22 bp, Mus musculus
tgttttgtgaccaattatatgg

SEQ ID NO: 211491 - DNA, 22 bp, Mus musculus
ccacagactctctgggtccctg

SEQ ID NO: 211492 - DNA, 23 bp, Mus musculus
attatgatgatgatgatgatgat

SEQ ID NO: 211493 - DNA, 22 bp, Mus musculus
tgtggatgtatgtacatatgta

SEQ ID NO: 211494 - DNA, 20 bp, Mus musculus
tgtgacatcagtgagaggag

SEQ ID NO: 211495 - DNA, 22 bp, Mus musculus
tgttttgtgaccaattatatgg

SEQ ID NO: 211496 - DNA, 19 bp, Mus musculus
atatccatatgtatatata

SEQ ID NO: 211497 - DNA, 22 bp, Mus musculus
atataccatgtatatattatct

SEQ ID NO: 211498 - DNA, 23 bp, Mus musculus
tgtttgctgcaatatatttgatt

SEQ ID NO: 211499 - DNA, 19 bp, Mus musculus
cctagagtctccctcatgt

SEQ ID NO: 211500 - DNA, 22 bp, Mus musculus
tgttttgtgaccaattatatgg

SEQ ID NO: 211501 - DNA, 23 bp, Mus musculus
cagtgtctctgtttagtttctgt

SEQ ID NO: 211502 - DNA, 23 bp, Mus musculus
aggatctgtccattgatgagagt

SEQ ID NO: 211503 - DNA, 19 bp, Mus musculus
attacaggcttcagtcagc

SEQ ID NO: 211504 - DNA, 20 bp, Mus musculus
atacacacacacatacatat

SEQ ID NO: 211505 - DNA, 23 bp, Mus musculus
tatgatgatgatgatgatgatga

SEQ ID NO: 211506 - DNA, 23 bp, Mus musculus
atctcatatactgtcagtttctg

SEQ ID NO: 211507 - DNA, 18 bp, Mus musculus
tatacattccatatatat

SEQ ID NO: 211508 - DNA, 23 bp, Mus musculus
acaaacacctctaactgtctctc

SEQ ID NO: 211509 - DNA, 23 bp, Mus musculus
aggactgggtgtgtgtcttcact

SEQ ID NO: 211510 - DNA, 23 bp, Mus musculus
ttttgtctgtacataaggaccac

SEQ ID NO: 211511 - DNA, 19 bp, Mus musculus
ttagtgggacttctcttga

SEQ ID NO: 211512 - DNA, 23 bp, Mus musculus
cctctctgactctctgcctcaga

SEQ ID NO: 211513 - DNA, 23 bp, Mus musculus
actgaacaatgtatgcagaactg

SEQ ID NO: 211514 - DNA, 23 bp, Mus musculus
caaacactgtcaggttttgttca

SEQ ID NO: 211515 - DNA, 20 bp, Mus musculus
atgtatgtatatatatgcat

SEQ ID NO: 211516 - DNA, 23 bp, Mus musculus
tatgtgtatatatgtatgtgtgt

SEQ ID NO: 211517 - DNA, 23 bp, Mus musculus
atcttgtgaattcagaatttgtt

SEQ ID NO: 211518 - DNA, 23 bp, Mus musculus
tatgacaggagacactgtgaact

SEQ ID NO: 211519 - DNA, 19 bp, Mus musculus
cagaacagaaacaggtata

SEQ ID NO: 211520 - DNA, 23 bp, Mus musculus
tgatgaggtacttggttcatttc

SEQ ID NO: 211521 - DNA, 21 bp, Mus musculus
tacatatgtgtagatgtacat

SEQ ID NO: 211522 - DNA, 22 bp, Mus musculus
tatatgtatatatacatgtgtg

SEQ ID NO: 211523 - DNA, 23 bp, Mus musculus
gtttctccttgtgaaatgtatgt

SEQ ID NO: 211524 - DNA, 22 bp, Mus musculus
tgttttgtgaccaattatatgg

SEQ ID NO: 211525 - DNA, 21 bp, Mus musculus
aagcagcctctctctgtcttt

SEQ ID NO: 211526 - DNA, 23 bp, Mus musculus
tgtttgtatgtgtgcatgtgtat

SEQ ID NO: 211527 - DNA, 23 bp, Mus musculus
tctgtctgtatgtctgtatacca

SEQ ID NO: 211528 - DNA, 22 bp, Mus musculus
tcagagtctggctgtctctggg

SEQ ID NO: 211529 - DNA, 23 bp, Mus musculus
agggtaaaagcacagactgctct

SEQ ID NO: 211530 - DNA, 23 bp, Mus musculus
tgtatgtgtatgtatgtatatgt

SEQ ID NO: 211531 - DNA, 23 bp, Mus musculus
atgtgtatatgtatatatgtgtg

SEQ ID NO: 211532 - DNA, 23 bp, Mus musculus
tctgtctgtctgtctgtctaact

SEQ ID NO: 211533 - DNA, 18 bp, Mus musculus
agagagaacagtcagagg

SEQ ID NO: 211534 - DNA, 23 bp, Mus musculus
gtggtattctcatgctgctggtg

SEQ ID NO: 211535 - DNA, 23 bp, Mus musculus
tgcctgcctgcctgcctgcctgc

SEQ ID NO: 211536 - DNA, 18 bp, Mus musculus
tatgtgttagttctttgc

SEQ ID NO: 211537 - DNA, 20 bp, Mus musculus
tgagaggactgagacagcac

SEQ ID NO: 211538 - DNA, 21 bp, Mus musculus
aaaggaactttgtaggtgtga

SEQ ID NO: 211539 - DNA, 19 bp, Mus musculus
tccactacgaggtctctga

SEQ ID NO: 211540 - DNA, 23 bp, Mus musculus
aagagtacagagttagctcttct

SEQ ID NO: 211541 - DNA, 20 bp, Mus musculus
ccgcttccagtttgggaaga

SEQ ID NO: 211542 - DNA, 23 bp, Mus musculus
tatatgtatgtgtgcatgtgttt

SEQ ID NO: 211543 - DNA, 23 bp, Mus musculus
gtatgtatgtatgtatgtgcatg

SEQ ID NO: 211544 - DNA, 21 bp, Mus musculus
gtatgtatgtatgtatgtatg

SEQ ID NO: 211545 - DNA, 21 bp, Mus musculus
tccatggtggtctgataggat

SEQ ID NO: 211546 - DNA, 22 bp, Mus musculus
accttgagggactggagagatg

SEQ ID NO: 211547 - DNA, 23 bp, Mus musculus
gtgttatttgtggttctcttgag

SEQ ID NO: 211548 - DNA, 22 bp, Mus musculus
atttatgtatatcatcatgtgg

SEQ ID NO: 211549 - DNA, 22 bp, Mus musculus
tgttttgtgaccaattatatgg

SEQ ID NO: 211550 - DNA, 20 bp, Mus musculus
ttatgtcctatatgcataca

SEQ ID NO: 211551 - DNA, 23 bp, Mus musculus
acactctctctgtgtgtcacctg

SEQ ID NO: 211552 - DNA, 23 bp, Mus musculus
acactctctctgtgtgtcacctg

SEQ ID NO: 211553 - DNA, 18 bp, Mus musculus
tccctgtgtgtcacctgg

SEQ ID NO: 211554 - DNA, 23 bp, Mus musculus
tacactctccctgtgtgtcacct

SEQ ID NO: 211555 - DNA, 23 bp, Mus musculus
agcacgtgagtgtgctcacagcg

SEQ ID NO: 211556 - DNA, 23 bp, Mus musculus
atcagaggttcctagttgttggt

SEQ ID NO: 211557 - DNA, 23 bp, Mus musculus
actgctctctctctctctatata

SEQ ID NO: 211558 - DNA, 23 bp, Mus musculus
tcagtctctgtgtgcttagaagg

SEQ ID NO: 211559 - DNA, 18 bp, Mus musculus
tgacagatgaaagagacc

SEQ ID NO: 211560 - DNA, 22 bp, Mus musculus
ctctgtgagcctgtgagcactc

SEQ ID NO: 211561 - DNA, 23 bp, Mus musculus
tatcatgtcagtatctctagatg

SEQ ID NO: 211562 - DNA, 19 bp, Mus musculus
atttgtatatatgtagttg

SEQ ID NO: 211563 - DNA, 23 bp, Mus musculus
ttgttatctgtgtgtgtgtgtgc

SEQ ID NO: 211564 - DNA, 22 bp, Mus musculus
acacacagaggtatgtatgagt

SEQ ID NO: 211565 - DNA, 20 bp, Mus musculus
agagaccaacagatacacag

SEQ ID NO: 211566 - DNA, 23 bp, Mus musculus
tatatgtgtacatattcatatgt

SEQ ID NO: 211567 - DNA, 19 bp, Mus musculus
gatggatgagacagtgcag

SEQ ID NO: 211568 - DNA, 23 bp, Mus musculus
tttagtgaagattcaaagctgtc

SEQ ID NO: 211569 - DNA, 23 bp, Mus musculus
aagtttgttctctctctctctca

SEQ ID NO: 211570 - DNA, 23 bp, Mus musculus
atatgtgtatatgtatatctgtg

SEQ ID NO: 211571 - DNA, 23 bp, Mus musculus
ctgtcaccctctccctctgtctt

SEQ ID NO: 211572 - DNA, 23 bp, Mus musculus
tttgactcaagagacagagggca

SEQ ID NO: 211573 - DNA, 18 bp, Mus musculus
cacctgcttgagttccag

SEQ ID NO: 211574 - DNA, 22 bp, Mus musculus
tcagtgagctaacagacacaca

SEQ ID NO: 211575 - DNA, 19 bp, Mus musculus
cttattaaactgcatctgg

SEQ ID NO: 211576 - DNA, 22 bp, Mus musculus
atttgcaagtgaagatgtgtga

SEQ ID NO: 211577 - DNA, 23 bp, Mus musculus
gggtctcactctgcttctgtatt

SEQ ID NO: 211578 - DNA, 20 bp, Mus musculus
ttgagtgaagtgagccagga

SEQ ID NO: 211579 - DNA, 22 bp, Mus musculus
tgttttgtgaccaattatatgg

SEQ ID NO: 211580 - DNA, 23 bp, Mus musculus
tgtatatgtatgtgtatatgtat

SEQ ID NO: 211581 - DNA, 21 bp, Mus musculus
tatatgttatgtatacatgta

SEQ ID NO: 211582 - DNA, 23 bp, Mus musculus
taagagcactgactgctcttcca

SEQ ID NO: 211583 - DNA, 19 bp, Mus musculus
tacatacacacatacatgt

SEQ ID NO: 211584 - DNA, 23 bp, Mus musculus
atacatgtatgtgtgtatgtgta

SEQ ID NO: 211585 - DNA, 23 bp, Mus musculus
gtgtactggatttgtaaatgtga

SEQ ID NO: 211586 - DNA, 23 bp, Mus musculus
tctgcctctctctggctcactgg

SEQ ID NO: 211587 - DNA, 23 bp, Mus musculus
atgagagcttgttggttcttaag

SEQ ID NO: 211588 - DNA, 19 bp, Mus musculus
agaatgagttgggtagagt

SEQ ID NO: 211589 - DNA, 23 bp, Mus musculus
ccagctctgtgtgtgtctctctc

SEQ ID NO: 211590 - DNA, 22 bp, Mus musculus
atgtatgtatatgtgtgtctgt

SEQ ID NO: 211591 - DNA, 22 bp, Mus musculus
tatgtatgtatgtatatgtgtg

SEQ ID NO: 211592 - DNA, 21 bp, Mus musculus
tgaaatgtagtcttcgggggc

SEQ ID NO: 211593 - DNA, 20 bp, Mus musculus
agctcctcttccttctggtt

SEQ ID NO: 211594 - DNA, 23 bp, Mus musculus
tctgcctctgagcctctctcagg

SEQ ID NO: 211595 - DNA, 23 bp, Mus musculus
tctgtctgtctgtctgtctgtgc

SEQ ID NO: 211596 - DNA, 22 bp, Mus musculus
agcatcttctggggctggagag

SEQ ID NO: 211597 - DNA, 23 bp, Mus musculus
tgtttcttttgcatgtgtgtgag

SEQ ID NO: 211598 - DNA, 23 bp, Mus musculus
tatttgtagaagaagctgagcag

SEQ ID NO: 211599 - DNA, 22 bp, Mus musculus
tgttctgtgaggctttgatgcc

SEQ ID NO: 211600 - DNA, 23 bp, Mus musculus
tgtgtgctctctctgtgtgaggg

SEQ ID NO: 211601 - DNA, 23 bp, Mus musculus
gagactctcgcagtgtctttctg

SEQ ID NO: 211602 - DNA, 22 bp, Mus musculus
ttaaggtttcagaggaatgatt

SEQ ID NO: 211603 - DNA, 19 bp, Mus musculus
acacagactgcacatgaca

SEQ ID NO: 211604 - DNA, 23 bp, Mus musculus
tttctgtctgtgtgtctgcctga

SEQ ID NO: 211605 - DNA, 23 bp, Mus musculus
tgtctgtcccactgactctggga

SEQ ID NO: 211606 - DNA, 22 bp, Mus musculus
agtgaacattctagtctgtctc

SEQ ID NO: 211607 - DNA, 20 bp, Mus musculus
tagtccttgctgtcttggag

SEQ ID NO: 211608 - DNA, 20 bp, Mus musculus
tgggtcactgaatctctcag

SEQ ID NO: 211609 - DNA, 23 bp, Mus musculus
tgatgtgccactcactgggtcac

SEQ ID NO: 211610 - DNA, 19 bp, Mus musculus
tgtatgtatgtacatatgt

SEQ ID NO: 211611 - DNA, 18 bp, Mus musculus
tgcatgtatgcatgtatg

SEQ ID NO: 211612 - DNA, 19 bp, Mus musculus
catgacagagggttgttga

SEQ ID NO: 211613 - DNA, 18 bp, Mus musculus
atgtctgtgtgtgcatgt

SEQ ID NO: 211614 - DNA, 18 bp, Mus musculus
gcagaagatgatgtggag

SEQ ID NO: 211615 - DNA, 20 bp, Mus musculus
ctcacagaagagagtgcaga

SEQ ID NO: 211616 - DNA, 20 bp, Mus musculus
tatgtgtatatgtatatatg

SEQ ID NO: 211617 - DNA, 19 bp, Mus musculus
atatgtgcatgtaacttga

SEQ ID NO: 211618 - DNA, 23 bp, Mus musculus
tcactgtgagcagtctcagtgga

SEQ ID NO: 211619 - DNA, 22 bp, Mus musculus
ttcaattctcagctaccacatg

SEQ ID NO: 211620 - DNA, 20 bp, Mus musculus
ttaagagcactgactgctct

SEQ ID NO: 211621 - DNA, 20 bp, Mus musculus
tggatcagactgtcctcaag

SEQ ID NO: 211622 - DNA, 19 bp, Mus musculus
gcatcatctggcagtccac

SEQ ID NO: 211623 - DNA, 21 bp, Mus musculus
agtctgtaatcatcttgaggc

SEQ ID NO: 211624 - DNA, 19 bp, Mus musculus
tggcagactgagaacctgc

SEQ ID NO: 211625 - DNA, 23 bp, Mus musculus
gccgacagtcagtctgtctgtcc

SEQ ID NO: 211626 - DNA, 19 bp, Mus musculus
acagttgtgtgtgctcagt

SEQ ID NO: 211627 - DNA, 23 bp, Mus musculus
cctctctcactctgggtcttaca

SEQ ID NO: 211628 - DNA, 22 bp, Mus musculus
atcaagcaggtataggtaagag

SEQ ID NO: 211629 - DNA, 23 bp, Mus musculus
taaatgtcactgcttcctcagcc

SEQ ID NO: 211630 - DNA, 20 bp, Mus musculus
tatgtgtatatatatgtatg

SEQ ID NO: 211631 - DNA, 23 bp, Mus musculus
agcctccctctgtgcctgttagt

SEQ ID NO: 211632 - DNA, 23 bp, Mus musculus
tctgtctgtttgtctgtctgcct

SEQ ID NO: 211633 - DNA, 19 bp, Mus musculus
ttcttgttcctgatcttga

SEQ ID NO: 211634 - DNA, 23 bp, Mus musculus
tggttcgctccgtctgtctcacc

SEQ ID NO: 211635 - DNA, 18 bp, Mus musculus
actggagagatggctcaa

SEQ ID NO: 211636 - DNA, 20 bp, Mus musculus
tggctctgactatcctggaa

SEQ ID NO: 211637 - DNA, 19 bp, Mus musculus
tgagtctgcacacagcctg

SEQ ID NO: 211638 - DNA, 23 bp, Mus musculus
ttcttgttgtttctggtttgaga

SEQ ID NO: 211639 - DNA, 23 bp, Mus musculus
tgtccaggaactcactctgtaga

SEQ ID NO: 211640 - DNA, 23 bp, Mus musculus
tgtgagtctgtgaaacttttagg

SEQ ID NO: 211641 - DNA, 21 bp, Mus musculus
tgtctgtgagtcccactgaca

SEQ ID NO: 211642 - DNA, 22 bp, Mus musculus
gtctgcctgtctgcctgcctgt

SEQ ID NO: 211643 - DNA, 23 bp, Mus musculus
gtatgcatgtatgtatgtatcta

SEQ ID NO: 211644 - DNA, 23 bp, Mus musculus
atgtgtgtgtgtgtatgtgcatg

SEQ ID NO: 211645 - DNA, 22 bp, Mus musculus
tgttttgtgaccaattatatgg

SEQ ID NO: 211646 - DNA, 19 bp, Mus musculus
tgtagaccaggctgtcctc

SEQ ID NO: 211647 - DNA, 22 bp, Mus musculus
atgtatgtatatatatgtgtgt

SEQ ID NO: 211648 - DNA, 23 bp, Mus musculus
aggttgtttttagttcaagtctt

SEQ ID NO: 211649 - DNA, 19 bp, Mus musculus
tgagaaggagaggctctgt

SEQ ID NO: 211650 - DNA, 22 bp, Mus musculus
taaggtacaaggttttatacta

SEQ ID NO: 211651 - DNA, 23 bp, Mus musculus
atgtatgtatgtatgtatgtatg

SEQ ID NO: 211652 - DNA, 23 bp, Mus musculus
tctgcttctgtctgtctgtgtgg

SEQ ID NO: 211653 - DNA, 23 bp, Mus musculus
aacacagttgagtcatccttttc

SEQ ID NO: 211654 - DNA, 23 bp, Mus musculus
atgcagtcagtcttcagagagtt

SEQ ID NO: 211655 - DNA, 22 bp, Mus musculus
tctcactgtgggttttttatct

SEQ ID NO: 211656 - DNA, 18 bp, Mus musculus
gtatatatacatgtgtat

SEQ ID NO: 211657 - DNA, 23 bp, Mus musculus
agcatcttcacccttctctctgg

SEQ ID NO: 211658 - DNA, 20 bp, Mus musculus
ccttagtgtcacctaaatgt

SEQ ID NO: 211659 - DNA, 23 bp, Mus musculus
actgcctccactgtcactgtcac

SEQ ID NO: 211660 - DNA, 23 bp, Mus musculus
tgtctggaaggttgtctggctct

SEQ ID NO: 211661 - DNA, 23 bp, Mus musculus
tgtatatgagtatatgtatatgt

SEQ ID NO: 211662 - DNA, 22 bp, Mus musculus
atcctgggtgtgtctgagctcc

SEQ ID NO: 211663 - DNA, 21 bp, Mus musculus
tctcatgtacaacttctctgt

SEQ ID NO: 211664 - DNA, 19 bp, Mus musculus
tctgtgtcacatataagac

SEQ ID NO: 211665 - DNA, 23 bp, Mus musculus
aattcaacaaattgaaatcacaa

SEQ ID NO: 211666 - DNA, 18 bp, Mus musculus
atgagcagagatacatct

SEQ ID NO: 211667 - DNA, 23 bp, Mus musculus
tgtgtatatgtatatatgttcat

SEQ ID NO: 211668 - DNA, 23 bp, Mus musculus
tatgtgtgtatatatatgtgtgt

SEQ ID NO: 211669 - DNA, 23 bp, Mus musculus
ttgtgtggctctggttcctgaaa

SEQ ID NO: 211670 - DNA, 22 bp, Mus musculus
atgcatgtatacgcatatgaaa

SEQ ID NO: 211671 - DNA, 22 bp, Mus musculus
gtgtctctcagtctgtgggcaa

SEQ ID NO: 211672 - DNA, 23 bp, Mus musculus
gagtgaggagtctcaggttagca

SEQ ID NO: 211673 - DNA, 22 bp, Mus musculus
tgttttgtgaccaattatatgg

SEQ ID NO: 211674 - DNA, 23 bp, Mus musculus
atagactcacaagagagagagct

SEQ ID NO: 211675 - DNA, 22 bp, Mus musculus
tcctgtcagcaaaatctttctg

SEQ ID NO: 211676 - DNA, 23 bp, Mus musculus
tcgctggctcactcactgactca

SEQ ID NO: 211677 - DNA, 23 bp, Mus musculus
tatgtgcatgtgcatgtgtctgt

SEQ ID NO: 211678 - DNA, 19 bp, Mus musculus
tgaggtggttttgagagca

SEQ ID NO: 211679 - DNA, 20 bp, Mus musculus
tacaggaagctgaagatgcc

SEQ ID NO: 211680 - DNA, 22 bp, Mus musculus
tagtggtagaaggttggttgga

SEQ ID NO: 211681 - DNA, 23 bp, Mus musculus
actttgtctggcagttatgagct

SEQ ID NO: 211682 - DNA, 23 bp, Mus musculus
ttttctttttgtaagcatgactt

SEQ ID NO: 211683 - DNA, 19 bp, Mus musculus
aaaggggtattgaaagccc

SEQ ID NO: 211684 - DNA, 19 bp, Mus musculus
acacactcagacaaatagg

SEQ ID NO: 211685 - DNA, 23 bp, Mus musculus
atgagcacagggataagaatcag

SEQ ID NO: 211686 - DNA, 22 bp, Mus musculus
tgttttgtgaccaattatatgg

SEQ ID NO: 211687 - DNA, 23 bp, Mus musculus
tcttctgagtggctcttctttat

SEQ ID NO: 211688 - DNA, 21 bp, Mus musculus
aaactcagaccactactgaga

SEQ ID NO: 211689 - DNA, 21 bp, Mus musculus
taaggtgcatatgatatgcat

SEQ ID NO: 211690 - DNA, 19 bp, Mus musculus
tttgtcctactcttctgtt

SEQ ID NO: 211691 - DNA, 23 bp, Mus musculus
tgagctcagttctgtgtctgtag

SEQ ID NO: 211692 - DNA, 22 bp, Mus musculus
agacagaagaggcaagcctggt

SEQ ID NO: 211693 - DNA, 23 bp, Mus musculus
ctctgtctctctgtctgctgtat

SEQ ID NO: 211694 - DNA, 23 bp, Mus musculus
cacccatcactctctctctgctt

SEQ ID NO: 211695 - DNA, 23 bp, Mus musculus
tagtccatagtgatctgatagga

SEQ ID NO: 211696 - DNA, 22 bp, Mus musculus
tgttttgtgaccaattatatgg

SEQ ID NO: 211697 - DNA, 23 bp, Mus musculus
gagatctgtatgtctcagctacg

SEQ ID NO: 211698 - DNA, 18 bp, Mus musculus
tctcactcagacccactg

SEQ ID NO: 211699 - DNA, 23 bp, Mus musculus
aatgtgtatatataagtgtgtgt

SEQ ID NO: 211700 - DNA, 23 bp, Mus musculus
agtcacaagacagtgcgtgcaga

SEQ ID NO: 211701 - DNA, 23 bp, Mus musculus
tgtggcactggtagaagacagtg

SEQ ID NO: 211702 - DNA, 23 bp, Mus musculus
atgctttcagaaacttttttgtg

SEQ ID NO: 211703 - DNA, 20 bp, Mus musculus
caaataggtcacactgcaga

SEQ ID NO: 211704 - DNA, 19 bp, Mus musculus
aaagggcatacagtggcag

SEQ ID NO: 211705 - DNA, 23 bp, Mus musculus
gattcttggttctttccttccat

SEQ ID NO: 211706 - DNA, 21 bp, Mus musculus
tgaagctcaaattatagtaca

SEQ ID NO: 211707 - DNA, 18 bp, Mus musculus
agacagatgtgtgtgtgt

SEQ ID NO: 211708 - DNA, 18 bp, Mus musculus
acagatgtgtgtgtgtgc

SEQ ID NO: 211709 - DNA, 18 bp, Mus musculus
agacagatgtgtgtgtgt

SEQ ID NO: 211710 - DNA, 18 bp, Mus musculus
acagatgtgtgtgtgtgc

SEQ ID NO: 211711 - DNA, 18 bp, Mus musculus
acagatgtgtgtgtgccc

SEQ ID NO: 211712 - DNA, 23 bp, Mus musculus
tgtggttagatgtagattctgca

SEQ ID NO: 211713 - DNA, 22 bp, Mus musculus
tgttttgtgaccaattatatgg

SEQ ID NO: 211714 - DNA, 23 bp, Mus musculus
tgtgactgtgaatatgtatatgt

SEQ ID NO: 211715 - DNA, 22 bp, Mus musculus
tgttttgtgaccaattatatgg

SEQ ID NO: 211716 - DNA, 23 bp, Mus musculus
gatctaggttacagtgtgatttg

SEQ ID NO: 211717 - DNA, 18 bp, Mus musculus
tgtgtgtatatatatatg

SEQ ID NO: 211718 - DNA, 23 bp, Mus musculus
tatgtatatatacatgtgtatac

SEQ ID NO: 211719 - DNA, 23 bp, Mus musculus
aagccgattcttgatttcactag

SEQ ID NO: 211720 - DNA, 20 bp, Mus musculus
aagtgtagtgatattattca

SEQ ID NO: 211721 - DNA, 19 bp, Mus musculus
atatgtatatatatatatg

SEQ ID NO: 211722 - DNA, 22 bp, Mus musculus
tatactgtatacatatatatgt

SEQ ID NO: 211723 - DNA, 23 bp, Mus musculus
tatatgtatgtatgcatatgtgt

SEQ ID NO: 211724 - DNA, 18 bp, Mus musculus
tatatgtgtgcatgtgta

SEQ ID NO: 211725 - DNA, 23 bp, Mus musculus
ctgtgtctatgtgtctctatgtg

SEQ ID NO: 211726 - DNA, 23 bp, Mus musculus
caatacaacctgcacagtgtgta

SEQ ID NO: 211727 - DNA, 23 bp, Mus musculus
tgtctctctctgagtgtgttctt

SEQ ID NO: 211728 - DNA, 21 bp, Mus musculus
acatatgcagctagagacacg

SEQ ID NO: 211729 - DNA, 23 bp, Mus musculus
tgtgtatgtgtatgtatatgtat

SEQ ID NO: 211730 - DNA, 22 bp, Mus musculus
atattgcatatatatacacata

SEQ ID NO: 211731 - DNA, 21 bp, Mus musculus
gcaagcaattgtagggctctg

SEQ ID NO: 211732 - DNA, 20 bp, Mus musculus
tgtgtggtcaacaatttcct

SEQ ID NO: 211733 - DNA, 23 bp, Mus musculus
aacactgactgctcttccagagg

SEQ ID NO: 211734 - DNA, 22 bp, Mus musculus
tgttttgtgaccaattatatgg

SEQ ID NO: 211735 - DNA, 23 bp, Mus musculus
taggtgtgtcactgtgggtgtgg

SEQ ID NO: 211736 - DNA, 23 bp, Mus musculus
aggtagaacacagttctgattct

SEQ ID NO: 211737 - DNA, 22 bp, Mus musculus
aggaatgaaatggagaaagatg

SEQ ID NO: 211738 - DNA, 23 bp, Mus musculus
tgctcttcagtctgtctctgcct

SEQ ID NO: 211739 - DNA, 18 bp, Mus musculus
taagtggtatctatctgt

SEQ ID NO: 211740 - DNA, 21 bp, Mus musculus
atgtatgtatgcatgtatgtg

SEQ ID NO: 211741 - DNA, 23 bp, Mus musculus
tctgagaggccattcagattgag

SEQ ID NO: 211742 - DNA, 23 bp, Mus musculus
caatatttttgtatctgttgagg

SEQ ID NO: 211743 - DNA, 23 bp, Mus musculus
atgtgtgtgtgtatgtatctgtg

SEQ ID NO: 211744 - DNA, 23 bp, Mus musculus
aaagagagagactccagtgtggg

SEQ ID NO: 211745 - DNA, 23 bp, Mus musculus
catttaacaggctggacatgacc

SEQ ID NO: 211746 - DNA, 23 bp, Mus musculus
tccttctctagtccatactgaaa

SEQ ID NO: 211747 - DNA, 23 bp, Mus musculus
aaacacatatgtatagatgtgtg

SEQ ID NO: 211748 - DNA, 23 bp, Mus musculus
ttgtctatgcagcatgtttgagg

SEQ ID NO: 211749 - DNA, 21 bp, Mus musculus
ttaagagcacatactgctgtt

SEQ ID NO: 211750 - DNA, 23 bp, Mus musculus
ctaccctgtgtctgtctctgcca

SEQ ID NO: 211751 - DNA, 23 bp, Mus musculus
gtatgtatatatgtgttatatgc

SEQ ID NO: 211752 - DNA, 23 bp, Mus musculus
tgtgtgtgtgtgtttgtgcatga

SEQ ID NO: 211753 - DNA, 20 bp, Mus musculus
agaccagtgtcagcagagag

SEQ ID NO: 211754 - DNA, 23 bp, Mus musculus
ctctgtctgtggctgtctggtgt

SEQ ID NO: 211755 - DNA, 23 bp, Mus musculus
atgtatgtgtgtatgctgtatgt

SEQ ID NO: 211756 - DNA, 23 bp, Mus musculus
gctgtgtgtgtgtgtctcagagg

SEQ ID NO: 211757 - DNA, 20 bp, Mus musculus
tcacagaactgagtgacttg

SEQ ID NO: 211758 - DNA, 19 bp, Mus musculus
tgccaaggactgtgtatcc

SEQ ID NO: 211759 - DNA, 23 bp, Mus musculus
gttgcaacttcttgcaggtgtgt

SEQ ID NO: 211760 - DNA, 19 bp, Mus musculus
actctgtggttaatgtttc

SEQ ID NO: 211761 - DNA, 21 bp, Mus musculus
atagatgtgtgtgtgtatgct

SEQ ID NO: 211762 - DNA, 18 bp, Mus musculus
aggctgtgagattcattg

SEQ ID NO: 211763 - DNA, 23 bp, Mus musculus
acagcctgtcagtctgtgtgagt

SEQ ID NO: 211764 - DNA, 19 bp, Mus musculus
gggagtgtcactctcagtc

SEQ ID NO: 211765 - DNA, 19 bp, Mus musculus
tgtctacgtccttgtctgt

SEQ ID NO: 211766 - DNA, 20 bp, Mus musculus
gacagacagacagacagaca

SEQ ID NO: 211767 - DNA, 23 bp, Mus musculus
acagggtctgtgtgttccctagc

SEQ ID NO: 211768 - DNA, 20 bp, Mus musculus
tcaggcactctttctgtctc

SEQ ID NO: 211769 - DNA, 23 bp, Mus musculus
acagaacagacagacatcaagct

SEQ ID NO: 211770 - DNA, 23 bp, Mus musculus
cacacacacatatatgtgtgtgt

SEQ ID NO: 211771 - DNA, 23 bp, Mus musculus
gtaggcagtgttgttagctggct

SEQ ID NO: 211772 - DNA, 21 bp, Mus musculus
tgacagttcagtgtcaggtca

SEQ ID NO: 211773 - DNA, 23 bp, Mus musculus
tgtgcctgctctgtgtcaggtca

SEQ ID NO: 211774 - DNA, 23 bp, Mus musculus
ctgtctctacctcactctctcat

SEQ ID NO: 211775 - DNA, 23 bp, Mus musculus
tcagtgggagtgtctttgaagat

SEQ ID NO: 211776 - DNA, 21 bp, Mus musculus
tctttacaatgtttgtaaatg

SEQ ID NO: 211777 - DNA, 20 bp, Mus musculus
tgcatgagacgttaatttga

SEQ ID NO: 211778 - DNA, 23 bp, Mus musculus
aaattcgatgtatatgtttccat

SEQ ID NO: 211779 - DNA, 23 bp, Mus musculus
taattgtgtgttgaaatgatttg

SEQ ID NO: 211780 - DNA, 22 bp, Mus musculus
tatatgtatatgtatatgaata

SEQ ID NO: 211781 - DNA, 23 bp, Mus musculus
tctttcagcgtctctgtgtctca

SEQ ID NO: 211782 - DNA, 18 bp, Mus musculus
tagagttcagatctctga

SEQ ID NO: 211783 - DNA, 23 bp, Mus musculus
tctctgaggctctctgagtgtga

SEQ ID NO: 211784 - DNA, 23 bp, Mus musculus
ttcttcacttgtgattttcctgt

SEQ ID NO: 211785 - DNA, 22 bp, Mus musculus
tatgtatatatgtatatctgta

SEQ ID NO: 211786 - DNA, 22 bp, Mus musculus
taagagcactgactgctcttct

SEQ ID NO: 211787 - DNA, 21 bp, Mus musculus
tgacagagctgagagaagaca

SEQ ID NO: 211788 - DNA, 19 bp, Mus musculus
gtgcatatataatatgtaa

SEQ ID NO: 211789 - DNA, 20 bp, Mus musculus
tgtgtgtgtgtgtgtgtgtc

SEQ ID NO: 211790 - DNA, 23 bp, Mus musculus
tgatgtcagggttgaaactgggt

SEQ ID NO: 211791 - DNA, 23 bp, Mus musculus
tattttctatgtatggtgattga

SEQ ID NO: 211792 - DNA, 22 bp, Mus musculus
tgtgtgtgtgatgtacatgtgt

SEQ ID NO: 211793 - DNA, 23 bp, Mus musculus
tgtgtttgagcattagcatgtgc

SEQ ID NO: 211794 - DNA, 21 bp, Mus musculus
tatgtgtgtgcatacccacac

SEQ ID NO: 211795 - DNA, 21 bp, Mus musculus
atatgtgtatatgaatatatg

SEQ ID NO: 211796 - DNA, 23 bp, Mus musculus
gcaagtcagacaacagacagcag

SEQ ID NO: 211797 - DNA, 21 bp, Mus musculus
tttaccttgatgaagagggtg

SEQ ID NO: 211798 - DNA, 22 bp, Mus musculus
tttgtgaattgtaatatgtgtg

SEQ ID NO: 211799 - DNA, 23 bp, Mus musculus
gtgggtctgtgtatgagcatgtg

SEQ ID NO: 211800 - DNA, 23 bp, Mus musculus
tggaagagatgtggttttgttgg

SEQ ID NO: 211801 - DNA, 18 bp, Mus musculus
tgtgcatttttatgcatg

SEQ ID NO: 211802 - DNA, 22 bp, Mus musculus
tatatgtgtgtgtgtgttgtat

SEQ ID NO: 211803 - DNA, 23 bp, Mus musculus
tcagagcactgactgctctacca

SEQ ID NO: 211804 - DNA, 22 bp, Mus musculus
tgttttgtgaccaattatatgg

SEQ ID NO: 211805 - DNA, 22 bp, Mus musculus
ttgggagtagagtctgtggaca

SEQ ID NO: 211806 - DNA, 21 bp, Mus musculus
tgtctaattcaaactctgggc

SEQ ID NO: 211807 - DNA, 22 bp, Mus musculus
ttagagactgcaatggaagtgt

SEQ ID NO: 211808 - DNA, 20 bp, Mus musculus
tcagtttggtcttcatgtgg

SEQ ID NO: 211809 - DNA, 23 bp, Mus musculus
tacacacacacatacatatatgt

SEQ ID NO: 211810 - DNA, 23 bp, Mus musculus
tatatgtatatatgtatgtgtgt

SEQ ID NO: 211811 - DNA, 23 bp, Mus musculus
tgtgagtctatctgtctcagtcg

SEQ ID NO: 211812 - DNA, 23 bp, Mus musculus
ttgatattgaaagttaatgtatg

SEQ ID NO: 211813 - DNA, 18 bp, Mus musculus
ttggacttcacatagttc

SEQ ID NO: 211814 - DNA, 23 bp, Mus musculus
tgtgtctctgtgtctgtctgctt

SEQ ID NO: 211815 - DNA, 23 bp, Mus musculus
gagcttggtttactaggtgtatg

SEQ ID NO: 211816 - DNA, 22 bp, Mus musculus
ttaacatgtacatacttggatg

SEQ ID NO: 211817 - DNA, 23 bp, Mus musculus
ctgctcacagtggctgttcattt

SEQ ID NO: 211818 - DNA, 22 bp, Mus musculus
tgtcagtctctgtatttgttca

SEQ ID NO: 211819 - DNA, 21 bp, Mus musculus
ttttcactggaaagattactg

SEQ ID NO: 211820 - DNA, 23 bp, Mus musculus
gtggattttgctttagtcttctc

SEQ ID NO: 211821 - DNA, 23 bp, Mus musculus
attagtgcagagtgagcagaatg

SEQ ID NO: 211822 - DNA, 23 bp, Mus musculus
tgcgtgcgtgcgtgagtgcgtgc

SEQ ID NO: 211823 - DNA, 21 bp, Mus musculus
acacacatgtgtgtgagcaca

SEQ ID NO: 211824 - DNA, 23 bp, Mus musculus
gttagacaattgtttctgtttca

SEQ ID NO: 211825 - DNA, 23 bp, Mus musculus
aatcactcactgttccattactg

SEQ ID NO: 211826 - DNA, 23 bp, Mus musculus
ttgtatctccttaagtttctggt

SEQ ID NO: 211827 - DNA, 19 bp, Mus musculus
taggcagtagtgtgctttc

SEQ ID NO: 211828 - DNA, 23 bp, Mus musculus
tgcctcagtgactctgtgcttcc

SEQ ID NO: 211829 - DNA, 21 bp, Mus musculus
aattagatgctggtttgcatg

SEQ ID NO: 211830 - DNA, 23 bp, Mus musculus
tttgtacttccatgagattttct

SEQ ID NO: 211831 - DNA, 23 bp, Mus musculus
cctttcagatgaaagtgaccaga

SEQ ID NO: 211832 - DNA, 23 bp, Mus musculus
tctctgagtcccaagtgttgagg

SEQ ID NO: 211833 - DNA, 18 bp, Mus musculus
tctagtctgtcactcaca

SEQ ID NO: 211834 - DNA, 20 bp, Mus musculus
taactcctcagagtccagct

SEQ ID NO: 211835 - DNA, 23 bp, Mus musculus
tctgagatcctgggtgtgtcaga

SEQ ID NO: 211836 - DNA, 23 bp, Mus musculus
tctcagtgtctgtataacatctg

SEQ ID NO: 211837 - DNA, 19 bp, Mus musculus
aagatcagggtaaagcaga

SEQ ID NO: 211838 - DNA, 22 bp, Mus musculus
tgttttgtgaccaattatatgg

SEQ ID NO: 211839 - DNA, 22 bp, Mus musculus
tgttttgtgaccaattatatgg

SEQ ID NO: 211840 - DNA, 22 bp, Mus musculus
tgttttgtgaccaattatatgg

SEQ ID NO: 211841 - DNA, 23 bp, Mus musculus
ggtaaccttgttagtgtgacagt

SEQ ID NO: 211842 - DNA, 18 bp, Mus musculus
ttttggagcaaatcccat

SEQ ID NO: 211843 - DNA, 18 bp, Mus musculus
ctgactgctcttccagag

SEQ ID NO: 211844 - DNA, 22 bp, Mus musculus
tgttttgtgaccaattatatgg

SEQ ID NO: 211845 - DNA, 23 bp, Mus musculus
tcatatgtggttctagtgttgat

SEQ ID NO: 211846 - DNA, 23 bp, Mus musculus
tctgcctgcctgtatgtgtctgt

SEQ ID NO: 211847 - DNA, 22 bp, Mus musculus
tcaggtcaccagagttgtaggg

SEQ ID NO: 211848 - DNA, 23 bp, Mus musculus
atgtgtgtcactgtgcctgtctc

SEQ ID NO: 211849 - DNA, 20 bp, Mus musculus
tggtgtagtgttaggctgaa

SEQ ID NO: 211850 - DNA, 20 bp, Mus musculus
tgggagctggcttctttggg

SEQ ID NO: 211851 - DNA, 23 bp, Mus musculus
gtaactgtgtgtggtattgtaca

SEQ ID NO: 211852 - DNA, 18 bp, Mus musculus
gtatattaaaattgtcta

SEQ ID NO: 211853 - DNA, 23 bp, Mus musculus
acatacagtgtcactctgtctgg

SEQ ID NO: 211854 - DNA, 23 bp, Mus musculus
atctgtatctgtatctgtatatg

SEQ ID NO: 211855 - DNA, 23 bp, Mus musculus
tttgtcactgtttagtttctgtt

SEQ ID NO: 211856 - DNA, 23 bp, Mus musculus
agtgtagtagtgaaggggtgtgt

SEQ ID NO: 211857 - DNA, 19 bp, Mus musculus
atgtatatatgtacgtatg

SEQ ID NO: 211858 - DNA, 23 bp, Mus musculus
tttagatgcgtatgtgtgtgtat

SEQ ID NO: 211859 - DNA, 21 bp, Mus musculus
tttctgtagcttaagaattga

SEQ ID NO: 211860 - DNA, 23 bp, Mus musculus
tacgagcactgactgctcttcca

SEQ ID NO: 211861 - DNA, 23 bp, Mus musculus
atgtatatatgtatacatatgtg

SEQ ID NO: 211862 - DNA, 20 bp, Mus musculus
atgtgtatatgtatgcatat

SEQ ID NO: 211863 - DNA, 19 bp, Mus musculus
acattattcgtgttcatgt

SEQ ID NO: 211864 - DNA, 20 bp, Mus musculus
atacacacacatatatatgt

SEQ ID NO: 211865 - DNA, 23 bp, Mus musculus
atatacaatatgtatatgtatac

SEQ ID NO: 211866 - DNA, 18 bp, Mus musculus
atatatatgcatatgtgt

SEQ ID NO: 211867 - DNA, 23 bp, Mus musculus
catgtgcatatgtgtgcatgtct

SEQ ID NO: 211868 - DNA, 22 bp, Mus musculus
tggtctctgtgtctgagtttgc

SEQ ID NO: 211869 - DNA, 23 bp, Mus musculus
atgtgcatcagtcttgtcggtct

SEQ ID NO: 211870 - DNA, 23 bp, Mus musculus
tacacacacacatacatgtatgt

SEQ ID NO: 211871 - DNA, 22 bp, Mus musculus
tgtatgtatgtatgtatgtatg

SEQ ID NO: 211872 - DNA, 22 bp, Mus musculus
tctgactcattatctgacaggt

SEQ ID NO: 211873 - DNA, 22 bp, Mus musculus
atatgttgtggggctggagaga

SEQ ID NO: 211874 - DNA, 23 bp, Mus musculus
atttgtgtgagcatgtgcatgtg

SEQ ID NO: 211875 - DNA, 21 bp, Mus musculus
aagcacacaggtgtaggtcag

SEQ ID NO: 211876 - DNA, 21 bp, Mus musculus
ctctgtctgtctgtctgtctc

SEQ ID NO: 211877 - DNA, 18 bp, Mus musculus
gagctacagtcatatagg

SEQ ID NO: 211878 - DNA, 21 bp, Mus musculus
catactcgttactgtcctcct

SEQ ID NO: 211879 - DNA, 23 bp, Mus musculus
tcacttacactgtgtctttctct

SEQ ID NO: 211880 - DNA, 23 bp, Mus musculus
atctgtctgtctgtctgcctgtc

SEQ ID NO: 211881 - DNA, 23 bp, Mus musculus
gtatgcatatatgtatgtatgta

SEQ ID NO: 211882 - DNA, 23 bp, Mus musculus
tttatgtatatgtataggcatgt

SEQ ID NO: 211883 - DNA, 22 bp, Mus musculus
atatatgtatatatgtatatgt

SEQ ID NO: 211884 - DNA, 23 bp, Mus musculus
ccagtgacagtgagacctagtcg

SEQ ID NO: 211885 - DNA, 23 bp, Mus musculus
aaagcttgatgtacagccagact

SEQ ID NO: 211886 - DNA, 23 bp, Mus musculus
acagactggctgtctgtatggct

SEQ ID NO: 211887 - DNA, 23 bp, Mus musculus
tatatgtatatatatgtatgtgt

SEQ ID NO: 211888 - DNA, 23 bp, Mus musculus
gtctctggtgtctgtgtctcact

SEQ ID NO: 211889 - DNA, 21 bp, Mus musculus
cactgcctgagtctcagcttg

SEQ ID NO: 211890 - DNA, 21 bp, Mus musculus
attctgtggttggtattgagt

SEQ ID NO: 211891 - DNA, 22 bp, Mus musculus
gtctgaatctgcggctgcttac

SEQ ID NO: 211892 - DNA, 20 bp, Mus musculus
acccagagaccctctttaga

SEQ ID NO: 211893 - DNA, 23 bp, Mus musculus
cctgtctccgtatctctctctct

SEQ ID NO: 211894 - DNA, 18 bp, Mus musculus
tcagagctgggatcacag

SEQ ID NO: 211895 - DNA, 23 bp, Mus musculus
tgaccaatcaggatctgcctttg

SEQ ID NO: 211896 - DNA, 21 bp, Mus musculus
agagtgaagacagagacctga

SEQ ID NO: 211897 - DNA, 19 bp, Mus musculus
gtgactgacagaggagttt

SEQ ID NO: 211898 - DNA, 23 bp, Mus musculus
ttaattcagcgttgtcagggcga

SEQ ID NO: 211899 - DNA, 23 bp, Mus musculus
ctttagcctcactctctgtcacc

SEQ ID NO: 211900 - DNA, 23 bp, Mus musculus
tctgggtggtttcttgtctggaa

SEQ ID NO: 211901 - DNA, 21 bp, Mus musculus
ttggaagaactaagagatgtc

SEQ ID NO: 211902 - DNA, 23 bp, Mus musculus
atgtatatgtatatgtatgtgta

SEQ ID NO: 211903 - DNA, 19 bp, Mus musculus
tatgagcagagggagctca

SEQ ID NO: 211904 - DNA, 23 bp, Mus musculus
tttagattgaattgtgtcctgag

SEQ ID NO: 211905 - DNA, 19 bp, Mus musculus
tatgtgtatactggtacac

SEQ ID NO: 211906 - DNA, 22 bp, Mus musculus
gtgtgtgtgtgtgtgtcaatgc

SEQ ID NO: 211907 - DNA, 20 bp, Mus musculus
acaagaaacagacactctca

SEQ ID NO: 211908 - DNA, 22 bp, Mus musculus
gtgtgtgcatgtacatgtgtgt

SEQ ID NO: 211909 - DNA, 23 bp, Mus musculus
tgtgtgtatatgtgtgtgcatgt

SEQ ID NO: 211910 - DNA, 22 bp, Mus musculus
atctctggctgtctcagactgt

SEQ ID NO: 211911 - DNA, 20 bp, Mus musculus
tgtgtagccagtctctcagt

SEQ ID NO: 211912 - DNA, 23 bp, Mus musculus
agtccattgatgttgtagtagga

SEQ ID NO: 211913 - DNA, 18 bp, Mus musculus
gacagtcatgttagaggt

SEQ ID NO: 211914 - DNA, 21 bp, Mus musculus
tctcagagtctgaatcaccaa

SEQ ID NO: 211915 - DNA, 20 bp, Mus musculus
tttgagactagactgtgagc

SEQ ID NO: 211916 - DNA, 23 bp, Mus musculus
tatatcacaaattgaattgagaa

SEQ ID NO: 211917 - DNA, 23 bp, Mus musculus
catcagtgtcagttgtgctggct

SEQ ID NO: 211918 - DNA, 22 bp, Mus musculus
aatttactgtttatcattttta

SEQ ID NO: 211919 - DNA, 22 bp, Mus musculus
acaagcagcaaattaattaagt

SEQ ID NO: 211920 - DNA, 21 bp, Mus musculus
tatgtatgtatgtatgtatgt

SEQ ID NO: 211921 - DNA, 18 bp, Mus musculus
gccacatgttagggaaga

SEQ ID NO: 211922 - DNA, 23 bp, Mus musculus
gtctttgttcagtttctctatgt

SEQ ID NO: 211923 - DNA, 23 bp, Mus musculus
gaagtgacagctgagagagagga

SEQ ID NO: 211924 - DNA, 23 bp, Mus musculus
tacagacttgatttttctctcag

SEQ ID NO: 211925 - DNA, 23 bp, Mus musculus
tcacatccttgtgctcagaaatc

SEQ ID NO: 211926 - DNA, 18 bp, Mus musculus
catcacagaggcaagttg

SEQ ID NO: 211927 - DNA, 23 bp, Mus musculus
ctatcaccatttgaattcattta

SEQ ID NO: 211928 - DNA, 20 bp, Mus musculus
ctctctgtgtctctgcctct

SEQ ID NO: 211929 - DNA, 21 bp, Mus musculus
tgtgtatgtatgtatgtatgt

SEQ ID NO: 211930 - DNA, 19 bp, Mus musculus
ttgtgtattgttcctgaag

SEQ ID NO: 211931 - DNA, 21 bp, Mus musculus
aatgtctgaagagagtcacct

SEQ ID NO: 211932 - DNA, 23 bp, Mus musculus
tgtctctgtgcctcagtctcatc

SEQ ID NO: 211933 - DNA, 18 bp, Mus musculus
gtagaggtggctcagcag

SEQ ID NO: 211934 - DNA, 22 bp, Mus musculus
agaaacatcaagtcctattgat

SEQ ID NO: 211935 - DNA, 23 bp, Mus musculus
aagtgcatttgttttcgagtact

SEQ ID NO: 211936 - DNA, 23 bp, Mus musculus
aacagtaatcctcaagatgaaca

SEQ ID NO: 211937 - DNA, 23 bp, Mus musculus
acgtgtctgtgtatctgtgtgtg

SEQ ID NO: 211938 - DNA, 22 bp, Mus musculus
tgtatacatatgtacattaaca

SEQ ID NO: 211939 - DNA, 23 bp, Mus musculus
tcaacagtataaatggagtagca

SEQ ID NO: 211940 - DNA, 23 bp, Mus musculus
gaatggttgttctaagtcctatc

SEQ ID NO: 211941 - DNA, 23 bp, Mus musculus
actatatgtgtatgtatatgcat

SEQ ID NO: 211942 - DNA, 19 bp, Mus musculus
gagagtgtatacatataca

SEQ ID NO: 211943 - DNA, 23 bp, Mus musculus
tgtatgtatgtgtgcatgcatgt

SEQ ID NO: 211944 - DNA, 21 bp, Mus musculus
tgtgtttatatacacatatgt

SEQ ID NO: 211945 - DNA, 22 bp, Mus musculus
tatgtgtgtatatatatgtgtg

SEQ ID NO: 211946 - DNA, 22 bp, Mus musculus
tatacacacatgcactaattgg

SEQ ID NO: 211947 - DNA, 23 bp, Mus musculus
ttttaaggaagataatgctgagt

SEQ ID NO: 211948 - DNA, 21 bp, Mus musculus
tacacacacacacacttcata

SEQ ID NO: 211949 - DNA, 23 bp, Mus musculus
agtgtagagagtgtggagtgttt

SEQ ID NO: 211950 - DNA, 23 bp, Mus musculus
cactgatcagtctgaccaatcaa

SEQ ID NO: 211951 - DNA, 18 bp, Mus musculus
tcaggagtgtgttctagg

SEQ ID NO: 211952 - DNA, 19 bp, Mus musculus
atgaagtggggctggatag

SEQ ID NO: 211953 - DNA, 23 bp, Mus musculus
agcagtacctgaagagttgcagt

SEQ ID NO: 211954 - DNA, 23 bp, Mus musculus
tttgtctgtctgtctgtctgtct

SEQ ID NO: 211955 - DNA, 23 bp, Mus musculus
catgtttgtgactctgactctgt

SEQ ID NO: 211956 - DNA, 18 bp, Mus musculus
agcagcagaagggtgtca

SEQ ID NO: 211957 - DNA, 21 bp, Mus musculus
attcttagtttaacatctggt

SEQ ID NO: 211958 - DNA, 23 bp, Mus musculus
tgtctgtctgtctgtctgtctat

SEQ ID NO: 211959 - DNA, 23 bp, Mus musculus
gagactgtctttcctttccttgt

SEQ ID NO: 211960 - DNA, 23 bp, Mus musculus
tgtgtatatgtatgtatatatat

SEQ ID NO: 211961 - DNA, 20 bp, Mus musculus
tatacacacacatatataca

SEQ ID NO: 211962 - DNA, 23 bp, Mus musculus
tgtgtctgtggtatgtatgtatg

SEQ ID NO: 211963 - DNA, 20 bp, Mus musculus
tgcatgcatgtatgtatgta

SEQ ID NO: 211964 - DNA, 23 bp, Mus musculus
tgactgtgtctacatcttctgtt

SEQ ID NO: 211965 - DNA, 21 bp, Mus musculus
aacactactgatttgcatgtt

SEQ ID NO: 211966 - DNA, 23 bp, Mus musculus
acttattgttttggttcatcaac

SEQ ID NO: 211967 - DNA, 23 bp, Mus musculus
agtgcagactgctcttgctgagg

SEQ ID NO: 211968 - DNA, 23 bp, Mus musculus
tctgtctctctgaccctgtctgt

SEQ ID NO: 211969 - DNA, 23 bp, Mus musculus
atagctctgtcagctgggtgcag

SEQ ID NO: 211970 - DNA, 23 bp, Mus musculus
agtctctgcctctctgaccctct

SEQ ID NO: 211971 - DNA, 23 bp, Mus musculus
acatgtgtctgtgtgtctctctc

SEQ ID NO: 211972 - DNA, 23 bp, Mus musculus
tgagcagtgttattgtagttgaa

SEQ ID NO: 211973 - DNA, 22 bp, Mus musculus
tgttttgtgaccaattatatgg

SEQ ID NO: 211974 - DNA, 23 bp, Mus musculus
ggactgtcacagtctttggagcg

SEQ ID NO: 211975 - DNA, 23 bp, Mus musculus
tatatatgcatatgtatatttgt

SEQ ID NO: 211976 - DNA, 22 bp, Mus musculus
tgttttgtgaccaattatatgg

SEQ ID NO: 211977 - DNA, 21 bp, Mus musculus
tccatggtgatctgataggat

SEQ ID NO: 211978 - DNA, 22 bp, Mus musculus
ttaagtgagtagaagataagag

SEQ ID NO: 211979 - DNA, 23 bp, Mus musculus
atgtgtgtgtatctgatagagag

SEQ ID NO: 211980 - DNA, 23 bp, Mus musculus
tagtccatggtgatctgatagga

SEQ ID NO: 211981 - DNA, 23 bp, Mus musculus
tttgtgaccaattatattgtcaa

SEQ ID NO: 211982 - DNA, 23 bp, Mus musculus
gtcaggcactgtcagagcctctc

SEQ ID NO: 211983 - DNA, 23 bp, Mus musculus
catcatcatcatcatcatgagaa

SEQ ID NO: 211984 - DNA, 22 bp, Mus musculus
tagttccatgttttgattttct

SEQ ID NO: 211985 - DNA, 23 bp, Mus musculus
tagagagtttttgacttagtaaa

SEQ ID NO: 211986 - DNA, 23 bp, Mus musculus
aagactgtcacagatgtttgctg

SEQ ID NO: 211987 - DNA, 23 bp, Mus musculus
tccgtctgtctgtctatcatctg

SEQ ID NO: 211988 - DNA, 23 bp, Mus musculus
aaagaagatgttcaggctggaga

SEQ ID NO: 211989 - DNA, 23 bp, Mus musculus
tctgtctgtctgtctatcagcgt

SEQ ID NO: 211990 - DNA, 22 bp, Mus musculus
tgaggatgtttcaatatttgta

SEQ ID NO: 211991 - DNA, 23 bp, Mus musculus
cacattagtacatcagataggaa

SEQ ID NO: 211992 - DNA, 22 bp, Mus musculus
atgtctgtgtgtgagtatgtac

SEQ ID NO: 211993 - DNA, 22 bp, Mus musculus
acaatcacagagtggtgtgggg

SEQ ID NO: 211994 - DNA, 23 bp, Mus musculus
aagagctttgtatgctgagtgaa

SEQ ID NO: 211995 - DNA, 20 bp, Mus musculus
agtcactagacactgtccag

SEQ ID NO: 211996 - DNA, 23 bp, Mus musculus
cagcatgaggtacaaccttgttt

SEQ ID NO: 211997 - DNA, 23 bp, Mus musculus
tggaacacaggttgtttgtgctt

SEQ ID NO: 211998 - DNA, 23 bp, Mus musculus
atatctgatgatgtgtgagagta

SEQ ID NO: 211999 - DNA, 20 bp, Mus musculus
ctcaagtctgctcattggtt

SEQ ID NO: 212000 - DNA, 18 bp, Mus musculus
tgcatgggttatgtgact

SEQ ID NO: 212001 - DNA, 22 bp, Mus musculus
ttgtgtctgcatatgtatgtat

SEQ ID NO: 212002 - DNA, 23 bp, Mus musculus
tgatctgactgcctgttttcagt

SEQ ID NO: 212003 - DNA, 23 bp, Mus musculus
ctgaaaaagaaaacagagattag

SEQ ID NO: 212004 - DNA, 18 bp, Mus musculus
gatcttgcagaatcggtg

SEQ ID NO: 212005 - DNA, 21 bp, Mus musculus
tatgtagaaggatgtttagta

SEQ ID NO: 212006 - DNA, 23 bp, Mus musculus
gtgtcactgtgactctcaggaac

SEQ ID NO: 212007 - DNA, 23 bp, Mus musculus
agacccactgtctcaccctctct

SEQ ID NO: 212008 - DNA, 23 bp, Mus musculus
tgggagtcagtgtggtgagtgag

SEQ ID NO: 212009 - DNA, 22 bp, Mus musculus
tgtatacatgcacgtatacatg

SEQ ID NO: 212010 - DNA, 20 bp, Mus musculus
ggtcttgagagggctagtga

SEQ ID NO: 212011 - DNA, 20 bp, Mus musculus
ttaagagcactcactgctct

SEQ ID NO: 212012 - DNA, 22 bp, Mus musculus
ttagatgagagagagcatagtg

SEQ ID NO: 212013 - DNA, 23 bp, Mus musculus
atgtgtatatatatatatgtgtg

SEQ ID NO: 212014 - DNA, 23 bp, Mus musculus
tgtcactcagtcattattcaagc

SEQ ID NO: 212015 - DNA, 23 bp, Mus musculus
acactcaagagtgtgaggtcatg

SEQ ID NO: 212016 - DNA, 23 bp, Mus musculus
gtatatatatatgtatgtgtgtg

SEQ ID NO: 212017 - DNA, 23 bp, Mus musculus
atgtctgtgtgttatgtgtatgt

SEQ ID NO: 212018 - DNA, 23 bp, Mus musculus
tatctcagccacctttgactcag

SEQ ID NO: 212019 - DNA, 23 bp, Mus musculus
acccttacaggttctttttcttg

SEQ ID NO: 212020 - DNA, 23 bp, Mus musculus
tcagaggacagtgtgcacacaga

SEQ ID NO: 212021 - DNA, 22 bp, Mus musculus
gtcagaggacagcgtgcacaca

SEQ ID NO: 212022 - DNA, 23 bp, Mus musculus
gtcagaggacagcgtgcacacag

SEQ ID NO: 212023 - DNA, 23 bp, Mus musculus
tcagaggacagtgtgcacacaga

SEQ ID NO: 212024 - DNA, 19 bp, Mus musculus
gtcagaggacagtgtgcac

SEQ ID NO: 212025 - DNA, 23 bp, Mus musculus
tcagaggacagtgtgcacacaga

SEQ ID NO: 212026 - DNA, 23 bp, Mus musculus
gtcagaggacagcgtgcacacag

SEQ ID NO: 212027 - DNA, 23 bp, Mus musculus
tcagaggacagtgtgcacacaga

SEQ ID NO: 212028 - DNA, 22 bp, Mus musculus
gtcagaggacagtgtgcacaca

SEQ ID NO: 212029 - DNA, 23 bp, Mus musculus
gtcagaggacaacgtgcacacag

SEQ ID NO: 212030 - DNA, 19 bp, Mus musculus
gtcagaggacagcgtgcac

SEQ ID NO: 212031 - DNA, 23 bp, Mus musculus
tgtgtgtatatatatgtgtgtgt

SEQ ID NO: 212032 - DNA, 23 bp, Mus musculus
gtgactcagtgtctgagagaccc

SEQ ID NO: 212033 - DNA, 23 bp, Mus musculus
tatagtccttctccagctccagt

SEQ ID NO: 212034 - DNA, 20 bp, Mus musculus
gctgtctgtcagtgggactc

SEQ ID NO: 212035 - DNA, 23 bp, Mus musculus
gagcacagactgcttttcctgag

SEQ ID NO: 212036 - DNA, 18 bp, Mus musculus
atgtatatatatatatgt

SEQ ID NO: 212037 - DNA, 22 bp, Mus musculus
tgttttgtgaccaattatatgg

SEQ ID NO: 212038 - DNA, 23 bp, Mus musculus
ttaatgtatatgtgtatggtgta

SEQ ID NO: 212039 - DNA, 22 bp, Mus musculus
ctcagcctgtctgtctgtgcct

SEQ ID NO: 212040 - DNA, 21 bp, Mus musculus
aagagactagtgaggctccag

SEQ ID NO: 212041 - DNA, 23 bp, Mus musculus
ctgcttgttcctgtctctcagac

SEQ ID NO: 212042 - DNA, 23 bp, Mus musculus
ttctgtgatgtctgtgaggacag

SEQ ID NO: 212043 - DNA, 22 bp, Mus musculus
tgtatgtgtgtgtgttctataa

SEQ ID NO: 212044 - DNA, 18 bp, Mus musculus
tcagtagatagatgcttc

SEQ ID NO: 212045 - DNA, 23 bp, Mus musculus
gtctctgtctgtctctgtctgtc

SEQ ID NO: 212046 - DNA, 22 bp, Mus musculus
acctggttatagattgggttga

SEQ ID NO: 212047 - DNA, 23 bp, Mus musculus
agtgtgcttacagttttcagagc

SEQ ID NO: 212048 - DNA, 23 bp, Mus musculus
ttttgcacactcacagttttctg

SEQ ID NO: 212049 - DNA, 22 bp, Mus musculus
aaaagtgcacgttgtacaggat

SEQ ID NO: 212050 - DNA, 20 bp, Mus musculus
tttgtgcttgttttttagat

SEQ ID NO: 212051 - DNA, 23 bp, Mus musculus
tgcctgtgtctgtctctgtctcc

SEQ ID NO: 212052 - DNA, 22 bp, Mus musculus
atcttgtggtagtggtgacgat

SEQ ID NO: 212053 - DNA, 21 bp, Mus musculus
tcggtccctctgtcactgcca

SEQ ID NO: 212054 - DNA, 19 bp, Mus musculus
actgaagtgcctctgcaca

SEQ ID NO: 212055 - DNA, 18 bp, Mus musculus
ctctctctgtgtgcctgt

SEQ ID NO: 212056 - DNA, 23 bp, Mus musculus
gtgtctgtctgtctttgtctctg

SEQ ID NO: 212057 - DNA, 23 bp, Mus musculus
tctgtctcagtcagctactgata

SEQ ID NO: 212058 - DNA, 23 bp, Mus musculus
atgtatgcatgtgtgtgtgtgtg

SEQ ID NO: 212059 - DNA, 23 bp, Mus musculus
gcgtgtgcatgtgcatgtgtgtg

SEQ ID NO: 212060 - DNA, 21 bp, Mus musculus
ttcaattctcagcaaccacat

SEQ ID NO: 212061 - DNA, 23 bp, Mus musculus
cttgtctcaggtattcatagtga

SEQ ID NO: 212062 - DNA, 21 bp, Mus musculus
tatcagcaaccacatagtggc

SEQ ID NO: 212063 - DNA, 23 bp, Mus musculus
tgtctgtctgtctgtctgtctgt

SEQ ID NO: 212064 - DNA, 23 bp, Mus musculus
gggagtggatgagcaagtgaatg

SEQ ID NO: 212065 - DNA, 21 bp, Mus musculus
tattgctctcagaccttctgg

SEQ ID NO: 212066 - DNA, 23 bp, Mus musculus
ttcataagttacctagctcatga

SEQ ID NO: 212067 - DNA, 18 bp, Mus musculus
tatgtatattagcaaaca

SEQ ID NO: 212068 - DNA, 22 bp, Mus musculus
actgtttctggctccttgttgt

SEQ ID NO: 212069 - DNA, 23 bp, Mus musculus
atgaatgcatgtatgtatgaatg

SEQ ID NO: 212070 - DNA, 23 bp, Mus musculus
gaatgcatgtacgtgtgaatgca

SEQ ID NO: 212071 - DNA, 19 bp, Mus musculus
tcaggcggactgactggcc

SEQ ID NO: 212072 - DNA, 23 bp, Mus musculus
cacacacacacttcacctttagc

SEQ ID NO: 212073 - DNA, 20 bp, Mus musculus
tgcagtctgtgtgtgtgtgt

SEQ ID NO: 212074 - DNA, 23 bp, Mus musculus
ctgcctgtctgcctgcctgtgac

SEQ ID NO: 212075 - DNA, 23 bp, Mus musculus
caaggctcactctatgcctcacc

SEQ ID NO: 212076 - DNA, 22 bp, Mus musculus
actctcagcaatctcagcctcc

SEQ ID NO: 212077 - DNA, 20 bp, Mus musculus
tctccacacactcacacgca

SEQ ID NO: 212078 - DNA, 21 bp, Mus musculus
aggagctggagagatggctct

SEQ ID NO: 212079 - DNA, 23 bp, Mus musculus
tgtgtgtgtgcatgtgtgtatgc

SEQ ID NO: 212080 - DNA, 23 bp, Mus musculus
tgagtgcctgtgtgtgtgcctgt

SEQ ID NO: 212081 - DNA, 23 bp, Mus musculus
aggtactgtctgtctgtctgtcc

SEQ ID NO: 212082 - DNA, 22 bp, Mus musculus
tgttttgtgaccaattatatgg

SEQ ID NO: 212083 - DNA, 23 bp, Mus musculus
ctgtgtctctgtttagtttctgt

SEQ ID NO: 212084 - DNA, 23 bp, Mus musculus
aggatctgtccattgatgagagt

SEQ ID NO: 212085 - DNA, 21 bp, Mus musculus
aaaagctcatcaaggtctgga

SEQ ID NO: 212086 - DNA, 23 bp, Mus musculus
tctccctgtctgtgtctgcctct

SEQ ID NO: 212087 - DNA, 19 bp, Mus musculus
acagttctgtcactgtgtg

SEQ ID NO: 212088 - DNA, 18 bp, Mus musculus
gctttacttcctgtgtct

SEQ ID NO: 212089 - DNA, 23 bp, Mus musculus
taagtaaaataccttctgtctgt

SEQ ID NO: 212090 - DNA, 20 bp, Mus musculus
ccctgcctccctgattggct

SEQ ID NO: 212091 - DNA, 19 bp, Mus musculus
tctcagtcagagaattttc

SEQ ID NO: 212092 - DNA, 23 bp, Mus musculus
tagtccatgatgatctgatagga

SEQ ID NO: 212093 - DNA, 21 bp, Mus musculus
tgttttgtgaccaattatgtg

SEQ ID NO: 212094 - DNA, 23 bp, Mus musculus
tttggctgtcaatttctgaacta

SEQ ID NO: 212095 - DNA, 23 bp, Mus musculus
tgtctgtgtgcatgtttatgtat

SEQ ID NO: 212096 - DNA, 23 bp, Mus musculus
tatgtgcatgtacatttatgtgt

SEQ ID NO: 212097 - DNA, 23 bp, Mus musculus
catctgtgtctgtctctctctgt

SEQ ID NO: 212098 - DNA, 18 bp, Mus musculus
ctgtcttacactgtctgt

SEQ ID NO: 212099 - DNA, 23 bp, Mus musculus
gggtgtgtgtctgtgtctatgtc

SEQ ID NO: 212100 - DNA, 23 bp, Mus musculus
gtgtcacacacagtgaatgaccc

SEQ ID NO: 212101 - DNA, 23 bp, Mus musculus
tggctggctcactgtcagtttta

SEQ ID NO: 212102 - DNA, 22 bp, Mus musculus
cacactgcctctctgcgtggct

SEQ ID NO: 212103 - DNA, 20 bp, Mus musculus
agtctgagggtctttattca

SEQ ID NO: 212104 - DNA, 18 bp, Mus musculus
aagcaagattaattttgt

SEQ ID NO: 212105 - DNA, 23 bp, Mus musculus
tgtctgtctgtctgcctgcctgc

SEQ ID NO: 212106 - DNA, 23 bp, Mus musculus
tctcccagtctgagataatacag

SEQ ID NO: 212107 - DNA, 23 bp, Mus musculus
tgtgctctttcagaacggatgaa

SEQ ID NO: 212108 - DNA, 23 bp, Mus musculus
accagtacaagcagctcacgaag

SEQ ID NO: 212109 - DNA, 22 bp, Mus musculus
ttcccagtagaatgtcagctga

SEQ ID NO: 212110 - DNA, 22 bp, Mus musculus
tgtcacacaggctgtgtgactc

SEQ ID NO: 212111 - DNA, 23 bp, Mus musculus
tctgtgtgtgcttctgcatgtgt

SEQ ID NO: 212112 - DNA, 23 bp, Mus musculus
acagtgtgtcacacagtgcaccc

SEQ ID NO: 212113 - DNA, 23 bp, Mus musculus
tgtgtcacacagtacaccctttt

SEQ ID NO: 212114 - DNA, 23 bp, Mus musculus
tcacagtgtgtcacacagtgcac

SEQ ID NO: 212115 - DNA, 22 bp, Mus musculus
tgttttgtgaccaattatatgg

SEQ ID NO: 212116 - DNA, 23 bp, Mus musculus
gagcacactcagtctgttctttc

SEQ ID NO: 212117 - DNA, 23 bp, Mus musculus
aacggtcaccatgtgaacagatg

SEQ ID NO: 212118 - DNA, 22 bp, Mus musculus
tgaatccaaaacatttgggtgt

SEQ ID NO: 212119 - DNA, 23 bp, Mus musculus
tacaacatgtttatgtatgcaga

SEQ ID NO: 212120 - DNA, 18 bp, Mus musculus
aatgtatgagtgtgtgtg

SEQ ID NO: 212121 - DNA, 19 bp, Mus musculus
agctatgtatatatgtatg

SEQ ID NO: 212122 - DNA, 21 bp, Mus musculus
ataggtagtttatttttatct

SEQ ID NO: 212123 - DNA, 22 bp, Mus musculus
ttatgaagagctttacttctgt

SEQ ID NO: 212124 - DNA, 23 bp, Mus musculus
tatctatatctatatctgtatct

SEQ ID NO: 212125 - DNA, 23 bp, Mus musculus
tctccctcactgttactttgtag

SEQ ID NO: 212126 - DNA, 23 bp, Mus musculus
tcactgcctgacaccctctatgg

SEQ ID NO: 212127 - DNA, 22 bp, Mus musculus
tgttttgtgaccaattatatgg

SEQ ID NO: 212128 - DNA, 22 bp, Mus musculus
tctgagatatgcttggattgac

SEQ ID NO: 212129 - DNA, 19 bp, Mus musculus
aggccagaagagggcattg

SEQ ID NO: 212130 - DNA, 23 bp, Mus musculus
aacatgtgtctctgtctgtgacg

SEQ ID NO: 212131 - DNA, 23 bp, Mus musculus
tgtgtgtgcatgtgcatgtgtgt

SEQ ID NO: 212132 - DNA, 23 bp, Mus musculus
agacaaacatcagactgagcaca

SEQ ID NO: 212133 - DNA, 19 bp, Mus musculus
atacgtggtgataatctgt

SEQ ID NO: 212134 - DNA, 23 bp, Mus musculus
cctgactctgccactgagtgtca

SEQ ID NO: 212135 - DNA, 23 bp, Mus musculus
tcacagtagactgtgtgctcctg

SEQ ID NO: 212136 - DNA, 23 bp, Mus musculus
gcagtagactgtgtgtgctcatg

SEQ ID NO: 212137 - DNA, 20 bp, Mus musculus
ctctctgtttgtctcaggga

SEQ ID NO: 212138 - DNA, 20 bp, Mus musculus
gctttgaaataggtttggac

SEQ ID NO: 212139 - DNA, 23 bp, Mus musculus
agatcatggagacttctgaagta

SEQ ID NO: 212140 - DNA, 22 bp, Mus musculus
ctgtgtgtgcatgtgcatgtgt

SEQ ID NO: 212141 - DNA, 22 bp, Mus musculus
aagtgagtctcatatgtttgat

SEQ ID NO: 212142 - DNA, 23 bp, Mus musculus
atcatgcttctgagaaactctgt

SEQ ID NO: 212143 - DNA, 23 bp, Mus musculus
taggacttaagttgcataggaaa

SEQ ID NO: 212144 - DNA, 18 bp, Mus musculus
acacacacttgagtgtac

SEQ ID NO: 212145 - DNA, 22 bp, Mus musculus
tgattatatttagataactgta

SEQ ID NO: 212146 - DNA, 23 bp, Mus musculus
aattagatgtatgaagttgatgg

SEQ ID NO: 212147 - DNA, 21 bp, Mus musculus
tgtgtatgtgcatgtgtgtgt

SEQ ID NO: 212148 - DNA, 22 bp, Mus musculus
gcgagtgtgtgcatgtgtatgt

SEQ ID NO: 212149 - DNA, 23 bp, Mus musculus
agaatgactgaagggattgaaga

SEQ ID NO: 212150 - DNA, 23 bp, Mus musculus
tgagtgctgtcttgtgtccctca

SEQ ID NO: 212151 - DNA, 21 bp, Mus musculus
aatctcagtattctctcaggg

SEQ ID NO: 212152 - DNA, 23 bp, Mus musculus
tgcatatgcatgaagaatggtat

SEQ ID NO: 212153 - DNA, 23 bp, Mus musculus
taggttgaagaaagtggttatct

SEQ ID NO: 212154 - DNA, 22 bp, Mus musculus
tgttttgtgaccaattatatgg

SEQ ID NO: 212155 - DNA, 21 bp, Mus musculus
gtaatgtttcattttttgtaa

SEQ ID NO: 212156 - DNA, 20 bp, Mus musculus
tgggattactgtttcagaga

SEQ ID NO: 212157 - DNA, 23 bp, Mus musculus
tagtgcctgtgcctgtgagtgtc

SEQ ID NO: 212158 - DNA, 23 bp, Mus musculus
gagtgactatctctctgtgtggt

SEQ ID NO: 212159 - DNA, 21 bp, Mus musculus
gtgtggaatgttctctgagag

SEQ ID NO: 212160 - DNA, 23 bp, Mus musculus
gtctctctgtgtgttttctgtga

SEQ ID NO: 212161 - DNA, 23 bp, Mus musculus
tccatgtgcatgagaaatctttc

SEQ ID NO: 212162 - DNA, 20 bp, Mus musculus
cagtcacgaaaagcttttgc

SEQ ID NO: 212163 - DNA, 22 bp, Mus musculus
tatacatatatatggaatgtat

SEQ ID NO: 212164 - DNA, 20 bp, Mus musculus
tatatatatatgtatatatg

SEQ ID NO: 212165 - DNA, 23 bp, Mus musculus
tgtatgtatgtgtatatgtatat

SEQ ID NO: 212166 - DNA, 19 bp, Mus musculus
tgaatacatgtatatatga

SEQ ID NO: 212167 - DNA, 23 bp, Mus musculus
atttctgaatatatatttctgaa

SEQ ID NO: 212168 - DNA, 23 bp, Mus musculus
attgctcaagaattgatgctgtc

SEQ ID NO: 212169 - DNA, 23 bp, Mus musculus
tgtgagcatgaatgtgtgtgtgt

SEQ ID NO: 212170 - DNA, 19 bp, Mus musculus
tatctatgtatctatatag

SEQ ID NO: 212171 - DNA, 23 bp, Mus musculus
caatatttttgtatctgttgagg

SEQ ID NO: 212172 - DNA, 22 bp, Mus musculus
ttgtgcagtgattgttgtgtgt

SEQ ID NO: 212173 - DNA, 23 bp, Mus musculus
atgtgtatgcatatattatatat

SEQ ID NO: 212174 - DNA, 23 bp, Mus musculus
attttctcttatggcttttcaga

SEQ ID NO: 212175 - DNA, 23 bp, Mus musculus
aggtacatagagtctgtgagaca

SEQ ID NO: 212176 - DNA, 23 bp, Mus musculus
atacacacacatatacagataca

SEQ ID NO: 212177 - DNA, 23 bp, Mus musculus
tcattactgattttgttaattag

SEQ ID NO: 212178 - DNA, 20 bp, Mus musculus
tctttgaactttagttagtt

SEQ ID NO: 212179 - DNA, 23 bp, Mus musculus
tatgcatatatgtgtatatgtat

SEQ ID NO: 212180 - DNA, 20 bp, Mus musculus
agaggtagatggatggatgg

SEQ ID NO: 212181 - DNA, 18 bp, Mus musculus
gtttaaaagctgtagaag

SEQ ID NO: 212182 - DNA, 23 bp, Mus musculus
gcctcagtggctctgtggctctg

SEQ ID NO: 212183 - DNA, 23 bp, Mus musculus
ctgcatctctgtgtctcactctg

SEQ ID NO: 212184 - DNA, 23 bp, Mus musculus
taaatgaggtatagatttctttg

SEQ ID NO: 212185 - DNA, 20 bp, Mus musculus
tacaagttatctcagttacc

SEQ ID NO: 212186 - DNA, 21 bp, Mus musculus
tgtgtctgtctgtcaattccc

SEQ ID NO: 212187 - DNA, 22 bp, Mus musculus
tgttttgtgaccaattatatgg

SEQ ID NO: 212188 - DNA, 23 bp, Mus musculus
agttatgtgaaattcttgatctg

SEQ ID NO: 212189 - DNA, 22 bp, Mus musculus
tataacagaatatcgatagaat

SEQ ID NO: 212190 - DNA, 18 bp, Mus musculus
tgttttgttttactctag

SEQ ID NO: 212191 - DNA, 22 bp, Mus musculus
ttctatcttttatgtggaagat

SEQ ID NO: 212192 - DNA, 23 bp, Mus musculus
atatgtatatgtgtatgtgtatg

SEQ ID NO: 212193 - DNA, 21 bp, Mus musculus
atatgtatatatatatatgtg

SEQ ID NO: 212194 - DNA, 23 bp, Mus musculus
tatgtatatatgtatatgtgtat

SEQ ID NO: 212195 - DNA, 20 bp, Mus musculus
ttgttgttttggaaatttgt

SEQ ID NO: 212196 - DNA, 20 bp, Mus musculus
tgtatgtatgtatatatgta

SEQ ID NO: 212197 - DNA, 22 bp, Mus musculus
tgttttgtgaccaattatatgg

SEQ ID NO: 212198 - DNA, 22 bp, Mus musculus
tatgtatgtatgtatgtgtgtg

SEQ ID NO: 212199 - DNA, 19 bp, Mus musculus
catatatgtatgtatacag

SEQ ID NO: 212200 - DNA, 22 bp, Mus musculus
acacacacacacatatatatgt

SEQ ID NO: 212201 - DNA, 23 bp, Mus musculus
agacaactgaggaaggagttctg

SEQ ID NO: 212202 - DNA, 23 bp, Mus musculus
tatgtgtatatatatgtatgtgt

SEQ ID NO: 212203 - DNA, 22 bp, Mus musculus
tggtagacgaggacaaatgttg

SEQ ID NO: 212204 - DNA, 23 bp, Mus musculus
catgttgagtgtgagatcttgcc

SEQ ID NO: 212205 - DNA, 20 bp, Mus musculus
aaagtgcttagagcaacagc

SEQ ID NO: 212206 - DNA, 20 bp, Mus musculus
acagtccctgacagtctctt

SEQ ID NO: 212207 - DNA, 19 bp, Mus musculus
gtttctgttatgtcttact

SEQ ID NO: 212208 - DNA, 21 bp, Mus musculus
tcagagacactcagacagcca

SEQ ID NO: 212209 - DNA, 22 bp, Mus musculus
agaggaagaacatgaagcagct

SEQ ID NO: 212210 - DNA, 23 bp, Mus musculus
tgtctctctgtctgtctgtctat

SEQ ID NO: 212211 - DNA, 21 bp, Mus musculus
tactgactgctcttccagagg

SEQ ID NO: 212212 - DNA, 22 bp, Mus musculus
tttcagggtcaacatcagagag

SEQ ID NO: 212213 - DNA, 21 bp, Mus musculus
gttgggaagtacttaccttgt

SEQ ID NO: 212214 - DNA, 23 bp, Mus musculus
cccttcaacatggtctacagtgt

SEQ ID NO: 212215 - DNA, 22 bp, Mus musculus
tttcggttatctagctttatga

SEQ ID NO: 212216 - DNA, 23 bp, Mus musculus
atacagctagataaccaaagata

SEQ ID NO: 212217 - DNA, 21 bp, Mus musculus
tccatggtggtctgataggat

SEQ ID NO: 212218 - DNA, 22 bp, Mus musculus
tgttttgtgaccaattatatgg

SEQ ID NO: 212219 - DNA, 21 bp, Mus musculus
ttctctttttgtatctgtgtg

SEQ ID NO: 212220 - DNA, 21 bp, Mus musculus
aggtatatatatatgtgtgtg

SEQ ID NO: 212221 - DNA, 23 bp, Mus musculus
tgtatgtatgtatgtatgtatgt

SEQ ID NO: 212222 - DNA, 23 bp, Mus musculus
tgacagaagtgtcagagaagtaa

SEQ ID NO: 212223 - DNA, 23 bp, Mus musculus
ttttcctgtgagccattctggtc

SEQ ID NO: 212224 - DNA, 18 bp, Mus musculus
atcatggtaaaccctgtt

SEQ ID NO: 212225 - DNA, 21 bp, Mus musculus
ggaattcaatagaaatagttt

SEQ ID NO: 212226 - DNA, 23 bp, Mus musculus
atgtgtgcatgtatgtgtgtgtg

SEQ ID NO: 212227 - DNA, 23 bp, Mus musculus
cagaacttgttctacatttgagt

SEQ ID NO: 212228 - DNA, 23 bp, Mus musculus
agttggatgtactttctgtgatg

SEQ ID NO: 212229 - DNA, 23 bp, Mus musculus
tgtgagcttcttgtttttactgt

SEQ ID NO: 212230 - DNA, 23 bp, Mus musculus
tgtgagtttctgtattagttttc

SEQ ID NO: 212231 - DNA, 23 bp, Mus musculus
cagtgctataaagtttcttttta

SEQ ID NO: 212232 - DNA, 21 bp, Mus musculus
taatccaggatacagtggcac

SEQ ID NO: 212233 - DNA, 18 bp, Mus musculus
tatgcgtgtgtgagaagt

SEQ ID NO: 212234 - DNA, 22 bp, Mus musculus
gtatgtatgtatgtatgtgtct

SEQ ID NO: 212235 - DNA, 23 bp, Mus musculus
tcaggaagcagagagagatgagt

SEQ ID NO: 212236 - DNA, 23 bp, Mus musculus
aggcagtctcacactgtgtccat

SEQ ID NO: 212237 - DNA, 23 bp, Mus musculus
ctccctccctctgggtatccctg

SEQ ID NO: 212238 - DNA, 18 bp, Mus musculus
tggtgaggaaatgagttt

SEQ ID NO: 212239 - DNA, 22 bp, Mus musculus
tagaggcatgatttcccaaaca

SEQ ID NO: 212240 - DNA, 18 bp, Mus musculus
agtatgtagaaatgtatt

SEQ ID NO: 212241 - DNA, 19 bp, Mus musculus
tatgtatttaaatatgtag

SEQ ID NO: 212242 - DNA, 22 bp, Mus musculus
ctctgactctctcacgccataa

SEQ ID NO: 212243 - DNA, 21 bp, Mus musculus
ctttccttatgaaaatgtagc

SEQ ID NO: 212244 - DNA, 19 bp, Mus musculus
cacccgctctcagtgctct

SEQ ID NO: 212245 - DNA, 23 bp, Mus musculus
ctcttgtcttgccagggtctcac

SEQ ID NO: 212246 - DNA, 23 bp, Mus musculus
tgtctgtctgtctgtcttgtgct

SEQ ID NO: 212247 - DNA, 22 bp, Mus musculus
tgttttgtgaccaattatatgg

SEQ ID NO: 212248 - DNA, 20 bp, Mus musculus
agagagaattttgacagcac

SEQ ID NO: 212249 - DNA, 18 bp, Mus musculus
tgtgttgtgattcgatcc

SEQ ID NO: 212250 - DNA, 23 bp, Mus musculus
gagggagagttttgtatttcttt

SEQ ID NO: 212251 - DNA, 23 bp, Mus musculus
tgtgtatgcatatgtatgtgtat

SEQ ID NO: 212252 - DNA, 23 bp, Mus musculus
atgtgtgcatttgtatacacata

SEQ ID NO: 212253 - DNA, 22 bp, Mus musculus
tgttttgtgaccaattatatgg

SEQ ID NO: 212254 - DNA, 23 bp, Mus musculus
tgtatgtctgtggtcttcctgag

SEQ ID NO: 212255 - DNA, 23 bp, Mus musculus
gagactctgtgtgtgtgtgcgcc

SEQ ID NO: 212256 - DNA, 22 bp, Mus musculus
acagacagaagacagacagaca

SEQ ID NO: 212257 - DNA, 23 bp, Mus musculus
catgacttcagactcatccagca

SEQ ID NO: 212258 - DNA, 20 bp, Mus musculus
tgtgtgtgactatgtttata

SEQ ID NO: 212259 - DNA, 22 bp, Mus musculus
tgttttgtgaccaattatatgg

SEQ ID NO: 212260 - DNA, 23 bp, Mus musculus
aaatcagtctggctgttctatct

SEQ ID NO: 212261 - DNA, 19 bp, Mus musculus
tttgtgtctgaagggatct

SEQ ID NO: 212262 - DNA, 19 bp, Mus musculus
tcatgtgtatatgtatatg

SEQ ID NO: 212263 - DNA, 23 bp, Mus musculus
tgcatattatgcatgtataaaca

SEQ ID NO: 212264 - DNA, 23 bp, Mus musculus
aggactctgacatagctctctct

SEQ ID NO: 212265 - DNA, 18 bp, Mus musculus
gtgagtctatgtcactgc

SEQ ID NO: 212266 - DNA, 23 bp, Mus musculus
tggaagaggagtgaatttctttt

SEQ ID NO: 212267 - DNA, 23 bp, Mus musculus
tctgtatgtgtaggagcatgtga

SEQ ID NO: 212268 - DNA, 22 bp, Mus musculus
atatgtgtatatgtatatgtga

SEQ ID NO: 212269 - DNA, 19 bp, Mus musculus
gcatgtttgtatatttgtt

SEQ ID NO: 212270 - DNA, 23 bp, Mus musculus
tgtgtgcgtgcgtgcgtgcgtgc

SEQ ID NO: 212271 - DNA, 23 bp, Mus musculus
ttggatctcctgtctctgttgtt

SEQ ID NO: 212272 - DNA, 23 bp, Mus musculus
agtgactcattctctggctctct

SEQ ID NO: 212273 - DNA, 23 bp, Mus musculus
ctttgtcactctcactgttaccc

SEQ ID NO: 212274 - DNA, 23 bp, Mus musculus
aacagtcagatggtaatagtcag

SEQ ID NO: 212275 - DNA, 21 bp, Mus musculus
tctgtttctctgagactatct

SEQ ID NO: 212276 - DNA, 23 bp, Mus musculus
atgtatgtatgtatgtatgtatg

SEQ ID NO: 212277 - DNA, 23 bp, Mus musculus
acatacacacacacatatatcac

SEQ ID NO: 212278 - DNA, 23 bp, Mus musculus
ctgtgtctctgtttagtttctgt

SEQ ID NO: 212279 - DNA, 23 bp, Mus musculus
atctatccattgatgacagtgga

SEQ ID NO: 212280 - DNA, 21 bp, Mus musculus
taatctgaatttttatatgtc

SEQ ID NO: 212281 - DNA, 23 bp, Mus musculus
tgggtgtatatatatatgtgtgt

SEQ ID NO: 212282 - DNA, 22 bp, Mus musculus
gtctgtgtgtctctgtccctaa

SEQ ID NO: 212283 - DNA, 23 bp, Mus musculus
tatgtatgtatgtatgtatatgt

SEQ ID NO: 212284 - DNA, 19 bp, Mus musculus
tcaaatctcagcaaccaca

SEQ ID NO: 212285 - DNA, 20 bp, Mus musculus
attgcattttcctaaaggat

SEQ ID NO: 212286 - DNA, 23 bp, Mus musculus
agactggctctgtgtctccatcc

SEQ ID NO: 212287 - DNA, 21 bp, Mus musculus
gcttttcttccttttctctga

SEQ ID NO: 212288 - DNA, 20 bp, Mus musculus
tgcatctatctatctatctg

SEQ ID NO: 212289 - DNA, 23 bp, Mus musculus
tttgtgcacatacacgtgtgtgt

SEQ ID NO: 212290 - DNA, 23 bp, Mus musculus
ctctgtcactctgattcagtgtg

SEQ ID NO: 212291 - DNA, 23 bp, Mus musculus
acgtgagtaggttaagtttcctg

SEQ ID NO: 212292 - DNA, 23 bp, Mus musculus
agtgtggatatgaaaacgtagga

SEQ ID NO: 212293 - DNA, 23 bp, Mus musculus
aggctttgtgggttgtagagatg

SEQ ID NO: 212294 - DNA, 20 bp, Mus musculus
aagtgccagatctaagcata

SEQ ID NO: 212295 - DNA, 20 bp, Mus musculus
acttgtgtgtaccacagtta

SEQ ID NO: 212296 - DNA, 22 bp, Mus musculus
aggaggcagagcagattgctgt

SEQ ID NO: 212297 - DNA, 23 bp, Mus musculus
agatgtgtctctctgtgtgtaca

SEQ ID NO: 212298 - DNA, 23 bp, Mus musculus
tgagatcttttgtctatggtcct

SEQ ID NO: 212299 - DNA, 22 bp, Mus musculus
tgtgcatatgtatatgcatgca

SEQ ID NO: 212300 - DNA, 23 bp, Mus musculus
tatgtatgtatatgtgtatgtat

SEQ ID NO: 212301 - DNA, 22 bp, Mus musculus
ctgacagtgggaagttaggagc

SEQ ID NO: 212302 - DNA, 23 bp, Mus musculus
taaccagtctgtttttgtggaag

SEQ ID NO: 212303 - DNA, 22 bp, Mus musculus
tacacagagggaaagctccaca

SEQ ID NO: 212304 - DNA, 23 bp, Mus musculus
acatgagttgtgagcagaatggt

SEQ ID NO: 212305 - DNA, 23 bp, Mus musculus
aatgatctgtgacgtgagctttt

SEQ ID NO: 212306 - DNA, 22 bp, Mus musculus
tgcctctagttagacaacacag

SEQ ID NO: 212307 - DNA, 20 bp, Mus musculus
agactggagtgactgagcac

SEQ ID NO: 212308 - DNA, 23 bp, Mus musculus
ttataagtgtgcatgtgtatgtg

SEQ ID NO: 212309 - DNA, 22 bp, Mus musculus
gtctctcactgtgtgcagagga

SEQ ID NO: 212310 - DNA, 21 bp, Mus musculus
gtttgtacatatgtatgtatg

SEQ ID NO: 212311 - DNA, 18 bp, Mus musculus
acacatgtataatgtatg

SEQ ID NO: 212312 - DNA, 23 bp, Mus musculus
catctatatgtatatatgtacat

SEQ ID NO: 212313 - DNA, 21 bp, Mus musculus
tctgaagaagcaggtgagact

SEQ ID NO: 212314 - DNA, 23 bp, Mus musculus
ccaggctccctctctgcatgctt

SEQ ID NO: 212315 - DNA, 23 bp, Mus musculus
ttagtgcatggtgatctggtagg

SEQ ID NO: 212316 - DNA, 19 bp, Mus musculus
tttgtgacctattatgtgg

SEQ ID NO: 212317 - DNA, 22 bp, Mus musculus
tgtgtgcatgtgtttacatgtt

SEQ ID NO: 212318 - DNA, 19 bp, Mus musculus
atatatgtatgtgtgtaag

SEQ ID NO: 212319 - DNA, 23 bp, Mus musculus
tatgcatatgtatatgtatatat

SEQ ID NO: 212320 - DNA, 23 bp, Mus musculus
ttctctctctctctctatgccta

SEQ ID NO: 212321 - DNA, 23 bp, Mus musculus
atatatgtacccagagagagaga

SEQ ID NO: 212322 - DNA, 23 bp, Mus musculus
atgtgtgtatatcatgtgtatgt

SEQ ID NO: 212323 - DNA, 23 bp, Mus musculus
gtgtatcacgtgtatgtggtatg

SEQ ID NO: 212324 - DNA, 23 bp, Mus musculus
tgtgcctgtgtgtgcagcatgtg

SEQ ID NO: 212325 - DNA, 22 bp, Mus musculus
aagaatgtatgcagagcctcac

SEQ ID NO: 212326 - DNA, 21 bp, Mus musculus
cagtgctgtctgtatctgtac

SEQ ID NO: 212327 - DNA, 20 bp, Mus musculus
gcagacactctcagtcactg

SEQ ID NO: 212328 - DNA, 20 bp, Mus musculus
acaggatttttcagtgcctg

SEQ ID NO: 212329 - DNA, 23 bp, Mus musculus
tgttagtctgtggtttttatggg

SEQ ID NO: 212330 - DNA, 21 bp, Mus musculus
catgtctgtgtgtttggagca

SEQ ID NO: 212331 - DNA, 23 bp, Mus musculus
tgtgcatctgctttatttcattt

SEQ ID NO: 212332 - DNA, 23 bp, Mus musculus
gtatgtgcatgtgcatgtgtgtc

SEQ ID NO: 212333 - DNA, 23 bp, Mus musculus
tttcactctgtgtctgaaacagg

SEQ ID NO: 212334 - DNA, 23 bp, Mus musculus
cactgcctctctcaacaggatga

SEQ ID NO: 212335 - DNA, 22 bp, Mus musculus
tgttttgtgaccaattatatgg

SEQ ID NO: 212336 - DNA, 23 bp, Mus musculus
ggatgactgaagagagtctgaag

SEQ ID NO: 212337 - DNA, 23 bp, Mus musculus
tctcatgtaaagttgtgtggaca

SEQ ID NO: 212338 - DNA, 18 bp, Mus musculus
tcaggttagtgttccaaa

SEQ ID NO: 212339 - DNA, 21 bp, Mus musculus
ttttggttttgtttccttata

SEQ ID NO: 212340 - DNA, 23 bp, Mus musculus
tctgtgtgtctgtgtgcctgcca

SEQ ID NO: 212341 - DNA, 21 bp, Mus musculus
ctggctggttttctgtgtcaa

SEQ ID NO: 212342 - DNA, 21 bp, Mus musculus
ttgacacaagatagagtcatc

SEQ ID NO: 212343 - DNA, 23 bp, Mus musculus
tgtcaccaaggtggttctattgt

SEQ ID NO: 212344 - DNA, 23 bp, Mus musculus
agtgtgtgtatgatatatgtgtg

SEQ ID NO: 212345 - DNA, 22 bp, Mus musculus
tgttttgtgaccaattatatgg

SEQ ID NO: 212346 - DNA, 22 bp, Mus musculus
tgactagagagagacttgctct

SEQ ID NO: 212347 - DNA, 23 bp, Mus musculus
gtcaggagagagagaggtgttgc

SEQ ID NO: 212348 - DNA, 23 bp, Mus musculus
acagtttgcagctccttttcttt

SEQ ID NO: 212349 - DNA, 22 bp, Mus musculus
tactggttgtttactgatgaca

SEQ ID NO: 212350 - DNA, 23 bp, Mus musculus
tttatatttgagtcagggtaaga

SEQ ID NO: 212351 - DNA, 19 bp, Mus musculus
cactgccctttctatttgt

SEQ ID NO: 212352 - DNA, 22 bp, Mus musculus
agccagggtgcatgtggtgctg

SEQ ID NO: 212353 - DNA, 23 bp, Mus musculus
gaagattgtagactggttgtaga

SEQ ID NO: 212354 - DNA, 23 bp, Mus musculus
gtgatcacagtcaccacacccag

SEQ ID NO: 212355 - DNA, 23 bp, Mus musculus
aggttctgactccctctctccat

SEQ ID NO: 212356 - DNA, 20 bp, Mus musculus
tgcagcaagatagagtcttc

SEQ ID NO: 212357 - DNA, 21 bp, Mus musculus
ttctgtttcttattcatggat

SEQ ID NO: 212358 - DNA, 20 bp, Mus musculus
tcagatactgagtgagcaca

SEQ ID NO: 212359 - DNA, 23 bp, Mus musculus
ttagagaagacagagacctcagg

SEQ ID NO: 212360 - DNA, 23 bp, Mus musculus
cttggctcatcctgagtttgggt

SEQ ID NO: 212361 - DNA, 21 bp, Mus musculus
atacatgtatttcaggatgta

SEQ ID NO: 212362 - DNA, 22 bp, Mus musculus
acagaagaaccacagtcagtct

SEQ ID NO: 212363 - DNA, 23 bp, Mus musculus
gtctttcagtgtgtgagttaata

SEQ ID NO: 212364 - DNA, 21 bp, Mus musculus
gtcactgtgtaactctgagct

SEQ ID NO: 212365 - DNA, 18 bp, Mus musculus
tatgggaattaatctgta

SEQ ID NO: 212366 - DNA, 18 bp, Mus musculus
tgcatttgattggtgaat

SEQ ID NO: 212367 - DNA, 23 bp, Mus musculus
agcagttgagttttagatgtggt

SEQ ID NO: 212368 - DNA, 23 bp, Mus musculus
cctgtgtgtgtctccctctctgg

SEQ ID NO: 212369 - DNA, 22 bp, Mus musculus
tgttatgtgaccaattatatgg

SEQ ID NO: 212370 - DNA, 23 bp, Mus musculus
gttaacagtctgaagacactgtg

SEQ ID NO: 212371 - DNA, 22 bp, Mus musculus
tgttttgtgaccaattatatgg

SEQ ID NO: 212372 - DNA, 18 bp, Mus musculus
ctgggcacagattttgtc

SEQ ID NO: 212373 - DNA, 23 bp, Mus musculus
atgtacacttgtgaaattgatga

SEQ ID NO: 212374 - DNA, 23 bp, Mus musculus
ttcaggagcattcagtgcagctt

SEQ ID NO: 212375 - DNA, 22 bp, Mus musculus
tgttttgtgaccaattatatgg

SEQ ID NO: 212376 - DNA, 22 bp, Mus musculus
atctttgctgatctttgctttg

SEQ ID NO: 212377 - DNA, 23 bp, Mus musculus
tttaatacagtttttcatgttgt

SEQ ID NO: 212378 - DNA, 20 bp, Mus musculus
tgtgtgagtcctttggtctg

SEQ ID NO: 212379 - DNA, 20 bp, Mus musculus
tttatatacattttgaaaag

SEQ ID NO: 212380 - DNA, 23 bp, Mus musculus
tacatacatatacatgtgtgtgt

SEQ ID NO: 212381 - DNA, 23 bp, Mus musculus
gacagtggtaagagtggacagtc

SEQ ID NO: 212382 - DNA, 22 bp, Mus musculus
gatactgtgtgggaaagatgac

SEQ ID NO: 212383 - DNA, 18 bp, Mus musculus
tctgctgcatgtgctcat

SEQ ID NO: 212384 - DNA, 23 bp, Mus musculus
tatcaatgaacagtttggtgggt

SEQ ID NO: 212385 - DNA, 23 bp, Mus musculus
tgtggaatgaatagagagaggag

SEQ ID NO: 212386 - DNA, 21 bp, Mus musculus
atgctgctgtttctgattccg

SEQ ID NO: 212387 - DNA, 23 bp, Mus musculus
agtactgactgctctttcagagg

SEQ ID NO: 212388 - DNA, 23 bp, Mus musculus
atgtgtctgagtgttttgcttga

SEQ ID NO: 212389 - DNA, 21 bp, Mus musculus
tgtgtgtctgtgtgagggtgt

SEQ ID NO: 212390 - DNA, 21 bp, Mus musculus
ttgtatgagtgtatgtggtgt

SEQ ID NO: 212391 - DNA, 23 bp, Mus musculus
tttcccaccctttctattgtcat

SEQ ID NO: 212392 - DNA, 23 bp, Mus musculus
gatcacttctgatgatgttcttg

SEQ ID NO: 212393 - DNA, 23 bp, Mus musculus
gatttatgagtatgtgaactgga

SEQ ID NO: 212394 - DNA, 23 bp, Mus musculus
tccctcactgtttcgctgtgttc

SEQ ID NO: 212395 - DNA, 21 bp, Mus musculus
tgaggaatgtagaatggccaa

SEQ ID NO: 212396 - DNA, 23 bp, Mus musculus
atatgtgtatgtgtacgtgtgtg

SEQ ID NO: 212397 - DNA, 23 bp, Mus musculus
tagtgcatggtgatctgatagga

SEQ ID NO: 212398 - DNA, 22 bp, Mus musculus
tgttttgtgacctattatgtgg

SEQ ID NO: 212399 - DNA, 23 bp, Mus musculus
ccatagtttagatgttctactca

SEQ ID NO: 212400 - DNA, 23 bp, Mus musculus
atcagtgagtgcatatcatgtgt

SEQ ID NO: 212401 - DNA, 22 bp, Mus musculus
tgttttgtgaccaattatatgg

SEQ ID NO: 212402 - DNA, 23 bp, Mus musculus
actgcttgtggaactgtctcagt

SEQ ID NO: 212403 - DNA, 20 bp, Mus musculus
agagctgctcagttacctca

SEQ ID NO: 212404 - DNA, 23 bp, Mus musculus
cagtccctgtggagtgagtgctg

SEQ ID NO: 212405 - DNA, 20 bp, Mus musculus
acacatgtatatggatggtc

SEQ ID NO: 212406 - DNA, 21 bp, Mus musculus
tctgaagagagtctcctcatg

SEQ ID NO: 212407 - DNA, 23 bp, Mus musculus
ctctgtgtctgagactggctctg

SEQ ID NO: 212408 - DNA, 22 bp, Mus musculus
tctgactgcctgagaagtaact

SEQ ID NO: 212409 - DNA, 23 bp, Mus musculus
tttctcacggtatgtgtctctgt

SEQ ID NO: 212410 - DNA, 19 bp, Mus musculus
cagactccagagggatgtg

SEQ ID NO: 212411 - DNA, 22 bp, Mus musculus
ctgattcagcttctgcatgtgg

SEQ ID NO: 212412 - DNA, 21 bp, Mus musculus
aatcatagtcgagctcctgtc

SEQ ID NO: 212413 - DNA, 18 bp, Mus musculus
tgagttctagtagacatt

SEQ ID NO: 212414 - DNA, 23 bp, Mus musculus
tctgtgggagagtttctggtact

SEQ ID NO: 212415 - DNA, 21 bp, Mus musculus
cacacacacacactctctcac

SEQ ID NO: 212416 - DNA, 23 bp, Mus musculus
atatcacagtctactatggactt

SEQ ID NO: 212417 - DNA, 21 bp, Mus musculus
ttttctgggtgcttgagttgg

SEQ ID NO: 212418 - DNA, 23 bp, Mus musculus
tgagagagtataatatgaggctt

SEQ ID NO: 212419 - DNA, 23 bp, Mus musculus
ttattggtccaataccatagcta

SEQ ID NO: 212420 - DNA, 23 bp, Mus musculus
tcagtgtagagtgtgacgaaagg

SEQ ID NO: 212421 - DNA, 22 bp, Mus musculus
tgtcacacttcagattttgaac

SEQ ID NO: 212422 - DNA, 23 bp, Mus musculus
gaccctgtctgtgtctgtggccc

SEQ ID NO: 212423 - DNA, 23 bp, Mus musculus
agaccctgtggatgtccttggcc

SEQ ID NO: 212424 - DNA, 23 bp, Mus musculus
actgtgggtccagtttgtgtctc

SEQ ID NO: 212425 - DNA, 23 bp, Mus musculus
aaagcctgtgtggtaagcaggtt

SEQ ID NO: 212426 - DNA, 23 bp, Mus musculus
tggaagactagtgattttgttgt

SEQ ID NO: 212427 - DNA, 23 bp, Mus musculus
caacaaatcacagtctgccatat

SEQ ID NO: 212428 - DNA, 23 bp, Mus musculus
ttatgtatgtgtgcatgtgtgtg

SEQ ID NO: 212429 - DNA, 20 bp, Mus musculus
cagatgccagtgaggtcatg

SEQ ID NO: 212430 - DNA, 19 bp, Mus musculus
tctaagtcgcaggtttgct

SEQ ID NO: 212431 - DNA, 23 bp, Mus musculus
tgtgtctgtctgtctctatgtgt

SEQ ID NO: 212432 - DNA, 22 bp, Mus musculus
ctctcagtctcagagcctgcct

SEQ ID NO: 212433 - DNA, 22 bp, Mus musculus
atgtatgtatgtatgtgtgggg

SEQ ID NO: 212434 - DNA, 23 bp, Mus musculus
tgtatgtatgtatgtatgtgtgg

SEQ ID NO: 212435 - DNA, 23 bp, Mus musculus
ctgtctctgtctggctatctggt

SEQ ID NO: 212436 - DNA, 23 bp, Mus musculus
atgggacagatagatttgtgttt

SEQ ID NO: 212437 - DNA, 23 bp, Mus musculus
tatgtgtttatacttatgtgtgt

SEQ ID NO: 212438 - DNA, 23 bp, Mus musculus
tgtgcatatgataaatgtgtgta

SEQ ID NO: 212439 - DNA, 23 bp, Mus musculus
cacacacctatatatatgtcact

SEQ ID NO: 212440 - DNA, 23 bp, Mus musculus
tctgtctgtctgtctgtctgtct

SEQ ID NO: 212441 - DNA, 23 bp, Mus musculus
atagatatagatataggtataga

SEQ ID NO: 212442 - DNA, 23 bp, Mus musculus
gagatcacacggtgctttctaca

SEQ ID NO: 212443 - DNA, 23 bp, Mus musculus
tcaagtggtaggaagttagagac

SEQ ID NO: 212444 - DNA, 23 bp, Mus musculus
tctctgtcacagccactcttgag

SEQ ID NO: 212445 - DNA, 19 bp, Mus musculus
tgtttttgagtctctgtat

SEQ ID NO: 212446 - DNA, 22 bp, Mus musculus
aggctcagtctctgtctttctc

SEQ ID NO: 212447 - DNA, 21 bp, Mus musculus
tgcctgtggatcaggatggaa

SEQ ID NO: 212448 - DNA, 22 bp, Mus musculus
tgagattgtaaactgtagaccg

SEQ ID NO: 212449 - DNA, 23 bp, Mus musculus
ttctgagacatgtgatgcttctg

SEQ ID NO: 212450 - DNA, 23 bp, Mus musculus
gctgtgtctctgtctgtcctgca

SEQ ID NO: 212451 - DNA, 21 bp, Mus musculus
atgtgcgccacagagtcccag

SEQ ID NO: 212452 - DNA, 23 bp, Mus musculus
tactgctactacagagctgacat

SEQ ID NO: 212453 - DNA, 22 bp, Mus musculus
atgtgtgcgtctgtgtggctct

SEQ ID NO: 212454 - DNA, 19 bp, Mus musculus
cacaaatgaacatgtgtac

SEQ ID NO: 212455 - DNA, 19 bp, Mus musculus
tgtgacagctatggctgtg

SEQ ID NO: 212456 - DNA, 23 bp, Mus musculus
aaacagctgccatgttgttggtt

SEQ ID NO: 212457 - DNA, 23 bp, Mus musculus
gtatatgtctgtgcatgtacata

SEQ ID NO: 212458 - DNA, 20 bp, Mus musculus
atttgtgtatgtttacacat

SEQ ID NO: 212459 - DNA, 23 bp, Mus musculus
agcaactctctatttctctctca

SEQ ID NO: 212460 - DNA, 23 bp, Mus musculus
aggacagagaggactctgtgccc

SEQ ID NO: 212461 - DNA, 23 bp, Mus musculus
tgtctgtgagacacatagctgtt

SEQ ID NO: 212462 - DNA, 23 bp, Mus musculus
cctgtctcactgtgagtctgagc

SEQ ID NO: 212463 - DNA, 22 bp, Mus musculus
cttaggagatcaaggtgaagat

SEQ ID NO: 212464 - DNA, 18 bp, Mus musculus
attgagagggaaaaagat

SEQ ID NO: 212465 - DNA, 23 bp, Mus musculus
agtgttcttctctctcacagtcc

SEQ ID NO: 212466 - DNA, 23 bp, Mus musculus
actctgtggctctctctccccca

SEQ ID NO: 212467 - DNA, 20 bp, Mus musculus
acactcacacctgatcgcag

SEQ ID NO: 212468 - DNA, 23 bp, Mus musculus
tttgtgtcagtgtgtctgtgtca

SEQ ID NO: 212469 - DNA, 20 bp, Mus musculus
agaggattttttgtttgctt

SEQ ID NO: 212470 - DNA, 23 bp, Mus musculus
atgtatatatatatgtgtgtgtg

SEQ ID NO: 212471 - DNA, 23 bp, Mus musculus
acaccattatggagactgagtgt

SEQ ID NO: 212472 - DNA, 22 bp, Mus musculus
ttctatatatttatgtgcacac

SEQ ID NO: 212473 - DNA, 23 bp, Mus musculus
tctgagctacatgaaactgtctc

SEQ ID NO: 212474 - DNA, 23 bp, Mus musculus
ctcagtcactctgattctccact

SEQ ID NO: 212475 - DNA, 23 bp, Mus musculus
ctcatgtgtctgtctctcagccg

SEQ ID NO: 212476 - DNA, 20 bp, Mus musculus
agtgctggccagcttgttgg

SEQ ID NO: 212477 - DNA, 19 bp, Mus musculus
ggaaaacaagacatagctt

SEQ ID NO: 212478 - DNA, 23 bp, Mus musculus
agtctctgtctgtgtctctgtct

SEQ ID NO: 212479 - DNA, 22 bp, Mus musculus
caggcccagactcactctctct

SEQ ID NO: 212480 - DNA, 20 bp, Mus musculus
gtgtgcatatgtgtgtgtat

SEQ ID NO: 212481 - DNA, 23 bp, Mus musculus
gtatctgcatctgcatctgtctc

SEQ ID NO: 212482 - DNA, 23 bp, Mus musculus
ttaagaataaaggtgagacaggc

SEQ ID NO: 212483 - DNA, 23 bp, Mus musculus
tggctggctggctggctggctgg

SEQ ID NO: 212484 - DNA, 19 bp, Mus musculus
atcatgtgattcagtatac

SEQ ID NO: 212485 - DNA, 23 bp, Mus musculus
tcagtctgagcagactctgtgag

SEQ ID NO: 212486 - DNA, 20 bp, Mus musculus
aagaaaacaccattggggct

SEQ ID NO: 212487 - DNA, 22 bp, Mus musculus
atgacagaacagtgtttgcaat

SEQ ID NO: 212488 - DNA, 21 bp, Mus musculus
tctgtctttctcagagtcatt

SEQ ID NO: 212489 - DNA, 23 bp, Mus musculus
tgtgtctctgggtgtcttgcttg

SEQ ID NO: 212490 - DNA, 23 bp, Mus musculus
tctctctctctcagtctcttgtc

SEQ ID NO: 212491 - DNA, 23 bp, Mus musculus
ctctatagtgtttttcttgtgca

SEQ ID NO: 212492 - DNA, 23 bp, Mus musculus
tatgtgtgtatatatataagtgt

SEQ ID NO: 212493 - DNA, 23 bp, Mus musculus
atatgtgtttatatctatatatg

SEQ ID NO: 212494 - DNA, 21 bp, Mus musculus
tcagtggctccctgtttggct

SEQ ID NO: 212495 - DNA, 23 bp, Mus musculus
catcacatctgatctctgtgatc

SEQ ID NO: 212496 - DNA, 23 bp, Mus musculus
ttgactctgtggtttacctgctg

SEQ ID NO: 212497 - DNA, 23 bp, Mus musculus
tgaactgggctcagtctgtgagt

SEQ ID NO: 212498 - DNA, 20 bp, Mus musculus
aagagcactgactgctcttc

SEQ ID NO: 212499 - DNA, 22 bp, Mus musculus
ctgggtggtgatgaagtgttgg

SEQ ID NO: 212500 - DNA, 23 bp, Mus musculus
tatgtgtgtatagaaatgcatgt

SEQ ID NO: 212501 - DNA, 23 bp, Mus musculus
cactgactctcactgtggctact

SEQ ID NO: 212502 - DNA, 23 bp, Mus musculus
tagatgtcagtttgagataaggc

SEQ ID NO: 212503 - DNA, 23 bp, Mus musculus
tctccctggctctcagggtctgt

SEQ ID NO: 212504 - DNA, 23 bp, Mus musculus
cctctgactgagtcacttatggg

SEQ ID NO: 212505 - DNA, 20 bp, Mus musculus
cgtatatgtatatgtataca

SEQ ID NO: 212506 - DNA, 19 bp, Mus musculus
atactgtgggtgcacatat

SEQ ID NO: 212507 - DNA, 23 bp, Mus musculus
tctgtatgtgtgtctgtgtgtgt

SEQ ID NO: 212508 - DNA, 23 bp, Mus musculus
gactgactgactgactgaactcg

SEQ ID NO: 212509 - DNA, 23 bp, Mus musculus
ctctgagactgctgttgatccag

SEQ ID NO: 212510 - DNA, 20 bp, Mus musculus
atatatggttcatatccgtt

SEQ ID NO: 212511 - DNA, 19 bp, Mus musculus
atatgctatacatgtggca

SEQ ID NO: 212512 - DNA, 18 bp, Mus musculus
ctgtccacactcactgtt

SEQ ID NO: 212513 - DNA, 23 bp, Mus musculus
gctctctgtgagtgctttacatg

SEQ ID NO: 212514 - DNA, 23 bp, Mus musculus
ctttctctgtgtgaatgtatgca

SEQ ID NO: 212515 - DNA, 23 bp, Mus musculus
atctctgcatggaagtgtgtgtg

SEQ ID NO: 212516 - DNA, 23 bp, Mus musculus
atgtatgtgtgtgtgtgcctgtg

SEQ ID NO: 212517 - DNA, 23 bp, Mus musculus
ctctcccagtctgtgtactcagc

SEQ ID NO: 212518 - DNA, 23 bp, Mus musculus
tatcacacccaagtttgaagaac

SEQ ID NO: 212519 - DNA, 23 bp, Mus musculus
gtctgtctgtctgtctgtaaacc

SEQ ID NO: 212520 - DNA, 22 bp, Mus musculus
gagtctgcttcacatttgggct

SEQ ID NO: 212521 - DNA, 23 bp, Mus musculus
ctgcctgcctgcctgcctgcctg

SEQ ID NO: 212522 - DNA, 21 bp, Mus musculus
tgagccactctgcccggctct

SEQ ID NO: 212523 - DNA, 23 bp, Mus musculus
tctgggtgagcagatgctgctga

SEQ ID NO: 212524 - DNA, 22 bp, Mus musculus
aataacaggggctggtgagatg

SEQ ID NO: 212525 - DNA, 23 bp, Mus musculus
gagtgtgtgtgttcagactctct

SEQ ID NO: 212526 - DNA, 23 bp, Mus musculus
gtgtgtgtgtatatacatatgtg

SEQ ID NO: 212527 - DNA, 22 bp, Mus musculus
atacacacacacatatatatgt

SEQ ID NO: 212528 - DNA, 23 bp, Mus musculus
tgtctgtctgtctgtctgagggt

SEQ ID NO: 212529 - DNA, 22 bp, Mus musculus
atatgtatatatatgtgtatgt

SEQ ID NO: 212530 - DNA, 23 bp, Mus musculus
gtgtgtgtgtgagtgtgcgtgcg

SEQ ID NO: 212531 - DNA, 20 bp, Mus musculus
tgcccagaattgagctttgg

SEQ ID NO: 212532 - DNA, 23 bp, Mus musculus
tatgtgcatgtgcatgtgcatgc

SEQ ID NO: 212533 - DNA, 19 bp, Mus musculus
tctcacatgagcgtgcaca

SEQ ID NO: 212534 - DNA, 23 bp, Mus musculus
ctctgtgcttctcttcagatgaa

SEQ ID NO: 212535 - DNA, 23 bp, Mus musculus
tctctgtctgtaattgtatctgt

SEQ ID NO: 212536 - DNA, 23 bp, Mus musculus
gtgtctcactgtgtgagtgtcag

SEQ ID NO: 212537 - DNA, 23 bp, Mus musculus
tagggtatatcatactgccttga

SEQ ID NO: 212538 - DNA, 23 bp, Mus musculus
ctgtctgtgtctgtctgtgtgtg

SEQ ID NO: 212539 - DNA, 20 bp, Mus musculus
aacactgtctacttaccagg

SEQ ID NO: 212540 - DNA, 21 bp, Mus musculus
ctctcagagaaatctcggaga

SEQ ID NO: 212541 - DNA, 23 bp, Mus musculus
attctgtctgtcactttggggtt

SEQ ID NO: 212542 - DNA, 22 bp, Mus musculus
tgttttgtgaccaattatatgg

SEQ ID NO: 212543 - DNA, 23 bp, Mus musculus
tgcagtgagacaaggatgtctgc

SEQ ID NO: 212544 - DNA, 18 bp, Mus musculus
gggtccaggcttcatagg

SEQ ID NO: 212545 - DNA, 23 bp, Mus musculus
tgcctgtctcgctctgtctctaa

SEQ ID NO: 212546 - DNA, 23 bp, Mus musculus
tctgtctgtctctgtctccttac

SEQ ID NO: 212547 - DNA, 23 bp, Mus musculus
tgcctgcctgcctgcctgcctgc

SEQ ID NO: 212548 - DNA, 19 bp, Mus musculus
aaatgcaccagaaaactga

SEQ ID NO: 212549 - DNA, 20 bp, Mus musculus
tcagtggcttttacactcca

SEQ ID NO: 212550 - DNA, 23 bp, Mus musculus
tgtatgcatatttatgtgtatgt

SEQ ID NO: 212551 - DNA, 21 bp, Mus musculus
acatgtgtgtgcatatgctta

SEQ ID NO: 212552 - DNA, 23 bp, Mus musculus
tctcacacagactcatcttcagg

SEQ ID NO: 212553 - DNA, 19 bp, Mus musculus
tcagggtgggagagtagaa

SEQ ID NO: 212554 - DNA, 23 bp, Mus musculus
tgtgtgtgtgcatgtgcatattt

SEQ ID NO: 212555 - DNA, 23 bp, Mus musculus
gctgtttgcctgtctgtatgtct

SEQ ID NO: 212556 - DNA, 19 bp, Mus musculus
tacacacatatgtatatgt

SEQ ID NO: 212557 - DNA, 23 bp, Mus musculus
atacacacatatacatatgtgtg

SEQ ID NO: 212558 - DNA, 20 bp, Mus musculus
tatgtacatggtcatatgat

SEQ ID NO: 212559 - DNA, 23 bp, Mus musculus
ctgtctgtcattccagttccagg

SEQ ID NO: 212560 - DNA, 23 bp, Mus musculus
tcaacattcaccctggatgttct

SEQ ID NO: 212561 - DNA, 22 bp, Mus musculus
tgaggtagtaggttgtatagtt

SEQ ID NO: 212562 - DNA, 23 bp, Mus musculus
agtgaggtagtagattgtatagt

SEQ ID NO: 212563 - DNA, 22 bp, Mus musculus
agaggtagtaggttgcatagtt

SEQ ID NO: 212564 - DNA, 23 bp, Mus musculus
actatacgacctgctgcctttct

SEQ ID NO: 212565 - DNA, 23 bp, Mus musculus
ttcctagttgaatttggccagaa

SEQ ID NO: 212566 - DNA, 23 bp, Mus musculus
ctctcaggctctcgcacacatca

SEQ ID NO: 212567 - DNA, 23 bp, Mus musculus
actgtagactgagaacacagctc

SEQ ID NO: 212568 - DNA, 23 bp, Mus musculus
tgactatgtagctctctgtttgc

SEQ ID NO: 212569 - DNA, 22 bp, Mus musculus
attttacgacatgtgcagctga

SEQ ID NO: 212570 - DNA, 18 bp, Mus musculus
caggcatcacagttgctc

SEQ ID NO: 212571 - DNA, 23 bp, Mus musculus
tttgtctgtcctctctctcactc

SEQ ID NO: 212572 - DNA, 23 bp, Mus musculus
tcactcagactcatacttgactg

SEQ ID NO: 212573 - DNA, 18 bp, Mus musculus
tgacaaagccctgacaga

SEQ ID NO: 212574 - DNA, 22 bp, Mus musculus
tctcattctttgtgtctgtcca

SEQ ID NO: 212575 - DNA, 22 bp, Mus musculus
tctgtgccaagtcattttgact

SEQ ID NO: 212576 - DNA, 22 bp, Mus musculus
tcatcaggaaatcatggagtag

SEQ ID NO: 212577 - DNA, 23 bp, Mus musculus
gtgtgtgtatgtatatatatgtg

SEQ ID NO: 212578 - DNA, 20 bp, Mus musculus
tgtggtagttagttctctac

SEQ ID NO: 212579 - DNA, 22 bp, Mus musculus
tggtaatgatatgtcatatgtt

SEQ ID NO: 212580 - DNA, 21 bp, Mus musculus
tatgtatatgtatgtgtatgt

SEQ ID NO: 212581 - DNA, 23 bp, Mus musculus
tcactgtgtccctctctgcctct

SEQ ID NO: 212582 - DNA, 23 bp, Mus musculus
attatgtgcatatgtatatgtgt

SEQ ID NO: 212583 - DNA, 20 bp, Mus musculus
acagagacagagtttttttt

SEQ ID NO: 212584 - DNA, 23 bp, Mus musculus
tgtatatgcatatgtatatgtat

SEQ ID NO: 212585 - DNA, 19 bp, Mus musculus
gggtagatggatggatgga

SEQ ID NO: 212586 - DNA, 23 bp, Mus musculus
atttctgtctgttgtagatgaga

SEQ ID NO: 212587 - DNA, 23 bp, Mus musculus
aatgaacagggtctattttgagt

SEQ ID NO: 212588 - DNA, 19 bp, Mus musculus
tggcatgaagtggggattc

SEQ ID NO: 212589 - DNA, 22 bp, Mus musculus
tttcagaggcagctatggtttt

SEQ ID NO: 212590 - DNA, 23 bp, Mus musculus
taaactatgcatgtatatgcata

SEQ ID NO: 212591 - DNA, 20 bp, Mus musculus
gccagtctctcagtctctgt

SEQ ID NO: 212592 - DNA, 19 bp, Mus musculus
cacactctgacactccctg

SEQ ID NO: 212593 - DNA, 22 bp, Mus musculus
tgtgtatttgtatgttattgat

SEQ ID NO: 212594 - DNA, 23 bp, Mus musculus
ttgacttttcttggttttgagac

SEQ ID NO: 212595 - DNA, 21 bp, Mus musculus
agcaccagaagatgcgatgtt

SEQ ID NO: 212596 - DNA, 23 bp, Mus musculus
agtctccctgtctcactgggctt

SEQ ID NO: 212597 - DNA, 23 bp, Mus musculus
tgtgtgtgtgtgtgtgtccagct

SEQ ID NO: 212598 - DNA, 20 bp, Mus musculus
gactcacgtgtgagagcaca

SEQ ID NO: 212599 - DNA, 23 bp, Mus musculus
caactgacttctctatctctctg

SEQ ID NO: 212600 - DNA, 19 bp, Mus musculus
ttctatttatatgtgtgtg

SEQ ID NO: 212601 - DNA, 22 bp, Mus musculus
aaacacacataacacatacaga

SEQ ID NO: 212602 - DNA, 21 bp, Mus musculus
tttttcctcaagatccaggac

SEQ ID NO: 212603 - DNA, 19 bp, Mus musculus
tgtcactgtatctgactcc

SEQ ID NO: 212604 - DNA, 22 bp, Mus musculus
tggtagtatggaggagtggctg

SEQ ID NO: 212605 - DNA, 23 bp, Mus musculus
acctgagcatgaatttgactgtg

SEQ ID NO: 212606 - DNA, 23 bp, Mus musculus
ctgcctgtctgtctgactgactg

SEQ ID NO: 212607 - DNA, 23 bp, Mus musculus
atgtgtgtgtatatgtacatgta

SEQ ID NO: 212608 - DNA, 23 bp, Mus musculus
tatgtatatgtatatgtgtgtat

SEQ ID NO: 212609 - DNA, 23 bp, Mus musculus
tctgtcactgtagcttgtgaggc

SEQ ID NO: 212610 - DNA, 23 bp, Mus musculus
tgtctgtctgtctgtgtgctgtg

SEQ ID NO: 212611 - DNA, 20 bp, Mus musculus
tgtggtagttgcttctttca

SEQ ID NO: 212612 - DNA, 18 bp, Mus musculus
tgacaagaagcaacgaga

SEQ ID NO: 212613 - DNA, 23 bp, Mus musculus
ctgctgagtgttcagagagagca

SEQ ID NO: 212614 - DNA, 19 bp, Mus musculus
ttacttgagggactggaga

SEQ ID NO: 212615 - DNA, 23 bp, Mus musculus
atgtgcatgtatgtatgtatgta

SEQ ID NO: 212616 - DNA, 23 bp, Mus musculus
atgtatatgcttatcttaccaat

SEQ ID NO: 212617 - DNA, 22 bp, Mus musculus
acagatgtgtgtgtgtattgag

SEQ ID NO: 212618 - DNA, 19 bp, Mus musculus
gagagaagagtggcaccac

SEQ ID NO: 212619 - DNA, 23 bp, Mus musculus
gcttgcctgcctgcctgcctgcc

SEQ ID NO: 212620 - DNA, 21 bp, Mus musculus
gtctctcagtctggaattgca

SEQ ID NO: 212621 - DNA, 23 bp, Mus musculus
tggctcactcactctgtgccttg

SEQ ID NO: 212622 - DNA, 18 bp, Mus musculus
atgacaagagatttctct

SEQ ID NO: 212623 - DNA, 23 bp, Mus musculus
tgagtggctctgtgcctccatac

SEQ ID NO: 212624 - DNA, 21 bp, Mus musculus
aggagctatgttattatatat

SEQ ID NO: 212625 - DNA, 22 bp, Mus musculus
tctctggctccctcaattcata

SEQ ID NO: 212626 - DNA, 23 bp, Mus musculus
gatgacacacaagagcaggcaca

SEQ ID NO: 212627 - DNA, 22 bp, Mus musculus
tatggggctggaagagatggct

SEQ ID NO: 212628 - DNA, 23 bp, Mus musculus
ccaggcccacactcactctgcca

SEQ ID NO: 212629 - DNA, 23 bp, Mus musculus
acctgacagaagtaagaatggac

SEQ ID NO: 212630 - DNA, 23 bp, Mus musculus
tcatagcaattctaaactctgta

SEQ ID NO: 212631 - DNA, 23 bp, Mus musculus
atgtgtgtatatatgtgtgtgtg

SEQ ID NO: 212632 - DNA, 20 bp, Mus musculus
gagttcacgggtctgtcctc

SEQ ID NO: 212633 - DNA, 21 bp, Mus musculus
ctttggatgactagtgatatt

SEQ ID NO: 212634 - DNA, 20 bp, Mus musculus
gtattgtgacctttgccttg

SEQ ID NO: 212635 - DNA, 23 bp, Mus musculus
agaggacagagaacagtgctcat

SEQ ID NO: 212636 - DNA, 23 bp, Mus musculus
tgtgtatgtgtatatgtatatgt

SEQ ID NO: 212637 - DNA, 21 bp, Mus musculus
tccaagtgcagattgtcctct

SEQ ID NO: 212638 - DNA, 20 bp, Mus musculus
agagctttaccattgaagat

SEQ ID NO: 212639 - DNA, 23 bp, Mus musculus
tagatatgtaatcatgaatggag

SEQ ID NO: 212640 - DNA, 23 bp, Mus musculus
ctctgtctgtctgtctgtccatc

SEQ ID NO: 212641 - DNA, 20 bp, Mus musculus
ttactgttgtttgactgcag

SEQ ID NO: 212642 - DNA, 18 bp, Mus musculus
atgtgtgtatacatatgt

SEQ ID NO: 212643 - DNA, 22 bp, Mus musculus
ttctcactgtctcccaatctcc

SEQ ID NO: 212644 - DNA, 20 bp, Mus musculus
ctgtgtctctctccctgcca

SEQ ID NO: 212645 - DNA, 23 bp, Mus musculus
gtcatctgtcattctgtcattct

SEQ ID NO: 212646 - DNA, 20 bp, Mus musculus
acagtgatgtgtaagcagtg

SEQ ID NO: 212647 - DNA, 22 bp, Mus musculus
aacagaactgagtgtgcacaga

SEQ ID NO: 212648 - DNA, 23 bp, Mus musculus
acagtcaagatagtctcctctgt

SEQ ID NO: 212649 - DNA, 23 bp, Mus musculus
tgcctgcctgtctgtctgtattg

SEQ ID NO: 212650 - DNA, 23 bp, Mus musculus
tacccattctcagtgactctcat

SEQ ID NO: 212651 - DNA, 23 bp, Mus musculus
cagtgcctcactcactgtgtgat

SEQ ID NO: 212652 - DNA, 18 bp, Mus musculus
gatgaagtacaaggtaag

SEQ ID NO: 212653 - DNA, 21 bp, Mus musculus
agtgttgtgtccaagatgtag

SEQ ID NO: 212654 - DNA, 22 bp, Mus musculus
tgttttgtgaccaattatatgg

SEQ ID NO: 212655 - DNA, 22 bp, Mus musculus
tgttttgtgaccaattatatgg

SEQ ID NO: 212656 - DNA, 23 bp, Mus musculus
ttctgtgcagaaggtgctgtgat

SEQ ID NO: 212657 - DNA, 21 bp, Mus musculus
aatgctgggatcagagaggca

SEQ ID NO: 212658 - DNA, 21 bp, Mus musculus
ctgagatctgactgaccacat

SEQ ID NO: 212659 - DNA, 23 bp, Mus musculus
atgttttgaggagcatggttcag

SEQ ID NO: 212660 - DNA, 22 bp, Mus musculus
tgttttgtgaccaattatatgg

SEQ ID NO: 212661 - DNA, 22 bp, Mus musculus
tccatggtgatctgataggatg

SEQ ID NO: 212662 - DNA, 23 bp, Mus musculus
tgtgggtgtctgagtgcctctga

SEQ ID NO: 212663 - DNA, 21 bp, Mus musculus
tgagatgaggaacagatatgg

SEQ ID NO: 212664 - DNA, 23 bp, Mus musculus
ttttgtgtctggtagaggaatgg

SEQ ID NO: 212665 - DNA, 22 bp, Mus musculus
tgttttgtgaccaattatatgg

SEQ ID NO: 212666 - DNA, 23 bp, Mus musculus
atgagtgtgttacaaaagcagtc

SEQ ID NO: 212667 - DNA, 23 bp, Mus musculus
tgaatatgtgtgtgtgtgtgtgt

SEQ ID NO: 212668 - DNA, 23 bp, Mus musculus
tcagtaactgcatctggaactta

SEQ ID NO: 212669 - DNA, 23 bp, Mus musculus
cttgttctggctgctcagatagt

SEQ ID NO: 212670 - DNA, 23 bp, Mus musculus
tgtgtgagaccatgtccaagtgc

SEQ ID NO: 212671 - DNA, 23 bp, Mus musculus
agtgtgtgtctttgtgtatatgc

SEQ ID NO: 212672 - DNA, 23 bp, Mus musculus
actctgacactctgacagccttc

SEQ ID NO: 212673 - DNA, 21 bp, Mus musculus
atgtatgtatggttatgcatg

SEQ ID NO: 212674 - DNA, 23 bp, Mus musculus
ccagtctcagtctctgcttcagc

SEQ ID NO: 212675 - DNA, 23 bp, Mus musculus
gagaagtgtgagaggtgactcag

SEQ ID NO: 212676 - DNA, 21 bp, Mus musculus
gtgtgagtgtgtgtgtgtata

SEQ ID NO: 212677 - DNA, 21 bp, Mus musculus
cactgtatatactatgtggta

SEQ ID NO: 212678 - DNA, 20 bp, Mus musculus
ggcatgcatatggaacagtt

SEQ ID NO: 212679 - DNA, 22 bp, Mus musculus
tgttttgtgaccaattatatgg

SEQ ID NO: 212680 - DNA, 23 bp, Mus musculus
gctgtgcttatgtatacattaag

SEQ ID NO: 212681 - DNA, 23 bp, Mus musculus
atagaatgtaattttgtatagag

SEQ ID NO: 212682 - DNA, 23 bp, Mus musculus
ttgtatgttgtattgtaacttac

SEQ ID NO: 212683 - DNA, 19 bp, Mus musculus
agacaggcacacagacaga

SEQ ID NO: 212684 - DNA, 23 bp, Mus musculus
gagagtgaacacactgagcctgt

SEQ ID NO: 212685 - DNA, 22 bp, Mus musculus
gcaaagcattgtctccaagctg

SEQ ID NO: 212686 - DNA, 23 bp, Mus musculus
tatatgtatatatacatatgtgt

SEQ ID NO: 212687 - DNA, 21 bp, Mus musculus
tcactgtatcgagtcacaggg

SEQ ID NO: 212688 - DNA, 23 bp, Mus musculus
gtatgtatgtatgtatgtatgta

SEQ ID NO: 212689 - DNA, 22 bp, Mus musculus
tagcaacataatatatatgtat

SEQ ID NO: 212690 - DNA, 21 bp, Mus musculus
tgcatgtatatatacatgtgt

SEQ ID NO: 212691 - DNA, 23 bp, Mus musculus
tgtgtctgcatgtgtatgtgtgt

SEQ ID NO: 212692 - DNA, 23 bp, Mus musculus
catgtgtctgcatgtgtatgtat

SEQ ID NO: 212693 - DNA, 19 bp, Mus musculus
gaatgtatgtatgtatgta

SEQ ID NO: 212694 - DNA, 23 bp, Mus musculus
tatgtatgtgcatatgtgtgtgt

SEQ ID NO: 212695 - DNA, 23 bp, Mus musculus
tgagccacagtctctcactgagc

SEQ ID NO: 212696 - DNA, 19 bp, Mus musculus
tgtgtgtggcagaacttgg

SEQ ID NO: 212697 - DNA, 19 bp, Mus musculus
acatttctacattgctgtt

SEQ ID NO: 212698 - DNA, 23 bp, Mus musculus
tgtctgtgtctgactggctgtct

SEQ ID NO: 212699 - DNA, 19 bp, Mus musculus
tgagttcaattcttagcaa

SEQ ID NO: 212700 - DNA, 23 bp, Mus musculus
caaagactgtcaagggaactctg

SEQ ID NO: 212701 - DNA, 19 bp, Mus musculus
aggaagataagcattctga

SEQ ID NO: 212702 - DNA, 23 bp, Mus musculus
taacctagtagtcagcttttctt

SEQ ID NO: 212703 - DNA, 23 bp, Mus musculus
tgtctgtctgagtctctctgcgt

SEQ ID NO: 212704 - DNA, 21 bp, Mus musculus
ctctgtttctatctctgactc

SEQ ID NO: 212705 - DNA, 23 bp, Mus musculus
tgactcaagaaacacagctggtc

SEQ ID NO: 212706 - DNA, 23 bp, Mus musculus
atagctggttgatgagaagcagt

SEQ ID NO: 212707 - DNA, 23 bp, Mus musculus
gcttccctgtcatttcttggaga

SEQ ID NO: 212708 - DNA, 23 bp, Mus musculus
ctggattttaatgtacattgaag

SEQ ID NO: 212709 - DNA, 23 bp, Mus musculus
acttacctaagagtgcagaatgt

SEQ ID NO: 212710 - DNA, 23 bp, Mus musculus
cagagaagagagtgggctgagat

SEQ ID NO: 212711 - DNA, 20 bp, Mus musculus
ttatcactgttcctgtcttt

SEQ ID NO: 212712 - DNA, 21 bp, Mus musculus
ctgtgcctctcactgtcgcag

SEQ ID NO: 212713 - DNA, 21 bp, Mus musculus
gttttcttgtaaaattcccct

SEQ ID NO: 212714 - DNA, 19 bp, Mus musculus
agagaagacactgagctct

SEQ ID NO: 212715 - DNA, 23 bp, Mus musculus
atgagagtgcattggctctggaa

SEQ ID NO: 212716 - DNA, 19 bp, Mus musculus
taggaggagaaaaaggaga

SEQ ID NO: 212717 - DNA, 23 bp, Mus musculus
tatgtgtgtgcatatatatatat

SEQ ID NO: 212718 - DNA, 23 bp, Mus musculus
actgagcctgtgtggctctctgg

SEQ ID NO: 212719 - DNA, 23 bp, Mus musculus
tacactctgtctgcctcttcttt

SEQ ID NO: 212720 - DNA, 23 bp, Mus musculus
tccctgactccctggttgcctgt

SEQ ID NO: 212721 - DNA, 23 bp, Mus musculus
gtatgtatgtatgtgtgtgtgta

SEQ ID NO: 212722 - DNA, 23 bp, Mus musculus
ctgcctgcctgcctgcctgcctg

SEQ ID NO: 212723 - DNA, 22 bp, Mus musculus
tgtgagatcagtgagaccagaa

SEQ ID NO: 212724 - DNA, 18 bp, Mus musculus
aactcaagcagataagga

SEQ ID NO: 212725 - DNA, 23 bp, Mus musculus
ctgtctcagtctgcctgtgttgt

SEQ ID NO: 212726 - DNA, 23 bp, Mus musculus
tactctgtggattcttctgtgca

SEQ ID NO: 212727 - DNA, 23 bp, Mus musculus
tagtccatgatgttctgatagga

SEQ ID NO: 212728 - DNA, 23 bp, Mus musculus
actcagattcttattattcacaa

SEQ ID NO: 212729 - DNA, 23 bp, Mus musculus
agaaatgagacttgagatgttca

SEQ ID NO: 212730 - DNA, 23 bp, Mus musculus
agggtcacacattcagttcatgg

SEQ ID NO: 212731 - DNA, 22 bp, Mus musculus
catgagagtgtctgtggctcac

SEQ ID NO: 212732 - DNA, 23 bp, Mus musculus
attgcaactggaagaattcagtg

SEQ ID NO: 212733 - DNA, 23 bp, Mus musculus
aataaactattcttgcaggtatg

SEQ ID NO: 212734 - DNA, 23 bp, Mus musculus
ctctttctggttctgtctgtctc

SEQ ID NO: 212735 - DNA, 23 bp, Mus musculus
actactcagaacagtgtgtgatc

SEQ ID NO: 212736 - DNA, 18 bp, Mus musculus
tggttgtagtagtggtca

SEQ ID NO: 212737 - DNA, 23 bp, Mus musculus
gtgagtctctcagtgtgtcaaac

SEQ ID NO: 212738 - DNA, 23 bp, Mus musculus
ggcagtagtcttggagctgtaga

SEQ ID NO: 212739 - DNA, 23 bp, Mus musculus
tgagtctctcactctccctgtgc

SEQ ID NO: 212740 - DNA, 23 bp, Mus musculus
tctgtctgtctgtctgtctgtct

SEQ ID NO: 212741 - DNA, 20 bp, Mus musculus
tctctgtctctctgtctctg

SEQ ID NO: 212742 - DNA, 20 bp, Mus musculus
ccatggtggtctgataggat

SEQ ID NO: 212743 - DNA, 23 bp, Mus musculus
gtggatcttgaggccaaacttgt

SEQ ID NO: 212744 - DNA, 21 bp, Mus musculus
aatcgatagatttgagctgtg

SEQ ID NO: 212745 - DNA, 23 bp, Mus musculus
tctctcagggtagagtgtgacct

SEQ ID NO: 212746 - DNA, 23 bp, Mus musculus
tttatctcagaggttggttagtt

SEQ ID NO: 212747 - DNA, 22 bp, Mus musculus
tgttttgtgaccaattatatgg

SEQ ID NO: 212748 - DNA, 21 bp, Mus musculus
tgtatgtatatattttcagga

SEQ ID NO: 212749 - DNA, 23 bp, Mus musculus
tagtgcttggtgatctgatagga

SEQ ID NO: 212750 - DNA, 22 bp, Mus musculus
tgttttgtgacctattatgtgg

SEQ ID NO: 212751 - DNA, 19 bp, Mus musculus
tctgaccttccctgtcttc

SEQ ID NO: 212752 - DNA, 23 bp, Mus musculus
acataacatgaaacactctgcgg

SEQ ID NO: 212753 - DNA, 23 bp, Mus musculus
tttgtatctgatgaggcttgtct

SEQ ID NO: 212754 - DNA, 23 bp, Mus musculus
taaagtactgtttatcatgttta

SEQ ID NO: 212755 - DNA, 20 bp, Mus musculus
agtgtgtccattttgaacag

SEQ ID NO: 212756 - DNA, 22 bp, Mus musculus
agatgtcagaatttggagggat

SEQ ID NO: 212757 - DNA, 20 bp, Mus musculus
ctcagaagtcagagtggaga

SEQ ID NO: 212758 - DNA, 23 bp, Mus musculus
tcaagagtgctggatagaaaagg

SEQ ID NO: 212759 - DNA, 23 bp, Mus musculus
tttcattgtatttcttattcata

SEQ ID NO: 212760 - DNA, 20 bp, Mus musculus
tgacagaggtaaggctgaag

SEQ ID NO: 212761 - DNA, 22 bp, Mus musculus
tgacagattagattctgttctt

SEQ ID NO: 212762 - DNA, 23 bp, Mus musculus
tctctctgtcacactgtgcatgt

SEQ ID NO: 212763 - DNA, 22 bp, Mus musculus
ttgcatcacagtcactagcgga

SEQ ID NO: 212764 - DNA, 23 bp, Mus musculus
ttcaagtgagatgatgtaggaaa

SEQ ID NO: 212765 - DNA, 23 bp, Mus musculus
attcaaatacttgaaagcagttt

SEQ ID NO: 212766 - DNA, 23 bp, Mus musculus
tttgtactgctgacactttcttg

SEQ ID NO: 212767 - DNA, 23 bp, Mus musculus
tctgactgcttgttcatttttta

SEQ ID NO: 212768 - DNA, 23 bp, Mus musculus
attggttgtaccttgaacagtta

SEQ ID NO: 212769 - DNA, 23 bp, Mus musculus
atgtatgtatgaatgtacatagt

SEQ ID NO: 212770 - DNA, 18 bp, Mus musculus
tgtatgtgtgatgtgtgt

SEQ ID NO: 212771 - DNA, 19 bp, Mus musculus
tatagagtatgtatcattt

SEQ ID NO: 212772 - DNA, 19 bp, Mus musculus
tgcttgggacttttgagag

SEQ ID NO: 212773 - DNA, 23 bp, Mus musculus
tgtctgtctgtctgtctgtctgt

SEQ ID NO: 212774 - DNA, 21 bp, Mus musculus
ttgagttgtctgctgactggc

SEQ ID NO: 212775 - DNA, 23 bp, Mus musculus
aggtcagagtagattgacagctg

SEQ ID NO: 212776 - DNA, 23 bp, Mus musculus
tgctctctctctctctctgtgtg

SEQ ID NO: 212777 - DNA, 23 bp, Mus musculus
ggatggattgcatgtcttggggt

SEQ ID NO: 212778 - DNA, 22 bp, Mus musculus
actcctccattaatcttggata

SEQ ID NO: 212779 - DNA, 22 bp, Mus musculus
aaagatctgagtggctgttgtt

SEQ ID NO: 212780 - DNA, 21 bp, Mus musculus
tctttcactcgcagcattctt

SEQ ID NO: 212781 - DNA, 22 bp, Mus musculus
tgttttgtgaccaattatatgg

SEQ ID NO: 212782 - DNA, 23 bp, Mus musculus
ctcacactctgacagcctttctc

SEQ ID NO: 212783 - DNA, 23 bp, Mus musculus
ttaaagctcttgtagtgttctct

SEQ ID NO: 212784 - DNA, 22 bp, Mus musculus
gagagagagagaagagtgtcag

SEQ ID NO: 212785 - DNA, 20 bp, Mus musculus
gtctgcctgtctgtctgcat

SEQ ID NO: 212786 - DNA, 22 bp, Mus musculus
tctgtgtctcgctgtgttgctt

SEQ ID NO: 212787 - DNA, 18 bp, Mus musculus
tatatactatacataaca

SEQ ID NO: 212788 - DNA, 23 bp, Mus musculus
atttgatagtttagtaaacatct

SEQ ID NO: 212789 - DNA, 23 bp, Mus musculus
aggtgtgtgaagagtgtgacctt

SEQ ID NO: 212790 - DNA, 23 bp, Mus musculus
ttagtgtggatctgtttacctgt

SEQ ID NO: 212791 - DNA, 22 bp, Mus musculus
taggaatgcctacagtaactcc

SEQ ID NO: 212792 - DNA, 23 bp, Mus musculus
ctcagagtgcagactgtgagctc

SEQ ID NO: 212793 - DNA, 23 bp, Mus musculus
tgtcctaatgttttctattacca

SEQ ID NO: 212794 - DNA, 23 bp, Mus musculus
gatagctagataacagatagata

SEQ ID NO: 212795 - DNA, 20 bp, Mus musculus
taaagagctgtatttagtct

SEQ ID NO: 212796 - DNA, 23 bp, Mus musculus
tatgcatgcatatgtgtatgtat

SEQ ID NO: 212797 - DNA, 23 bp, Mus musculus
atgtatgtatgtatgtatgcata

SEQ ID NO: 212798 - DNA, 23 bp, Mus musculus
tttccagtctgttagtcaatgtc

SEQ ID NO: 212799 - DNA, 20 bp, Mus musculus
gtccattgatgttaagagat

SEQ ID NO: 212800 - DNA, 23 bp, Mus musculus
gtctctgtgtgagtgtgtgtgta

SEQ ID NO: 212801 - DNA, 20 bp, Mus musculus
tgcatgtatgtatatatgta

SEQ ID NO: 212802 - DNA, 20 bp, Mus musculus
atttgcagatcaggctggct

SEQ ID NO: 212803 - DNA, 23 bp, Mus musculus
ctgtctgcctctgtctctggact

SEQ ID NO: 212804 - DNA, 23 bp, Mus musculus
ctgtctgctagtgcagcagaagt

SEQ ID NO: 212805 - DNA, 18 bp, Mus musculus
gtgtgtcactcagggtgg

SEQ ID NO: 212806 - DNA, 23 bp, Mus musculus
aaactggatgcactcccagtgtc

SEQ ID NO: 212807 - DNA, 21 bp, Mus musculus
ttagatgtcttttagttgtat

SEQ ID NO: 212808 - DNA, 20 bp, Mus musculus
tgagtgtgcattaggaagtg

SEQ ID NO: 212809 - DNA, 22 bp, Mus musculus
atatgtgtatatgtttacgtat

SEQ ID NO: 212810 - DNA, 18 bp, Mus musculus
atgtacacacacacatat

SEQ ID NO: 212811 - DNA, 22 bp, Mus musculus
agttcctggcagcctgaaagcc

SEQ ID NO: 212812 - DNA, 21 bp, Mus musculus
tctatccctctcagtctgtct

SEQ ID NO: 212813 - DNA, 23 bp, Mus musculus
ataagctggaaagtcatttgctg

SEQ ID NO: 212814 - DNA, 21 bp, Mus musculus
ctatgtaggagaggctgtgtt

SEQ ID NO: 212815 - DNA, 23 bp, Mus musculus
cactcagtgacagtctgcattta

SEQ ID NO: 212816 - DNA, 21 bp, Mus musculus
gatggctcagttgtttggagg

SEQ ID NO: 212817 - DNA, 22 bp, Mus musculus
tgtctgcctgcctccttcccag

SEQ ID NO: 212818 - DNA, 23 bp, Mus musculus
catgctgaagacattgtgtagtt

SEQ ID NO: 212819 - DNA, 23 bp, Mus musculus
atgactgtagtttgtgtggagtt

SEQ ID NO: 212820 - DNA, 23 bp, Mus musculus
tcacctatcagctgtgagagcag

SEQ ID NO: 212821 - DNA, 22 bp, Mus musculus
tagatgctttaagatcccctat

SEQ ID NO: 212822 - DNA, 23 bp, Mus musculus
tgcctgcctgcctgcctgtcacc

SEQ ID NO: 212823 - DNA, 23 bp, Mus musculus
agaactttgagattccaagtgct

SEQ ID NO: 212824 - DNA, 23 bp, Mus musculus
gggatctgtctgtctgtctctcc

SEQ ID NO: 212825 - DNA, 23 bp, Mus musculus
gtatgtgtgtatatgtatgtgtg

SEQ ID NO: 212826 - DNA, 23 bp, Mus musculus
tatatatgtatatgtatgtgtat

SEQ ID NO: 212827 - DNA, 21 bp, Mus musculus
tatatacatgtatatacacat

SEQ ID NO: 212828 - DNA, 21 bp, Mus musculus
ggtaacagtgcttgctactga

SEQ ID NO: 212829 - DNA, 23 bp, Mus musculus
ctgtctgcctgtctgtctacctg

SEQ ID NO: 212830 - DNA, 23 bp, Mus musculus
gtggctgtcactctctgcttgtg

SEQ ID NO: 212831 - DNA, 23 bp, Mus musculus
atgtttgtctgcatgtccatctg

SEQ ID NO: 212832 - DNA, 19 bp, Mus musculus
tcagacagttgcaagctgc

SEQ ID NO: 212833 - DNA, 23 bp, Mus musculus
tagtatatacatattctagtata

SEQ ID NO: 212834 - DNA, 23 bp, Mus musculus
aatgcagagtagtctccagattg

SEQ ID NO: 212835 - DNA, 20 bp, Mus musculus
acagggacaggtacatatgt

SEQ ID NO: 212836 - DNA, 18 bp, Mus musculus
atgttggtctgataggat

SEQ ID NO: 212837 - DNA, 22 bp, Mus musculus
tgttttgtgaccaattatatgg

SEQ ID NO: 212838 - DNA, 22 bp, Mus musculus
tgttttgtgaccaattatatgg

SEQ ID NO: 212839 - DNA, 23 bp, Mus musculus
ttcactagctggttgagactgat

SEQ ID NO: 212840 - DNA, 23 bp, Mus musculus
tgctcacacactatgctgagtga

SEQ ID NO: 212841 - DNA, 18 bp, Mus musculus
acagagtgtgcagagtaa

SEQ ID NO: 212842 - DNA, 20 bp, Mus musculus
atgcacctgagacaggctgt

SEQ ID NO: 212843 - DNA, 23 bp, Mus musculus
tctgtgtctgggatttcagtatg

SEQ ID NO: 212844 - DNA, 23 bp, Mus musculus
tatgactgtgggacttctttgct

SEQ ID NO: 212845 - DNA, 22 bp, Mus musculus
tgttttgtgaccaattatatgg

SEQ ID NO: 212846 - DNA, 22 bp, Mus musculus
tgttttgtgaccaattatatgg

SEQ ID NO: 212847 - DNA, 23 bp, Mus musculus
atgtatttgtgaatgtatatgaa

SEQ ID NO: 212848 - DNA, 23 bp, Mus musculus
gtagtctatgtatgcatatgtga

SEQ ID NO: 212849 - DNA, 23 bp, Mus musculus
tgtgtctctgtgtgtgtgcacat

SEQ ID NO: 212850 - DNA, 23 bp, Mus musculus
tgtatgtatgtatgcatgtatgt

SEQ ID NO: 212851 - DNA, 19 bp, Mus musculus
tgtggtattgcccaaggga

SEQ ID NO: 212852 - DNA, 23 bp, Mus musculus
cttgtctgtgtctgtgactctat

SEQ ID NO: 212853 - DNA, 22 bp, Mus musculus
tcagatcatttggagcagatgt

SEQ ID NO: 212854 - DNA, 19 bp, Mus musculus
tatcattagattcagagca

SEQ ID NO: 212855 - DNA, 22 bp, Mus musculus
tgttttgtgaccaattatatgg

SEQ ID NO: 212856 - DNA, 22 bp, Mus musculus
tgttttgtgaccaattatatgg

SEQ ID NO: 212857 - DNA, 18 bp, Mus musculus
ttaactggggctggagag

SEQ ID NO: 212858 - DNA, 23 bp, Mus musculus
atgtatgtatgtatgtgagtgca

SEQ ID NO: 212859 - DNA, 23 bp, Mus musculus
gtgcctgcctgcctgcctgcctg

SEQ ID NO: 212860 - DNA, 23 bp, Mus musculus
aaatcacactgaacttacaaaga

SEQ ID NO: 212861 - DNA, 22 bp, Mus musculus
aggcagagtggtttggaacatg

SEQ ID NO: 212862 - DNA, 19 bp, Mus musculus
aaaatgagtgaatttgttc

SEQ ID NO: 212863 - DNA, 23 bp, Mus musculus
gtctgtctgtgtctgtatgtgca

SEQ ID NO: 212864 - DNA, 22 bp, Mus musculus
ttttatgtacttctttatgaag

SEQ ID NO: 212865 - DNA, 21 bp, Mus musculus
cagtgggtagagaaagtgttt

SEQ ID NO: 212866 - DNA, 23 bp, Mus musculus
ctagattgtttttctttattgta

SEQ ID NO: 212867 - DNA, 22 bp, Mus musculus
atgagaccagaacgagcactaa

SEQ ID NO: 212868 - DNA, 23 bp, Mus musculus
atccaccttctgtctgtctgtct

SEQ ID NO: 212869 - DNA, 22 bp, Mus musculus
atcagaggcacaaagatggctg

SEQ ID NO: 212870 - DNA, 22 bp, Mus musculus
agtatgtcaaagatgctgtgga

SEQ ID NO: 212871 - DNA, 23 bp, Mus musculus
tcacaggcagttttgaacagact

SEQ ID NO: 212872 - DNA, 23 bp, Mus musculus
agtctgtgttgagtctcattcag

SEQ ID NO: 212873 - DNA, 22 bp, Mus musculus
ttatattcacatatacttgtgg

SEQ ID NO: 212874 - DNA, 23 bp, Mus musculus
ttcatggttgtctcacggaaaac

SEQ ID NO: 212875 - DNA, 23 bp, Mus musculus
agggtttctcagtgtctgtgtgt

SEQ ID NO: 212876 - DNA, 23 bp, Mus musculus
acacactgtcccagagtctccct

SEQ ID NO: 212877 - DNA, 23 bp, Mus musculus
acagttttcagcatgtaatgtgt

SEQ ID NO: 212878 - DNA, 19 bp, Mus musculus
tgactcagtgtagtgtttc

SEQ ID NO: 212879 - DNA, 22 bp, Mus musculus
tatatgtatttgtatgtatgag

SEQ ID NO: 212880 - DNA, 23 bp, Mus musculus
ttgcttcatccacttgggatgtg

SEQ ID NO: 212881 - DNA, 22 bp, Mus musculus
tgttttgtgaccaattatatgg

SEQ ID NO: 212882 - DNA, 23 bp, Mus musculus
tagtgcatggtgatctgatagga

SEQ ID NO: 212883 - DNA, 21 bp, Mus musculus
tgttttgtgaccaattatgtg

SEQ ID NO: 212884 - DNA, 21 bp, Mus musculus
tccatggtggtctgataggat

SEQ ID NO: 212885 - DNA, 22 bp, Mus musculus
tgttttgtgaccaattatatgg

SEQ ID NO: 212886 - DNA, 23 bp, Mus musculus
tatgtgtatgtatttgtatctat

SEQ ID NO: 212887 - DNA, 20 bp, Mus musculus
accatgagactatgttttct

SEQ ID NO: 212888 - DNA, 23 bp, Mus musculus
tggcatgtgtttctcttccttgt

SEQ ID NO: 212889 - DNA, 23 bp, Mus musculus
tccttatgttttgcatagttgag

SEQ ID NO: 212890 - DNA, 23 bp, Mus musculus
aattgtgtctgctaatgatatga

SEQ ID NO: 212891 - DNA, 23 bp, Mus musculus
atgtccgtagacatgcgttaaag

SEQ ID NO: 212892 - DNA, 23 bp, Mus musculus
tgtatgtatgtatgtatgtatgt

SEQ ID NO: 212893 - DNA, 23 bp, Mus musculus
tcactctctgtgtaatgtctggc

SEQ ID NO: 212894 - DNA, 21 bp, Mus musculus
gggctcagactctcacactta

SEQ ID NO: 212895 - DNA, 23 bp, Mus musculus
aagtgacagtgacttgggatggc

SEQ ID NO: 212896 - DNA, 23 bp, Mus musculus
tctgtggctctcagtgagatttg

SEQ ID NO: 212897 - DNA, 23 bp, Mus musculus
cacttgtacagactcgttatttt

SEQ ID NO: 212898 - DNA, 23 bp, Mus musculus
tgacatgtagctgactgcttaga

SEQ ID NO: 212899 - DNA, 23 bp, Mus musculus
aatgaagtgcatttactgttgtt

SEQ ID NO: 212900 - DNA, 23 bp, Mus musculus
agaagtgtgtgagaagaggaact

SEQ ID NO: 212901 - DNA, 23 bp, Mus musculus
gtgccttctctgttcttacatgt

SEQ ID NO: 212902 - DNA, 23 bp, Mus musculus
tactctgtcactgtgtttttagg

SEQ ID NO: 212903 - DNA, 21 bp, Mus musculus
agaaagctctttgtgacaggg

SEQ ID NO: 212904 - DNA, 23 bp, Mus musculus
tctctgtgtctttgatggctctt

SEQ ID NO: 212905 - DNA, 23 bp, Mus musculus
ataagcaggtcaaccagaagatg

SEQ ID NO: 212906 - DNA, 19 bp, Mus musculus
gcatgtatgtatgtatgta

SEQ ID NO: 212907 - DNA, 22 bp, Mus musculus
tgtatgtatgtatgtatatctg

SEQ ID NO: 212908 - DNA, 18 bp, Mus musculus
cagtgagcagacactgcc

SEQ ID NO: 212909 - DNA, 23 bp, Mus musculus
ttatgcttgaagtatttggtgaa

SEQ ID NO: 212910 - DNA, 22 bp, Mus musculus
tgttttgtgaccaattatatgg

SEQ ID NO: 212911 - DNA, 23 bp, Mus musculus
tagtgtgaagttttctatctttg

SEQ ID NO: 212912 - DNA, 19 bp, Mus musculus
agaatgagttgggtagagt

SEQ ID NO: 212913 - DNA, 22 bp, Mus musculus
tgttttgtgaccaattatatgg

SEQ ID NO: 212914 - DNA, 19 bp, Mus musculus
tgcacatgtgtatttgtgt

SEQ ID NO: 212915 - DNA, 23 bp, Mus musculus
tgtgtgcatatgcatgtgtatgt

SEQ ID NO: 212916 - DNA, 23 bp, Mus musculus
tagtccatggtgatctgatagga

SEQ ID NO: 212917 - DNA, 22 bp, Mus musculus
tatatgtaactatatatatgtg

SEQ ID NO: 212918 - DNA, 23 bp, Mus musculus
agtagtaggtggcttcatcttct

SEQ ID NO: 212919 - DNA, 23 bp, Mus musculus
ttgaggtagaagtttgaaaatct

SEQ ID NO: 212920 - DNA, 23 bp, Mus musculus
agtagtaggtggcttcatcttct

SEQ ID NO: 212921 - DNA, 23 bp, Mus musculus
ttgaggtagaagtttgaaaatct

SEQ ID NO: 212922 - DNA, 23 bp, Mus musculus
gacactactcagagaagtgagca

SEQ ID NO: 212923 - DNA, 22 bp, Mus musculus
aattacaggctgctctttgtgt

SEQ ID NO: 212924 - DNA, 23 bp, Mus musculus
tgtgtctctgtgtgatacatgcc

SEQ ID NO: 212925 - DNA, 21 bp, Mus musculus
tgtgtctctgtgtgatacatg

SEQ ID NO: 212926 - DNA, 22 bp, Mus musculus
tgttttgtgaccaattatatgg

SEQ ID NO: 212927 - DNA, 23 bp, Mus musculus
atgtgtgtacatgtgtatgtgtg

SEQ ID NO: 212928 - DNA, 22 bp, Mus musculus
actgatttttctacaatgtggt

SEQ ID NO: 212929 - DNA, 22 bp, Mus musculus
tgttttgtgaccaattatatgg

SEQ ID NO: 212930 - DNA, 21 bp, Mus musculus
aaattgtcttcaatgtcagtg

SEQ ID NO: 212931 - DNA, 23 bp, Mus musculus
gcctgcgtgcctccctggctggc

SEQ ID NO: 212932 - DNA, 22 bp, Mus musculus
atagtagaaagactgttggaga

SEQ ID NO: 212933 - DNA, 23 bp, Mus musculus
ttaaactgacagtttatcctatc

SEQ ID NO: 212934 - DNA, 23 bp, Mus musculus
tgtgtctctgactctttttcctg

SEQ ID NO: 212935 - DNA, 22 bp, Mus musculus
tgttttgtgaccaattatatgg

SEQ ID NO: 212936 - DNA, 21 bp, Mus musculus
caatatttttgtatctgttga

SEQ ID NO: 212937 - DNA, 21 bp, Mus musculus
tgtccaattatatggtcaatt

SEQ ID NO: 212938 - DNA, 23 bp, Mus musculus
tccttcacttgtcttattgttct

SEQ ID NO: 212939 - DNA, 23 bp, Mus musculus
agacgttaagtacaagaacgaat

SEQ ID NO: 212940 - DNA, 22 bp, Mus musculus
tgttttgtgaccaattatatgg

SEQ ID NO: 212941 - DNA, 23 bp, Mus musculus
ctctgagggtagtgtctgtctaa

SEQ ID NO: 212942 - DNA, 23 bp, Mus musculus
agagtctgtcactgtctggcatt

SEQ ID NO: 212943 - DNA, 23 bp, Mus musculus
atgtgtgctactttattagaatg

SEQ ID NO: 212944 - DNA, 22 bp, Mus musculus
tgttttgtgaccaattatatgg

SEQ ID NO: 212945 - DNA, 23 bp, Mus musculus
taacatctgtttttcatgttgtg

SEQ ID NO: 212946 - DNA, 23 bp, Mus musculus
aaagcagacttgatgatgtgaat

SEQ ID NO: 212947 - DNA, 23 bp, Mus musculus
ttgtcttagtcagggtttctatt

SEQ ID NO: 212948 - DNA, 20 bp, Mus musculus
tgactgttccgtgtgtctga

SEQ ID NO: 212949 - DNA, 19 bp, Mus musculus
tttatgattttttccatag

SEQ ID NO: 212950 - DNA, 23 bp, Mus musculus
ggttgaaatcactggaaagctgt

SEQ ID NO: 212951 - DNA, 22 bp, Mus musculus
caatcagcatcctttatgtgtg

SEQ ID NO: 212952 - DNA, 20 bp, Mus musculus
aatcttatacatatgtgaga

SEQ ID NO: 212953 - DNA, 23 bp, Mus musculus
tgtatgtatgtatttatgtatgt

SEQ ID NO: 212954 - DNA, 23 bp, Mus musculus
ctcatactccaaggactggagcc

SEQ ID NO: 212955 - DNA, 19 bp, Mus musculus
atatgtgtatatgtgtacg

SEQ ID NO: 212956 - DNA, 22 bp, Mus musculus
agagtggctctgtcagtgcctg

SEQ ID NO: 212957 - DNA, 22 bp, Mus musculus
ttgtgtgtgtctgtgtgtctct

SEQ ID NO: 212958 - DNA, 19 bp, Mus musculus
cagtggttaagagcactga

SEQ ID NO: 212959 - DNA, 19 bp, Mus musculus
aatgttattcagtttggta

SEQ ID NO: 212960 - DNA, 23 bp, Mus musculus
tagtgcatggtgatctgatagga

SEQ ID NO: 212961 - DNA, 22 bp, Mus musculus
tttgatctattatgtggtcagt

SEQ ID NO: 212962 - DNA, 22 bp, Mus musculus
tgttttgtgaccaattatatgg

SEQ ID NO: 212963 - DNA, 21 bp, Mus musculus
atgagctgtccattagtgaga

SEQ ID NO: 212964 - DNA, 22 bp, Mus musculus
tgtatgtatgtatacatgtatg

SEQ ID NO: 212965 - DNA, 23 bp, Mus musculus
tagtccatggtgatctgatagga

SEQ ID NO: 212966 - DNA, 23 bp, Mus musculus
tagtgcatggtgatctgatagga

SEQ ID NO: 212967 - DNA, 23 bp, Mus musculus
tttttacagttattgttgatgtc

SEQ ID NO: 212968 - DNA, 20 bp, Mus musculus
agcttgtatctatattagtt

SEQ ID NO: 212969 - DNA, 23 bp, Mus musculus
tgtctgtctgtctgtctgggtgt

SEQ ID NO: 212970 - DNA, 19 bp, Mus musculus
agtatagcagacccactgt

SEQ ID NO: 212971 - DNA, 22 bp, Mus musculus
tgttttgtgaccaattatatgg

SEQ ID NO: 212972 - DNA, 23 bp, Mus musculus
tgtctgtctgtttgtctctctat

SEQ ID NO: 212973 - DNA, 23 bp, Mus musculus
tgactcagtctgtgtatcttgat

SEQ ID NO: 212974 - DNA, 23 bp, Mus musculus
aagagaagacagtgagctgagtg

SEQ ID NO: 212975 - DNA, 23 bp, Mus musculus
tctaagtgctacagcaaggcata

SEQ ID NO: 212976 - DNA, 23 bp, Mus musculus
ctgtctgtgtgtgtgtgtctctc

SEQ ID NO: 212977 - DNA, 18 bp, Mus musculus
tgcttttaagtgaggtgc

SEQ ID NO: 212978 - DNA, 23 bp, Mus musculus
atgcctatgtatgtgtatgtgac

SEQ ID NO: 212979 - DNA, 18 bp, Mus musculus
gtatatatagtgtatatg

SEQ ID NO: 212980 - DNA, 23 bp, Mus musculus
acacataggacaaacagatcttg

SEQ ID NO: 212981 - DNA, 23 bp, Mus musculus
tcactctggttcactgaactttg

SEQ ID NO: 212982 - DNA, 23 bp, Mus musculus
atatatgcatatgtatagacata

SEQ ID NO: 212983 - DNA, 23 bp, Mus musculus
tgcatgtatgtatgtatgtatgt

SEQ ID NO: 212984 - DNA, 18 bp, Mus musculus
accactttaactaattgt

SEQ ID NO: 212985 - DNA, 23 bp, Mus musculus
aacatttattgtatatgtgtagg

SEQ ID NO: 212986 - DNA, 23 bp, Mus musculus
tcaccatggttttgtagctctag

SEQ ID NO: 212987 - DNA, 23 bp, Mus musculus
atttgtgaatatgtatatgtcag

SEQ ID NO: 212988 - DNA, 23 bp, Mus musculus
tgcatgtatgtatttgtaggtct

SEQ ID NO: 212989 - DNA, 23 bp, Mus musculus
catctgcatgctcgagtgcatgc

SEQ ID NO: 212990 - DNA, 23 bp, Mus musculus
gcacgagtctctgtgtgtgtgtg

SEQ ID NO: 212991 - DNA, 23 bp, Mus musculus
tctctgtgtctctctgtgtgtgt

SEQ ID NO: 212992 - DNA, 23 bp, Mus musculus
tatgcatgtacatgtatacatgg

SEQ ID NO: 212993 - DNA, 22 bp, Mus musculus
acattacatcccactcaggaag

SEQ ID NO: 212994 - DNA, 20 bp, Mus musculus
tgtatgtatgtatgtatgta

SEQ ID NO: 212995 - DNA, 23 bp, Mus musculus
acagcttgtggtttctgctctgt

SEQ ID NO: 212996 - DNA, 22 bp, Mus musculus
ctgtgtgtcagatgtgtatgtg

SEQ ID NO: 212997 - DNA, 23 bp, Mus musculus
acacatgtcacagtgcacacgtg

SEQ ID NO: 212998 - DNA, 21 bp, Mus musculus
atgcatgtttttatgtgtgta

SEQ ID NO: 212999 - DNA, 23 bp, Mus musculus
atgcatgtgtgcatgtatgtttt

SEQ ID NO: 213000 - DNA, 21 bp, Mus musculus
ttgggacagggactcttcagc

SEQ ID NO: 213001 - DNA, 21 bp, Mus musculus
gtatatatatgtgtgtgtgta

SEQ ID NO: 213002 - DNA, 20 bp, Mus musculus
tgcaaagaaaagcagtgtct

SEQ ID NO: 213003 - DNA, 22 bp, Mus musculus
tatgtgtatatatatgtgtgta

SEQ ID NO: 213004 - DNA, 19 bp, Mus musculus
tactgtgcaaggaaaggct

SEQ ID NO: 213005 - DNA, 21 bp, Mus musculus
ttatctatatatgcatatcat

SEQ ID NO: 213006 - DNA, 20 bp, Mus musculus
gatagatagatagacagata

SEQ ID NO: 213007 - DNA, 23 bp, Mus musculus
tcagttgagtctctgtgaggccc

SEQ ID NO: 213008 - DNA, 19 bp, Mus musculus
tatgagtagagcagaatga

SEQ ID NO: 213009 - DNA, 21 bp, Mus musculus
tgtgtctctgtcactccttaa

SEQ ID NO: 213010 - DNA, 21 bp, Mus musculus
tctcttcctgactctctcaga

SEQ ID NO: 213011 - DNA, 21 bp, Mus musculus
tatgtatgtatgtatatatgt

SEQ ID NO: 213012 - DNA, 21 bp, Mus musculus
acagatgtagacgttgcgtgt

SEQ ID NO: 213013 - DNA, 23 bp, Mus musculus
tgtgtatttgtatgtctgaatat

SEQ ID NO: 213014 - DNA, 23 bp, Mus musculus
ttgcatgcatttgtatgtgaaca

SEQ ID NO: 213015 - DNA, 20 bp, Mus musculus
aaaggtagatagtgactgag

SEQ ID NO: 213016 - DNA, 23 bp, Mus musculus
tctatccatccatctatctatct

SEQ ID NO: 213017 - DNA, 23 bp, Mus musculus
agatcagccagtgctatctgtct

SEQ ID NO: 213018 - DNA, 23 bp, Mus musculus
agctaatgagattgatgtacttg

SEQ ID NO: 213019 - DNA, 18 bp, Mus musculus
tgcagtgtcttctaagct

SEQ ID NO: 213020 - DNA, 23 bp, Mus musculus
tctttccatatgaagctgaaatt

SEQ ID NO: 213021 - DNA, 20 bp, Mus musculus
agaattttaatgaagattgc

SEQ ID NO: 213022 - DNA, 22 bp, Mus musculus
agatcttcaagcttgtatagca

SEQ ID NO: 213023 - DNA, 19 bp, Mus musculus
attccctgtactttgggca

SEQ ID NO: 213024 - DNA, 21 bp, Mus musculus
tatgtatgtatgtatgtatgt

SEQ ID NO: 213025 - DNA, 18 bp, Mus musculus
ctgaaagagagcgtggta

SEQ ID NO: 213026 - DNA, 22 bp, Mus musculus
tgagtttgaagccagtgtacag

SEQ ID NO: 213027 - DNA, 22 bp, Mus musculus
tgttttgtgaccaattatatgg

SEQ ID NO: 213028 - DNA, 23 bp, Mus musculus
agcatcaaccaagagagcacttc

SEQ ID NO: 213029 - DNA, 21 bp, Mus musculus
atgaagttttccaggtttgcc

SEQ ID NO: 213030 - DNA, 23 bp, Mus musculus
tgggactcctaacagtggaagta

SEQ ID NO: 213031 - DNA, 22 bp, Mus musculus
ttactttatttgtaattctgaa

SEQ ID NO: 213032 - DNA, 23 bp, Mus musculus
tctttcctctgaggaaattatgt

SEQ ID NO: 213033 - DNA, 23 bp, Mus musculus
gtctgtctgtgtctgtgaaattc

SEQ ID NO: 213034 - DNA, 23 bp, Mus musculus
gcatgcatgtatgtatgtatata

SEQ ID NO: 213035 - DNA, 22 bp, Mus musculus
gtatgtatgcatgcatgtatgt

SEQ ID NO: 213036 - DNA, 22 bp, Mus musculus
tatgtgtagaaatatgtatgta

SEQ ID NO: 213037 - DNA, 21 bp, Mus musculus
tatgtatgtatgtgtgtacat

SEQ ID NO: 213038 - DNA, 23 bp, Mus musculus
tagtgcatggtgatctgatagga

SEQ ID NO: 213039 - DNA, 23 bp, Mus musculus
ttttgtgaccatttatatggtca

SEQ ID NO: 213040 - DNA, 23 bp, Mus musculus
ttggatccaatggctgactttct

SEQ ID NO: 213041 - DNA, 23 bp, Mus musculus
aagagcactgactgctcttccag

SEQ ID NO: 213042 - DNA, 23 bp, Mus musculus
gaagagactctttaggcttatga

SEQ ID NO: 213043 - DNA, 23 bp, Mus musculus
cattagtagattagttttgagct

SEQ ID NO: 213044 - DNA, 23 bp, Mus musculus
tttctctctggctctctcaggag

SEQ ID NO: 213045 - DNA, 21 bp, Mus musculus
agaaagtggttgatgtattga

SEQ ID NO: 213046 - DNA, 23 bp, Mus musculus
cttgtctctctgtctgtccctgt

SEQ ID NO: 213047 - DNA, 23 bp, Mus musculus
attgtggtatttctggaagattt

SEQ ID NO: 213048 - DNA, 19 bp, Mus musculus
ttttcagagcaaatgagtg

SEQ ID NO: 213049 - DNA, 20 bp, Mus musculus
tgccaagttgtttggtagca

SEQ ID NO: 213050 - DNA, 23 bp, Mus musculus
attgcctggcacactgtttgcca

SEQ ID NO: 213051 - DNA, 21 bp, Mus musculus
tgtgacagcaagagcatgtgg

SEQ ID NO: 213052 - DNA, 23 bp, Mus musculus
tgtctccctgtgtgtctccatgc

SEQ ID NO: 213053 - DNA, 23 bp, Mus musculus
agcctctgatttgacatcaagct

SEQ ID NO: 213054 - DNA, 23 bp, Mus musculus
acgaggacagattttgtacttgt

SEQ ID NO: 213055 - DNA, 23 bp, Mus musculus
tggagagaagagtcacagcagag

SEQ ID NO: 213056 - DNA, 22 bp, Mus musculus
tgttttgtgaccaattatatgg

SEQ ID NO: 213057 - DNA, 22 bp, Mus musculus
tgttttgtgaccaattatatgg

SEQ ID NO: 213058 - DNA, 23 bp, Mus musculus
tttatcattttatgtatgtgtgt

SEQ ID NO: 213059 - DNA, 22 bp, Mus musculus
atatatgtatatatgtatgtgt

SEQ ID NO: 213060 - DNA, 18 bp, Mus musculus
tatgtatatgtatacata

SEQ ID NO: 213061 - DNA, 23 bp, Mus musculus
agcttctgtcttattcttcaatg

SEQ ID NO: 213062 - DNA, 23 bp, Mus musculus
tggtgcaccctctcacctgttca

SEQ ID NO: 213063 - DNA, 22 bp, Mus musculus
tgtaagacacacacactctgag

SEQ ID NO: 213064 - DNA, 23 bp, Mus musculus
atgtgacagcagtgacaggtgag

SEQ ID NO: 213065 - DNA, 22 bp, Mus musculus
ggcctgaagtcactggtggatc

SEQ ID NO: 213066 - DNA, 23 bp, Mus musculus
tgtttgcatgggtgtgtgtgtgt

SEQ ID NO: 213067 - DNA, 18 bp, Mus musculus
ttccactgaagggagctg

SEQ ID NO: 213068 - DNA, 22 bp, Mus musculus
tgatctgataaggtgcatgtga

SEQ ID NO: 213069 - DNA, 23 bp, Mus musculus
tttgtgaccgattatattgtcaa

SEQ ID NO: 213070 - DNA, 22 bp, Mus musculus
tatactgagtccatttattgtg

SEQ ID NO: 213071 - DNA, 23 bp, Mus musculus
tgtgctgtggttggtggctcagt

SEQ ID NO: 213072 - DNA, 22 bp, Mus musculus
actagaagtacacaaacatatt

SEQ ID NO: 213073 - DNA, 22 bp, Mus musculus
tctatgagcatctcgatgaggt

SEQ ID NO: 213074 - DNA, 23 bp, Mus musculus
aacactgactgctcttccagagg

SEQ ID NO: 213075 - DNA, 23 bp, Mus musculus
atacagcaagttcttttatctgt

SEQ ID NO: 213076 - DNA, 23 bp, Mus musculus
ttgcacaagtaagtgtgtgtctg

SEQ ID NO: 213077 - DNA, 21 bp, Mus musculus
agactctgtctctgtctcctg

SEQ ID NO: 213078 - DNA, 22 bp, Mus musculus
agtgagcaagaaattacaagga

SEQ ID NO: 213079 - DNA, 23 bp, Mus musculus
acattaaggttgtaaaggaaggg

SEQ ID NO: 213080 - DNA, 23 bp, Mus musculus
agcatgtggattagatatgtata

SEQ ID NO: 213081 - DNA, 23 bp, Mus musculus
tctgtcacaatgctctctgtact

SEQ ID NO: 213082 - DNA, 22 bp, Mus musculus
tgttttgtgaccaattatatgg

SEQ ID NO: 213083 - DNA, 21 bp, Mus musculus
tctcccacacactttgttatt

SEQ ID NO: 213084 - DNA, 19 bp, Mus musculus
tttcacagcctcccagtgc

SEQ ID NO: 213085 - DNA, 23 bp, Mus musculus
tatgtatgtgtgcaagtccatgc

SEQ ID NO: 213086 - DNA, 23 bp, Mus musculus
atctgagagtgcttggcattagg

SEQ ID NO: 213087 - DNA, 22 bp, Mus musculus
aagcatgtggtggggctggaga

SEQ ID NO: 213088 - DNA, 23 bp, Mus musculus
taagagcactgactgctcttcca

SEQ ID NO: 213089 - DNA, 23 bp, Mus musculus
tgcctgagtctgtctgtctgtct

SEQ ID NO: 213090 - DNA, 20 bp, Mus musculus
tacagcatgtcctttttttt

SEQ ID NO: 213091 - DNA, 19 bp, Mus musculus
gaaaatgatctcatgccat

SEQ ID NO: 213092 - DNA, 23 bp, Mus musculus
tagtgcatggtgatctgatagga

SEQ ID NO: 213093 - DNA, 22 bp, Mus musculus
tgttttgtgacctattatgtgg

SEQ ID NO: 213094 - DNA, 23 bp, Mus musculus
gtaagtgcatgtccttgtgcatg

SEQ ID NO: 213095 - DNA, 23 bp, Mus musculus
ctgtctgtgtctcagtgcctgta

SEQ ID NO: 213096 - DNA, 23 bp, Mus musculus
atcactgaagaaagtgttctcac

SEQ ID NO: 213097 - DNA, 23 bp, Mus musculus
acatgtgattttcttgaagaggg

SEQ ID NO: 213098 - DNA, 23 bp, Mus musculus
ctgtctgtgtctcagtgcctgta

SEQ ID NO: 213099 - DNA, 23 bp, Mus musculus
atcactgaagaaagtgttctcac

SEQ ID NO: 213100 - DNA, 23 bp, Mus musculus
acatgtgattttcttgaagaggg

SEQ ID NO: 213101 - DNA, 23 bp, Mus musculus
aacactgttattatctttgctag

SEQ ID NO: 213102 - DNA, 21 bp, Mus musculus
tctgtgtgcacctgctgtggc

SEQ ID NO: 213103 - DNA, 23 bp, Mus musculus
gtgtctctgtctgtctgtctgtc

SEQ ID NO: 213104 - DNA, 21 bp, Mus musculus
tctgtgtgcacctgctgtggc

SEQ ID NO: 213105 - DNA, 23 bp, Mus musculus
gtgtctctgtctgtctgtctgtc

SEQ ID NO: 213106 - DNA, 23 bp, Mus musculus
gctgtctctgcctgtcttgtctc

SEQ ID NO: 213107 - DNA, 23 bp, Mus musculus
tctcagagaacagtcagtgctct

SEQ ID NO: 213108 - DNA, 21 bp, Mus musculus
ttttgaatttttagacgtctg

SEQ ID NO: 213109 - DNA, 23 bp, Mus musculus
tcagagatgtgactgtggaatgg

SEQ ID NO: 213110 - DNA, 20 bp, Mus musculus
tccctcacttgatgtcctgt

SEQ ID NO: 213111 - DNA, 20 bp, Mus musculus
tatatgtgtgtgtatgtata

SEQ ID NO: 213112 - DNA, 21 bp, Mus musculus
tatatgtcatgtgcatataca

SEQ ID NO: 213113 - DNA, 20 bp, Mus musculus
acaatgatgatgatgataaa

SEQ ID NO: 213114 - DNA, 23 bp, Mus musculus
aaaaatccagggataagagaaac

SEQ ID NO: 213115 - DNA, 20 bp, Mus musculus
tatgtatatgtacatgtaca

SEQ ID NO: 213116 - DNA, 21 bp, Mus musculus
tactctgggtggactggagct

SEQ ID NO: 213117 - DNA, 23 bp, Mus musculus
agagcagtccaatctcagactca

SEQ ID NO: 213118 - DNA, 22 bp, Mus musculus
attagtgtgggacagaagttgc

SEQ ID NO: 213119 - DNA, 23 bp, Mus musculus
ctcactcactcagtcgggatact

SEQ ID NO: 213120 - DNA, 22 bp, Mus musculus
taagccggagcaaagcaggagt

SEQ ID NO: 213121 - DNA, 23 bp, Mus musculus
gtatatatatgtatatgtatgtg

SEQ ID NO: 213122 - DNA, 23 bp, Mus musculus
gctaatggcattggtagaattca

SEQ ID NO: 213123 - DNA, 23 bp, Mus musculus
agcatcagtgtgtaagttctggg

SEQ ID NO: 213124 - DNA, 23 bp, Mus musculus
gttgtgtgtcaaatgtgtgtgtg

SEQ ID NO: 213125 - DNA, 23 bp, Mus musculus
gtatgtgcatgtgtatatgtgtg

SEQ ID NO: 213126 - DNA, 22 bp, Mus musculus
tgtgtatgtgtacatgtgtgtg

SEQ ID NO: 213127 - DNA, 19 bp, Mus musculus
gtctcataggtcttgctgt

SEQ ID NO: 213128 - DNA, 23 bp, Mus musculus
tgtctgcctcagtccctgagact

SEQ ID NO: 213129 - DNA, 20 bp, Mus musculus
agtctatcctagttgaggct

SEQ ID NO: 213130 - DNA, 21 bp, Mus musculus
atgggacccaataacatggga

SEQ ID NO: 213131 - DNA, 23 bp, Mus musculus
gtccctctcactgccatgttgtc

SEQ ID NO: 213132 - DNA, 22 bp, Mus musculus
caggatgtgtctattgatgaga

SEQ ID NO: 213133 - DNA, 22 bp, Mus musculus
acagaagagaatgaggtcagtg

SEQ ID NO: 213134 - DNA, 18 bp, Mus musculus
tttggctggatttcactc

SEQ ID NO: 213135 - DNA, 23 bp, Mus musculus
tggctcactgtctctctttctgc

SEQ ID NO: 213136 - DNA, 22 bp, Mus musculus
ttttggtttctctatatgaagt

SEQ ID NO: 213137 - DNA, 23 bp, Mus musculus
gcattgaatttagaatgctttgg

SEQ ID NO: 213138 - DNA, 19 bp, Mus musculus
tcactgagactagatggca

SEQ ID NO: 213139 - DNA, 22 bp, Mus musculus
actctggctcagactctcctga

SEQ ID NO: 213140 - DNA, 23 bp, Mus musculus
gaaggcattgtgggactgtaatg

SEQ ID NO: 213141 - DNA, 23 bp, Mus musculus
tagctgtcttcagatgatccaga

SEQ ID NO: 213142 - DNA, 23 bp, Mus musculus
gtatgcatgtgtgtgcttatgta

SEQ ID NO: 213143 - DNA, 23 bp, Mus musculus
tctcccactgtctgtatgttctc

SEQ ID NO: 213144 - DNA, 21 bp, Mus musculus
tctgtctgagtcagcttctgg

SEQ ID NO: 213145 - DNA, 20 bp, Mus musculus
tagaggatatgttcaggtaa

SEQ ID NO: 213146 - DNA, 23 bp, Mus musculus
taatagtgtcaggaattgatgct

SEQ ID NO: 213147 - DNA, 19 bp, Mus musculus
tggttatctgataggatgc

SEQ ID NO: 213148 - DNA, 23 bp, Mus musculus
tgtgtctgtgtctatctgtctgt

SEQ ID NO: 213149 - DNA, 22 bp, Mus musculus
agactgaacagagtcaccttaa

SEQ ID NO: 213150 - DNA, 21 bp, Mus musculus
tagagcagagataagagagac

SEQ ID NO: 213151 - DNA, 23 bp, Mus musculus
tgggcacactgtccactgtgagc

SEQ ID NO: 213152 - DNA, 23 bp, Mus musculus
tggggtagtgcttttgttgtagt

SEQ ID NO: 213153 - DNA, 20 bp, Mus musculus
acacacacaaatataattgt

SEQ ID NO: 213154 - DNA, 23 bp, Mus musculus
tgtgaactctgcacattgttttc

SEQ ID NO: 213155 - DNA, 23 bp, Mus musculus
accacagacaagtgagttcagca

SEQ ID NO: 213156 - DNA, 22 bp, Mus musculus
tgttttgtgaccaattatatgg

SEQ ID NO: 213157 - DNA, 21 bp, Mus musculus
tgtgtatgtgcatgtgcatgt

SEQ ID NO: 213158 - DNA, 22 bp, Mus musculus
gcattagtactgattttcttga

SEQ ID NO: 213159 - DNA, 23 bp, Mus musculus
agtgtgcatgtgcatgtgtaacg

SEQ ID NO: 213160 - DNA, 23 bp, Mus musculus
gtgtgtgtatgtatatatgtgtg

SEQ ID NO: 213161 - DNA, 23 bp, Mus musculus
cttgcctgtctgactgtttctct

SEQ ID NO: 213162 - DNA, 18 bp, Mus musculus
tgtctggttttgtagctt

SEQ ID NO: 213163 - DNA, 23 bp, Mus musculus
tgactctcagtgactcatgctcc

SEQ ID NO: 213164 - DNA, 23 bp, Mus musculus
ttggaggtagtgtttctgctgag

SEQ ID NO: 213165 - DNA, 23 bp, Mus musculus
cctctgagactctgtccttcggt

SEQ ID NO: 213166 - DNA, 22 bp, Mus musculus
ccagtctgttagtctctgtctt

SEQ ID NO: 213167 - DNA, 21 bp, Mus musculus
tccatggtggtctgataggat

SEQ ID NO: 213168 - DNA, 22 bp, Mus musculus
tgttttgtgaccaattatatgg

SEQ ID NO: 213169 - DNA, 21 bp, Mus musculus
atgagtaagattggggtatgt

SEQ ID NO: 213170 - DNA, 23 bp, Mus musculus
tttcacagactagactgtgctga

SEQ ID NO: 213171 - DNA, 23 bp, Mus musculus
gacttctgtgtctatctacttcc

SEQ ID NO: 213172 - DNA, 19 bp, Mus musculus
agacagaagtgtatgctca

SEQ ID NO: 213173 - DNA, 22 bp, Mus musculus
gtcagtatagtgagaggagaga

SEQ ID NO: 213174 - DNA, 23 bp, Mus musculus
tgtctctgtcactctagttggtt

SEQ ID NO: 213175 - DNA, 21 bp, Mus musculus
atgtgcatgtgcatgtgcatc

SEQ ID NO: 213176 - DNA, 21 bp, Mus musculus
ctgaactggcatttgtgttct

SEQ ID NO: 213177 - DNA, 20 bp, Mus musculus
tcaggatgatgattggtgga

SEQ ID NO: 213178 - DNA, 21 bp, Mus musculus
tgtctctctctgatacagcag

SEQ ID NO: 213179 - DNA, 22 bp, Mus musculus
cctgccactctccctctgtggg

SEQ ID NO: 213180 - DNA, 23 bp, Mus musculus
gtggttgaactctgtcccactgt

SEQ ID NO: 213181 - DNA, 19 bp, Mus musculus
atcttttaggctttgctca

SEQ ID NO: 213182 - DNA, 23 bp, Mus musculus
ttagtttttcaataagaatttga

SEQ ID NO: 213183 - DNA, 23 bp, Mus musculus
gacaccctctcactgtgagctgt

SEQ ID NO: 213184 - DNA, 22 bp, Mus musculus
tctgtgcctatagtttgacata

SEQ ID NO: 213185 - DNA, 23 bp, Mus musculus
gatctgtgtgtatatgtatgtgt

SEQ ID NO: 213186 - DNA, 23 bp, Mus musculus
gtgatcagggtggtgatagagct

SEQ ID NO: 213187 - DNA, 23 bp, Mus musculus
tggtagtctctcagtgtctgtgg

SEQ ID NO: 213188 - DNA, 23 bp, Mus musculus
tctgtctgtctgtatctgacagt

SEQ ID NO: 213189 - DNA, 21 bp, Mus musculus
cagatacacatatatgcatgt

SEQ ID NO: 213190 - DNA, 21 bp, Mus musculus
cccaccctcagtcactctctc

SEQ ID NO: 213191 - DNA, 20 bp, Mus musculus
ttctgaactgagtgtgcaga

SEQ ID NO: 213192 - DNA, 22 bp, Mus musculus
tatgcatgtgtgtgtgcttgtg

SEQ ID NO: 213193 - DNA, 21 bp, Mus musculus
tagtggctcaatacccataga

SEQ ID NO: 213194 - DNA, 23 bp, Mus musculus
ataggtcctgtgttttagataat

SEQ ID NO: 213195 - DNA, 23 bp, Mus musculus
tatgtatgtatgtatgtgtgtgt

SEQ ID NO: 213196 - DNA, 23 bp, Mus musculus
tgtatgcatgcatgtatgtatgt

SEQ ID NO: 213197 - DNA, 22 bp, Mus musculus
tgttttgtgaccaattatatgg

SEQ ID NO: 213198 - DNA, 23 bp, Mus musculus
tgactctgtccctgagtatctga

SEQ ID NO: 213199 - DNA, 23 bp, Mus musculus
tctctcacagtctgtgcgtgagc

SEQ ID NO: 213200 - DNA, 21 bp, Mus musculus
ttgggacacagtgtgcagact

SEQ ID NO: 213201 - DNA, 20 bp, Mus musculus
tcagtagtgttttccaaggg

SEQ ID NO: 213202 - DNA, 23 bp, Mus musculus
tgcctgcctgtctgcctgcctta

SEQ ID NO: 213203 - DNA, 20 bp, Mus musculus
tctgtatatgtatatgtgtg

SEQ ID NO: 213204 - DNA, 23 bp, Mus musculus
agaacagtagttttccagctttg

SEQ ID NO: 213205 - DNA, 23 bp, Mus musculus
tgtcagtgtttgtgtctgtcagc

SEQ ID NO: 213206 - DNA, 19 bp, Mus musculus
agtcacacagacaatgtcc

SEQ ID NO: 213207 - DNA, 23 bp, Mus musculus
aggattacagatgtgtgtcacca

SEQ ID NO: 213208 - DNA, 20 bp, Mus musculus
atatgtatacatacatatgt

SEQ ID NO: 213209 - DNA, 23 bp, Mus musculus
gtttatgtgcatgtgcttgtgta

SEQ ID NO: 213210 - DNA, 23 bp, Mus musculus
accatgagcaattattttctggg

SEQ ID NO: 213211 - DNA, 22 bp, Mus musculus
gtctgacagtggcagatttcag

SEQ ID NO: 213212 - DNA, 23 bp, Mus musculus
cagtgtgtgcatgaggatgtgga

SEQ ID NO: 213213 - DNA, 21 bp, Mus musculus
agagtggttatagtcataggg

SEQ ID NO: 213214 - DNA, 22 bp, Mus musculus
tgtctcagactctctctctctg

SEQ ID NO: 213215 - DNA, 23 bp, Mus musculus
tgagtaaagtggcagaagtgtag

SEQ ID NO: 213216 - DNA, 23 bp, Mus musculus
tgagactctgcctgcctccctgc

SEQ ID NO: 213217 - DNA, 23 bp, Mus musculus
tcgctgtctctctggctctgttc

SEQ ID NO: 213218 - DNA, 23 bp, Mus musculus
agcctctctccctccctgactgt

SEQ ID NO: 213219 - DNA, 18 bp, Mus musculus
cagtgaccattaggagtg

SEQ ID NO: 213220 - DNA, 23 bp, Mus musculus
caatatttttgtatctgttgagg

SEQ ID NO: 213221 - DNA, 23 bp, Mus musculus
ctcttctctgtgagtgttacagg

SEQ ID NO: 213222 - DNA, 23 bp, Mus musculus
acttcagaatttgttaatctgtc

SEQ ID NO: 213223 - DNA, 23 bp, Mus musculus
agagaacagagagatcagacaag

SEQ ID NO: 213224 - DNA, 22 bp, Mus musculus
tggttttacatgttgatggcag

SEQ ID NO: 213225 - DNA, 23 bp, Mus musculus
aaaatcctagaaatgctttagat

SEQ ID NO: 213226 - DNA, 20 bp, Mus musculus
ggggttgtgctttccttgat

SEQ ID NO: 213227 - DNA, 23 bp, Mus musculus
tggatcagcctccctctgtgagt

SEQ ID NO: 213228 - DNA, 23 bp, Mus musculus
tctgtccctgtcactgtgggttc

SEQ ID NO: 213229 - DNA, 23 bp, Mus musculus
ctgacagtctcagaccctgcttc

SEQ ID NO: 213230 - DNA, 23 bp, Mus musculus
ggcttagtgttctgtctgtgcac

SEQ ID NO: 213231 - DNA, 23 bp, Mus musculus
tggctcagtccttcactgtgtct

SEQ ID NO: 213232 - DNA, 23 bp, Mus musculus
agctagagagatcttgcagtgag

SEQ ID NO: 213233 - DNA, 22 bp, Mus musculus
aggaagtgcattgctgtttctc

SEQ ID NO: 213234 - DNA, 23 bp, Mus musculus
aggggattgtattctgcctggag

SEQ ID NO: 213235 - DNA, 21 bp, Mus musculus
acacacacacactctggtcag

SEQ ID NO: 213236 - DNA, 23 bp, Mus musculus
tttgtctgactggttttgattgg

SEQ ID NO: 213237 - DNA, 23 bp, Mus musculus
tctgcgacaggctctgcttggat

SEQ ID NO: 213238 - DNA, 23 bp, Mus musculus
taaggtaactctcctgggacctc

SEQ ID NO: 213239 - DNA, 23 bp, Mus musculus
tctctctgtgtgtcttgtaggtc

SEQ ID NO: 213240 - DNA, 23 bp, Mus musculus
tctctctgtgtgtcttgtaggtc

SEQ ID NO: 213241 - DNA, 19 bp, Mus musculus
tctgaccctctgtgtctcc

SEQ ID NO: 213242 - DNA, 19 bp, Mus musculus
tctgaggttggaagacttg

SEQ ID NO: 213243 - DNA, 23 bp, Mus musculus
tgtcggtcggtctgtctaaggtt

SEQ ID NO: 213244 - DNA, 22 bp, Mus musculus
tgtatgtgcatgtgcatgtgtg

SEQ ID NO: 213245 - DNA, 23 bp, Mus musculus
tgagcagcagcaagagtatagag

SEQ ID NO: 213246 - DNA, 23 bp, Mus musculus
gtctctgtctgagtgtgtatgtg

SEQ ID NO: 213247 - DNA, 23 bp, Mus musculus
atctctctctctcaggtaccttc

SEQ ID NO: 213248 - DNA, 20 bp, Mus musculus
ataatgtatgcatgtatgat

SEQ ID NO: 213249 - DNA, 23 bp, Mus musculus
atggacagttcttggctcttaaa

SEQ ID NO: 213250 - DNA, 18 bp, Mus musculus
tgtgtgtgtggtatgcat

SEQ ID NO: 213251 - DNA, 23 bp, Mus musculus
cagtggcagtagagagtgagcag

SEQ ID NO: 213252 - DNA, 18 bp, Mus musculus
ttaacctaccttagcctt

SEQ ID NO: 213253 - DNA, 21 bp, Mus musculus
tacctcaagtagctgactttg

SEQ ID NO: 213254 - DNA, 22 bp, Mus musculus
gaagactgtggaagagttcaga

SEQ ID NO: 213255 - DNA, 18 bp, Mus musculus
tctgtctgtatatctgtc

SEQ ID NO: 213256 - DNA, 23 bp, Mus musculus
tgtctgtctgtctgaagtgagtg

SEQ ID NO: 213257 - DNA, 23 bp, Mus musculus
tccagactgagcagacagagctc

SEQ ID NO: 213258 - DNA, 23 bp, Mus musculus
ggctctcctggccgtgctcagtc

SEQ ID NO: 213259 - DNA, 23 bp, Mus musculus
ttgtgttcatctaatgctggtga

SEQ ID NO: 213260 - DNA, 20 bp, Mus musculus
tggctcagtggttaggagca

SEQ ID NO: 213261 - DNA, 23 bp, Mus musculus
aaaagctctgactgctcttccag

SEQ ID NO: 213262 - DNA, 22 bp, Mus musculus
catggagggatgagtgttccaa

SEQ ID NO: 213263 - DNA, 23 bp, Mus musculus
tctctcactctctgtaatgtctg

SEQ ID NO: 213264 - DNA, 23 bp, Mus musculus
agaacactgactgctcttccaga

SEQ ID NO: 213265 - DNA, 21 bp, Mus musculus
ctgtatgtggtgctcaaaggt

SEQ ID NO: 213266 - DNA, 22 bp, Mus musculus
atatgtatatatatgtatgtgt

SEQ ID NO: 213267 - DNA, 23 bp, Mus musculus
ttctgtctgtggttctcatgaca

SEQ ID NO: 213268 - DNA, 23 bp, Mus musculus
ttctcttctctctctgtgagatc

SEQ ID NO: 213269 - DNA, 21 bp, Mus musculus
tccatggtgatctgataggat

SEQ ID NO: 213270 - DNA, 19 bp, Mus musculus
actgtggggttagtaaaac

SEQ ID NO: 213271 - DNA, 20 bp, Mus musculus
tgtatgtatgtatgtatatg

SEQ ID NO: 213272 - DNA, 21 bp, Mus musculus
agtgagcttagctcaacttgg

SEQ ID NO: 213273 - DNA, 22 bp, Mus musculus
tgttttgtgaccaattatatgg

SEQ ID NO: 213274 - DNA, 22 bp, Mus musculus
caggcaagtttgctgatcatag

SEQ ID NO: 213275 - DNA, 23 bp, Mus musculus
taaacactgtgctaaggatgagg

SEQ ID NO: 213276 - DNA, 23 bp, Mus musculus
ttgtctgtctgtgtctctctcct

SEQ ID NO: 213277 - DNA, 23 bp, Mus musculus
tatgtacatgtagatgtgagtgt

SEQ ID NO: 213278 - DNA, 21 bp, Mus musculus
tctgtttctgagtgtcccatt

SEQ ID NO: 213279 - DNA, 23 bp, Mus musculus
gttcactgtcagcagtcagggtg

SEQ ID NO: 213280 - DNA, 23 bp, Mus musculus
ttggattctctgtatacggtatg

SEQ ID NO: 213281 - DNA, 23 bp, Mus musculus
tgtgcttgtgtgtgtgtatgtat

SEQ ID NO: 213282 - DNA, 22 bp, Mus musculus
atacatgtgtatatatatacat

SEQ ID NO: 213283 - DNA, 21 bp, Mus musculus
ctctgagcctctgtctccgtc

SEQ ID NO: 213284 - DNA, 20 bp, Mus musculus
ttcctgttttcttgtatacg

SEQ ID NO: 213285 - DNA, 23 bp, Mus musculus
tcagtaagctagaaaagggatcg

SEQ ID NO: 213286 - DNA, 23 bp, Mus musculus
taacaggtggtacctctttccag

SEQ ID NO: 213287 - DNA, 22 bp, Mus musculus
tatggaagtagaaagagagctc

SEQ ID NO: 213288 - DNA, 23 bp, Mus musculus
cctagttgccatgttgtgggcta

SEQ ID NO: 213289 - DNA, 20 bp, Mus musculus
tcacacctgagtgtgcagag

SEQ ID NO: 213290 - DNA, 20 bp, Mus musculus
atgtcacacctgagtgtgca

SEQ ID NO: 213291 - DNA, 22 bp, Mus musculus
ggtgtcacacctgagtgtgcag

SEQ ID NO: 213292 - DNA, 23 bp, Mus musculus
tgatgtcacacctgagtgtgcag

SEQ ID NO: 213293 - DNA, 22 bp, Mus musculus
agtgtcacacctgagtgtgcag

SEQ ID NO: 213294 - DNA, 23 bp, Mus musculus
ttagaaagcagctgatctggtgg

SEQ ID NO: 213295 - DNA, 21 bp, Mus musculus
tcactccctggctgagactct

SEQ ID NO: 213296 - DNA, 21 bp, Mus musculus
cttctctctctcagtccctcc

SEQ ID NO: 213297 - DNA, 22 bp, Mus musculus
ggtatgtatatgtatctgtgtg

SEQ ID NO: 213298 - DNA, 22 bp, Mus musculus
tgtgtgtacgtgcatgtgtgtg

SEQ ID NO: 213299 - DNA, 23 bp, Mus musculus
aactgagccagcttacctggtga

SEQ ID NO: 213300 - DNA, 21 bp, Mus musculus
ccagtcacactcagtgtctcc

SEQ ID NO: 213301 - DNA, 23 bp, Mus musculus
atatgtatgtatgtatgtatgtg

SEQ ID NO: 213302 - DNA, 23 bp, Mus musculus
tatgtgtgcatgtgtgtgtgtgt

SEQ ID NO: 213303 - DNA, 18 bp, Mus musculus
gtgtgtcactggctcagc

SEQ ID NO: 213304 - DNA, 18 bp, Mus musculus
tatgtatgtatgtatgtg

SEQ ID NO: 213305 - DNA, 23 bp, Mus musculus
attcagacgcatataggagtcac

SEQ ID NO: 213306 - DNA, 20 bp, Mus musculus
aacacgaaatgaacaggcag

SEQ ID NO: 213307 - DNA, 18 bp, Mus musculus
tttgaggtggaagtgctg

SEQ ID NO: 213308 - DNA, 18 bp, Mus musculus
tgctgtgtctgtgtctgt

SEQ ID NO: 213309 - DNA, 23 bp, Mus musculus
aggccattgtctgtctctctgtg

SEQ ID NO: 213310 - DNA, 19 bp, Mus musculus
gagtctgatgcctgcttct

SEQ ID NO: 213311 - DNA, 23 bp, Mus musculus
ctttctctctcagtgattcacat

SEQ ID NO: 213312 - DNA, 23 bp, Mus musculus
gactttacaagaagacggaggct

SEQ ID NO: 213313 - DNA, 23 bp, Mus musculus
ctgtgtctctcagtgggtgtcac

SEQ ID NO: 213314 - DNA, 23 bp, Mus musculus
gcctctgcttgtctgtgtctgtg

SEQ ID NO: 213315 - DNA, 22 bp, Mus musculus
tctgtacagacatcctgagcaa

SEQ ID NO: 213316 - DNA, 23 bp, Mus musculus
atacagaatgtttcgagtatctg

SEQ ID NO: 213317 - DNA, 20 bp, Mus musculus
gtccctgggtctgtgcagtg

SEQ ID NO: 213318 - DNA, 20 bp, Mus musculus
tgtgtgtgtgtgttgtaagt

SEQ ID NO: 213319 - DNA, 22 bp, Mus musculus
gtcctaatgtttaccttcagtg

SEQ ID NO: 213320 - DNA, 21 bp, Mus musculus
gaatgtgacctacctggaagt

SEQ ID NO: 213321 - DNA, 23 bp, Mus musculus
gagagtgctgtctgtctgtctgt

SEQ ID NO: 213322 - DNA, 22 bp, Mus musculus
ccgactctcacacagtccatct

SEQ ID NO: 213323 - DNA, 21 bp, Mus musculus
ttatctctgattacagttcag

SEQ ID NO: 213324 - DNA, 19 bp, Mus musculus
ctgtggaaaggctgtctgt

SEQ ID NO: 213325 - DNA, 23 bp, Mus musculus
tgctactctgagttcttgctgag

SEQ ID NO: 213326 - DNA, 22 bp, Mus musculus
gcactgactgctcttccagagg

SEQ ID NO: 213327 - DNA, 23 bp, Mus musculus
ttatactgggtggtgtgcacctt

SEQ ID NO: 213328 - DNA, 18 bp, Mus musculus
aatctcagcacttgggag

SEQ ID NO: 213329 - DNA, 23 bp, Mus musculus
atatgtgtgtgcatgtgcatgtg

SEQ ID NO: 213330 - DNA, 19 bp, Mus musculus
tgtgtgtatatgtgtgtgc

SEQ ID NO: 213331 - DNA, 23 bp, Mus musculus
cagttgatggtactgtgtctctc

SEQ ID NO: 213332 - DNA, 23 bp, Mus musculus
tgtctgcccgagtgcctgcctct

SEQ ID NO: 213333 - DNA, 23 bp, Mus musculus
taatgactctgaaggcagatgct

SEQ ID NO: 213334 - DNA, 23 bp, Mus musculus
tggatcacaagtgatgttgaact

SEQ ID NO: 213335 - DNA, 22 bp, Mus musculus
agtggacattgatgttggagcc

SEQ ID NO: 213336 - DNA, 21 bp, Mus musculus
tctgtgactgcttatcatacc

SEQ ID NO: 213337 - DNA, 23 bp, Mus musculus
tggaaagatgtctggatgcagtt

SEQ ID NO: 213338 - DNA, 23 bp, Mus musculus
tctttctgtatctattcatatgt

SEQ ID NO: 213339 - DNA, 22 bp, Mus musculus
atacgtatgtatagatgtctgt

SEQ ID NO: 213340 - DNA, 20 bp, Mus musculus
ttgagtcttttcttaggctc

SEQ ID NO: 213341 - DNA, 21 bp, Mus musculus
tgtgtgtgcatgtattcattc

SEQ ID NO: 213342 - DNA, 22 bp, Mus musculus
tgtatgagagttgtgtgtgtgt

SEQ ID NO: 213343 - DNA, 18 bp, Mus musculus
atgcattgtcatgctaag

SEQ ID NO: 213344 - DNA, 23 bp, Mus musculus
cagagatgagtgtctgcacacag

SEQ ID NO: 213345 - DNA, 23 bp, Mus musculus
gacatgtgactgtgtacagtgct

SEQ ID NO: 213346 - DNA, 23 bp, Mus musculus
tgtatatgtatatgtatatgtat

SEQ ID NO: 213347 - DNA, 23 bp, Mus musculus
tagtgcatggtgatctgatagga

SEQ ID NO: 213348 - DNA, 22 bp, Mus musculus
tgttttgtgacctattatgtgg

SEQ ID NO: 213349 - DNA, 20 bp, Mus musculus
ggctgtccctgagcctgttt

SEQ ID NO: 213350 - DNA, 21 bp, Mus musculus
aagtgagtctggatttgaggc

SEQ ID NO: 213351 - DNA, 22 bp, Mus musculus
tctcacactcagtgttttaact

SEQ ID NO: 213352 - DNA, 23 bp, Mus musculus
atcatcgaaaactgtgattggac

SEQ ID NO: 213353 - DNA, 23 bp, Mus musculus
tgtggctgctgctcatctcttgt

SEQ ID NO: 213354 - DNA, 23 bp, Mus musculus
caggagacagagtgcagactgcg

SEQ ID NO: 213355 - DNA, 22 bp, Mus musculus
aagatcatctaagagattggag

SEQ ID NO: 213356 - DNA, 23 bp, Mus musculus
aagagcactgactgctcttccag

SEQ ID NO: 213357 - DNA, 23 bp, Mus musculus
aactagtggctagtctgtcactg

SEQ ID NO: 213358 - DNA, 19 bp, Mus musculus
cattgtgatctgattggat

SEQ ID NO: 213359 - DNA, 22 bp, Mus musculus
ttttgtgaccaattatgttgtc

SEQ ID NO: 213360 - DNA, 23 bp, Mus musculus
tctttgattatcttgctgttagt

SEQ ID NO: 213361 - DNA, 23 bp, Mus musculus
aaagtcagtgttctatttctgta

SEQ ID NO: 213362 - DNA, 23 bp, Mus musculus
acacacacacacatatatgtgtg

SEQ ID NO: 213363 - DNA, 23 bp, Mus musculus
atgtgtgtatgtatgtatatgta

SEQ ID NO: 213364 - DNA, 23 bp, Mus musculus
tgtatgtgaccatgtgtatgcat

SEQ ID NO: 213365 - DNA, 23 bp, Mus musculus
gaatgtatacatgtgtgtattta

SEQ ID NO: 213366 - DNA, 23 bp, Mus musculus
atctcacttctctctctgtgtca

SEQ ID NO: 213367 - DNA, 18 bp, Mus musculus
cacagaacagacatccgt

SEQ ID NO: 213368 - DNA, 23 bp, Mus musculus
cctcagtcagtgtgtgtgttctt

SEQ ID NO: 213369 - DNA, 22 bp, Mus musculus
ttttcacttctacaaataggtt

SEQ ID NO: 213370 - DNA, 22 bp, Mus musculus
tgttttgtgaccaattatatgg

SEQ ID NO: 213371 - DNA, 22 bp, Mus musculus
tgttttgtgaccaattatatgg

SEQ ID NO: 213372 - DNA, 23 bp, Mus musculus
tagtccatggtgatctgatagga

SEQ ID NO: 213373 - DNA, 21 bp, Mus musculus
tgttttgttaccaattatatg

SEQ ID NO: 213374 - DNA, 22 bp, Mus musculus
tgttttgtgaccaattatatgg

SEQ ID NO: 213375 - DNA, 23 bp, Mus musculus
tctgtcactgtgtcagtactctg

SEQ ID NO: 213376 - DNA, 20 bp, Mus musculus
gtgagaagtgccagagcaca

SEQ ID NO: 213377 - DNA, 19 bp, Mus musculus
tttcgtttgcttacagatc

SEQ ID NO: 213378 - DNA, 23 bp, Mus musculus
atgtgtatatatgtatatgtgtg

SEQ ID NO: 213379 - DNA, 18 bp, Mus musculus
atatatatgtatatgtgt

SEQ ID NO: 213380 - DNA, 18 bp, Mus musculus
tgtacttggactggagag

SEQ ID NO: 213381 - DNA, 23 bp, Mus musculus
cacacacacatatatatatgtat

SEQ ID NO: 213382 - DNA, 22 bp, Mus musculus
tgtgtatgtatgtatgtatgta

SEQ ID NO: 213383 - DNA, 19 bp, Mus musculus
tgtatatatatatgtgtgt

SEQ ID NO: 213384 - DNA, 20 bp, Mus musculus
tgtgtgtgtgtatgtatata

SEQ ID NO: 213385 - DNA, 23 bp, Mus musculus
taaagtcagctgagagtgtgcac

SEQ ID NO: 213386 - DNA, 21 bp, Mus musculus
tatatagatacatatatagat

SEQ ID NO: 213387 - DNA, 23 bp, Mus musculus
tttggattagatatatttgtgta

SEQ ID NO: 213388 - DNA, 23 bp, Mus musculus
atatgtccagaatttgtttttga

SEQ ID NO: 213389 - DNA, 19 bp, Mus musculus
actccagcagtcttcttgc

SEQ ID NO: 213390 - DNA, 23 bp, Mus musculus
gagattgatatgtatgttatatt

SEQ ID NO: 213391 - DNA, 20 bp, Mus musculus
atgcatgtatataagtatgt

SEQ ID NO: 213392 - DNA, 23 bp, Mus musculus
agactgtctatggttttagagct

SEQ ID NO: 213393 - DNA, 23 bp, Mus musculus
tccctgtctgtctgtctgtctgt

SEQ ID NO: 213394 - DNA, 18 bp, Mus musculus
cagtggagttgagttcct

SEQ ID NO: 213395 - DNA, 21 bp, Mus musculus
tatatgtatatgtatatgtgt

SEQ ID NO: 213396 - DNA, 23 bp, Mus musculus
gctctcagcatctaatgagatga

SEQ ID NO: 213397 - DNA, 23 bp, Mus musculus
tgtgtgtgtgttatatgtgtagt

SEQ ID NO: 213398 - DNA, 23 bp, Mus musculus
atatatgtgtatatgtatatatg

SEQ ID NO: 213399 - DNA, 23 bp, Mus musculus
gactgtcattttctgtgtctgaa

SEQ ID NO: 213400 - DNA, 23 bp, Mus musculus
atgtgtgtatatgtatttgtatg

SEQ ID NO: 213401 - DNA, 18 bp, Mus musculus
atgcatgtgtgtacatgt

SEQ ID NO: 213402 - DNA, 20 bp, Mus musculus
tgttttgtgacctattatgt

SEQ ID NO: 213403 - DNA, 23 bp, Mus musculus
agagcactgactgctcttccaga

SEQ ID NO: 213404 - DNA, 20 bp, Mus musculus
aaatgagtgattatgttgtt

SEQ ID NO: 213405 - DNA, 23 bp, Mus musculus
tctgtctttctgtctgtccaaat

SEQ ID NO: 213406 - DNA, 22 bp, Mus musculus
aaaccttgggcatagcttatgt

SEQ ID NO: 213407 - DNA, 23 bp, Mus musculus
atatgtatgtatttgtatacatg

SEQ ID NO: 213408 - DNA, 23 bp, Mus musculus
accactgaagagagtctctctct

SEQ ID NO: 213409 - DNA, 23 bp, Mus musculus
tgtgaatgtgcatctgcatttgt

SEQ ID NO: 213410 - DNA, 23 bp, Mus musculus
tggctctcacagacagagagggg

SEQ ID NO: 213411 - DNA, 23 bp, Mus musculus
acactctgtgtgtgaatacggac

SEQ ID NO: 213412 - DNA, 23 bp, Mus musculus
tctctgtgtcagtaagttttgtc

SEQ ID NO: 213413 - DNA, 23 bp, Mus musculus
tgtctgtctacctgcctgcctgt

SEQ ID NO: 213414 - DNA, 23 bp, Mus musculus
gcacactgactgctcttccagag

SEQ ID NO: 213415 - DNA, 21 bp, Mus musculus
cactgtgccatctctccagct

SEQ ID NO: 213416 - DNA, 20 bp, Mus musculus
atcttgcaacatttggttag

SEQ ID NO: 213417 - DNA, 23 bp, Mus musculus
cagcatgactattcattttgatg

SEQ ID NO: 213418 - DNA, 22 bp, Mus musculus
tcttaccacatctgtctgtctg

SEQ ID NO: 213419 - DNA, 22 bp, Mus musculus
tggatccctgggtggctcagcg

SEQ ID NO: 213420 - DNA, 23 bp, Mus musculus
tgactctcaggctctctgcagca

SEQ ID NO: 213421 - DNA, 21 bp, Mus musculus
gattgtatagaactaagaaca

SEQ ID NO: 213422 - DNA, 23 bp, Mus musculus
tattagaacaaagagaattgttt

SEQ ID NO: 213423 - DNA, 23 bp, Mus musculus
tggctctctgtgtgtatacgccc

SEQ ID NO: 213424 - DNA, 23 bp, Mus musculus
tctgtctctgtctctatctgcct

SEQ ID NO: 213425 - DNA, 21 bp, Mus musculus
tggtagatattaattctgagt

SEQ ID NO: 213426 - DNA, 21 bp, Mus musculus
tgatgtggaagaaatgagtta

SEQ ID NO: 213427 - DNA, 22 bp, Mus musculus
gagtaccaggaacaggctggag

SEQ ID NO: 213428 - DNA, 23 bp, Mus musculus
tatgtatgtatatgtatacatat

SEQ ID NO: 213429 - DNA, 18 bp, Mus musculus
cggacactcactgtcact

SEQ ID NO: 213430 - DNA, 23 bp, Mus musculus
taagtacttgtgcctgagatctg

SEQ ID NO: 213431 - DNA, 23 bp, Mus musculus
tacgtggcttgagagatggctca

SEQ ID NO: 213432 - DNA, 23 bp, Mus musculus
ttgtttgctctggctgactagtg

SEQ ID NO: 213433 - DNA, 23 bp, Mus musculus
ttcttggatgagtgtgaggttag

SEQ ID NO: 213434 - DNA, 18 bp, Mus musculus
tggttgttgctcacatgc

SEQ ID NO: 213435 - DNA, 23 bp, Mus musculus
agcctgtgagcgtctctctctct

SEQ ID NO: 213436 - DNA, 22 bp, Mus musculus
agggtcagtgggtcagtgagcc

SEQ ID NO: 213437 - DNA, 19 bp, Mus musculus
cctggctccctgcatgcct

SEQ ID NO: 213438 - DNA, 23 bp, Mus musculus
aactgctgcatcttctccaggtt

SEQ ID NO: 213439 - DNA, 20 bp, Mus musculus
ttctcagtttgtaaatgtct

SEQ ID NO: 213440 - DNA, 22 bp, Mus musculus
agcactctcactcagtcccagt

SEQ ID NO: 213441 - DNA, 21 bp, Mus musculus
agagtccctgtgtgggtctgt

SEQ ID NO: 213442 - DNA, 21 bp, Mus musculus
tgtctgggtgcatgtaagcca

SEQ ID NO: 213443 - DNA, 23 bp, Mus musculus
catgtgagtctctctggctgtgg

SEQ ID NO: 213444 - DNA, 23 bp, Mus musculus
tgtctgcctgtgtctctgtgtgt

SEQ ID NO: 213445 - DNA, 19 bp, Mus musculus
agagaaggctgagggtgtg

SEQ ID NO: 213446 - DNA, 23 bp, Mus musculus
tagtgcatggtgatctgatagga

SEQ ID NO: 213447 - DNA, 22 bp, Mus musculus
tgttttgtgacctattatgtgg

SEQ ID NO: 213448 - DNA, 22 bp, Mus musculus
atatgtgttcatcatatttgct

SEQ ID NO: 213449 - DNA, 19 bp, Mus musculus
taaaagtttttctttttgt

SEQ ID NO: 213450 - DNA, 19 bp, Mus musculus
tctctgtgtatgtgtgtgt

SEQ ID NO: 213451 - DNA, 21 bp, Mus musculus
catgtgtatatttattcatca

SEQ ID NO: 213452 - DNA, 18 bp, Mus musculus
acctgtatatttgttgat

SEQ ID NO: 213453 - DNA, 22 bp, Mus musculus
tgttttgtgaccaattatatgg

SEQ ID NO: 213454 - DNA, 21 bp, Mus musculus
atacctgccaggttttcaagt

SEQ ID NO: 213455 - DNA, 23 bp, Mus musculus
actgcctctctgatcctcagtgt

SEQ ID NO: 213456 - DNA, 23 bp, Mus musculus
actaccacttgtgattatgttgt

SEQ ID NO: 213457 - DNA, 23 bp, Mus musculus
taaatgcaaatagtcatatgact

SEQ ID NO: 213458 - DNA, 23 bp, Mus musculus
acagatgacacagtggactaaga

SEQ ID NO: 213459 - DNA, 19 bp, Mus musculus
tcagagatgagagtggtca

SEQ ID NO: 213460 - DNA, 23 bp, Mus musculus
ctcagtcattcactgtcagacct

SEQ ID NO: 213461 - DNA, 23 bp, Mus musculus
ttcaattctcagtaaccatatgg

SEQ ID NO: 213462 - DNA, 23 bp, Mus musculus
cctgtgcttggtctgagaactca

SEQ ID NO: 213463 - DNA, 23 bp, Mus musculus
gtctctgtgtgtctgtgcacatg

SEQ ID NO: 213464 - DNA, 22 bp, Mus musculus
aactgatgctattagaagacat

SEQ ID NO: 213465 - DNA, 23 bp, Mus musculus
tgagctcactctcagtcaccgac

SEQ ID NO: 213466 - DNA, 23 bp, Mus musculus
ctctgctccacactttgtctctc

SEQ ID NO: 213467 - DNA, 20 bp, Mus musculus
aaggacaggtatatatgtgt

SEQ ID NO: 213468 - DNA, 23 bp, Mus musculus
tttaaatgtatagatacatatgt

SEQ ID NO: 213469 - DNA, 22 bp, Mus musculus
tgtgtgtgtgtgtatatgtatg

SEQ ID NO: 213470 - DNA, 22 bp, Mus musculus
tgttttgtgaccaattatatgg

SEQ ID NO: 213471 - DNA, 20 bp, Mus musculus
atgtatgtatgcatgtatgt

SEQ ID NO: 213472 - DNA, 23 bp, Mus musculus
gtctctgtgtgtgtgtgtctctc

SEQ ID NO: 213473 - DNA, 23 bp, Mus musculus
agaggtgacagagtggagacatg

SEQ ID NO: 213474 - DNA, 18 bp, Mus musculus
actcactgaggaaaggaa

SEQ ID NO: 213475 - DNA, 23 bp, Mus musculus
cagagaagatacagaggactagt

SEQ ID NO: 213476 - DNA, 23 bp, Mus musculus
ttctgtctgtctctgtatcctga

SEQ ID NO: 213477 - DNA, 23 bp, Mus musculus
tgagagatcagatggtggagaga

SEQ ID NO: 213478 - DNA, 19 bp, Mus musculus
ttgaacatttgcaggtttc

SEQ ID NO: 213479 - DNA, 23 bp, Mus musculus
tgtgcatcagtcctgctgtgtct

SEQ ID NO: 213480 - DNA, 23 bp, Mus musculus
tgagagaagggtcactgagactt

SEQ ID NO: 213481 - DNA, 23 bp, Mus musculus
tgtccatttgtaaggatgattgt

SEQ ID NO: 213482 - DNA, 19 bp, Mus musculus
agcagggacagtcaggcac

SEQ ID NO: 213483 - DNA, 23 bp, Mus musculus
ggactctgggtctctcactgctt

SEQ ID NO: 213484 - DNA, 21 bp, Mus musculus
tctggttctggggctggaaag

SEQ ID NO: 213485 - DNA, 18 bp, Mus musculus
tccagagaacccaagttc

SEQ ID NO: 213486 - DNA, 23 bp, Mus musculus
tgtatgcctgtgtgggtgtgtct

SEQ ID NO: 213487 - DNA, 20 bp, Mus musculus
tgtgtgtgcatgtgcatgtg

SEQ ID NO: 213488 - DNA, 23 bp, Mus musculus
tgtgcgtgtggatggaacacagg

SEQ ID NO: 213489 - DNA, 23 bp, Mus musculus
tgcgtgtcactctgctgtcatcc

SEQ ID NO: 213490 - DNA, 23 bp, Mus musculus
caactctgtggattgttctctga

SEQ ID NO: 213491 - DNA, 23 bp, Mus musculus
tgtctatgtctcttaatgttcag

SEQ ID NO: 213492 - DNA, 23 bp, Mus musculus
tctcatacactctcatgtaccag

SEQ ID NO: 213493 - DNA, 20 bp, Mus musculus
ctgttgatggaagagacagc

SEQ ID NO: 213494 - DNA, 23 bp, Mus musculus
accagcagtctcaatgttgactg

SEQ ID NO: 213495 - DNA, 23 bp, Mus musculus
tctccctttcagtcagtcactgt

SEQ ID NO: 213496 - DNA, 23 bp, Mus musculus
cagtgctctgtgtctctttctag

SEQ ID NO: 213497 - DNA, 20 bp, Mus musculus
tttttcaatatgaaaaagac

SEQ ID NO: 213498 - DNA, 23 bp, Mus musculus
atatatatgtacgacagtatatg

SEQ ID NO: 213499 - DNA, 20 bp, Mus musculus
aaacactacagagagagcac

SEQ ID NO: 213500 - DNA, 23 bp, Mus musculus
cctctctctctagttcctggtat

SEQ ID NO: 213501 - DNA, 23 bp, Mus musculus
tcagaaaagagccagcgctggag

SEQ ID NO: 213502 - DNA, 23 bp, Mus musculus
cctggctggctcactctgtccca

SEQ ID NO: 213503 - DNA, 21 bp, Mus musculus
ctcagtctctctcctttacat

SEQ ID NO: 213504 - DNA, 23 bp, Mus musculus
tgtctcagtggttaagagcactg

SEQ ID NO: 213505 - DNA, 23 bp, Mus musculus
ctcagactctctcacagttaaca

SEQ ID NO: 213506 - DNA, 19 bp, Mus musculus
tgaagtcttgtctaccact

SEQ ID NO: 213507 - DNA, 21 bp, Mus musculus
acagagaccagagagagcact

SEQ ID NO: 213508 - DNA, 21 bp, Mus musculus
tgagatcactctggtaggtaa

SEQ ID NO: 213509 - DNA, 18 bp, Mus musculus
tccctctctcagtagata

SEQ ID NO: 213510 - DNA, 21 bp, Mus musculus
ttgtgcttagagtgctagatg

SEQ ID NO: 213511 - DNA, 23 bp, Mus musculus
tgtgatcactctgggagataaga

SEQ ID NO: 213512 - DNA, 22 bp, Mus musculus
atggtggtctgataggataatg

SEQ ID NO: 213513 - DNA, 23 bp, Mus musculus
tgttttgtgaccaactatatggt

SEQ ID NO: 213514 - DNA, 23 bp, Mus musculus
tatgtgcttatatttatgtgtgt

SEQ ID NO: 213515 - DNA, 21 bp, Mus musculus
ctctctctctctctctctaaa

SEQ ID NO: 213516 - DNA, 21 bp, Mus musculus
atggtggctcatgaccatctg

SEQ ID NO: 213517 - DNA, 23 bp, Mus musculus
gagatctgtctgcctctgcctct

SEQ ID NO: 213518 - DNA, 23 bp, Mus musculus
agctggtatgtagagagctatga

SEQ ID NO: 213519 - DNA, 23 bp, Mus musculus
tagatatgacatagctgttgcac

SEQ ID NO: 213520 - DNA, 22 bp, Mus musculus
cactctgactctcagaccttgc

SEQ ID NO: 213521 - DNA, 23 bp, Mus musculus
atatgtacatgcacacacatata

SEQ ID NO: 213522 - DNA, 23 bp, Mus musculus
tctgctatttactgagtttctga

SEQ ID NO: 213523 - DNA, 23 bp, Mus musculus
ttctcagtgtgtcagtggctcac

SEQ ID NO: 213524 - DNA, 23 bp, Mus musculus
gtgcctgtctcccactgtctgtg

SEQ ID NO: 213525 - DNA, 19 bp, Mus musculus
tactcacctttaatctcag

SEQ ID NO: 213526 - DNA, 21 bp, Mus musculus
aggtttcttaagaagaatgtt

SEQ ID NO: 213527 - DNA, 23 bp, Mus musculus
accacgtggtctgactctctctc

SEQ ID NO: 213528 - DNA, 18 bp, Mus musculus
tgtgtgtgtatgaattta

SEQ ID NO: 213529 - DNA, 20 bp, Mus musculus
tcagaggctactgtttggtg

SEQ ID NO: 213530 - DNA, 23 bp, Mus musculus
tctgactctcgacatgttagcca

SEQ ID NO: 213531 - DNA, 19 bp, Mus musculus
agactcaggctctttaaag

SEQ ID NO: 213532 - DNA, 23 bp, Mus musculus
taacacactggctgttctttcag

SEQ ID NO: 213533 - DNA, 18 bp, Mus musculus
tcacacactctggcaatg

SEQ ID NO: 213534 - DNA, 20 bp, Mus musculus
gttcagagatgactgctctt

SEQ ID NO: 213535 - DNA, 23 bp, Mus musculus
gaggagtgtgaggagacaggcag

SEQ ID NO: 213536 - DNA, 18 bp, Mus musculus
cagtgcttggaatcactg

SEQ ID NO: 213537 - DNA, 22 bp, Mus musculus
atggtgctggagtggcagctgt

SEQ ID NO: 213538 - DNA, 23 bp, Mus musculus
aacttctgacatgttgaagattt

SEQ ID NO: 213539 - DNA, 23 bp, Mus musculus
atgactgtgttcctaggaggatg

SEQ ID NO: 213540 - DNA, 23 bp, Mus musculus
ttttctgcagagacactctcatt

SEQ ID NO: 213541 - DNA, 22 bp, Mus musculus
tttacagaacaaactgagcaga

SEQ ID NO: 213542 - DNA, 23 bp, Mus musculus
tgtgtgtctgtgtgtctgctggc

SEQ ID NO: 213543 - DNA, 23 bp, Mus musculus
ccataggttgtctctctgcttgc

SEQ ID NO: 213544 - DNA, 22 bp, Mus musculus
actgagagtcctttgtttgttg

SEQ ID NO: 213545 - DNA, 23 bp, Mus musculus
tgacatggaagtgtttagtactg

SEQ ID NO: 213546 - DNA, 23 bp, Mus musculus
tgagaggctctgtcagtgcctga

SEQ ID NO: 213547 - DNA, 23 bp, Mus musculus
tgtgtgtttaactctgtgcctgt

SEQ ID NO: 213548 - DNA, 23 bp, Mus musculus
tgtctgtatctgtctgagtcagc

SEQ ID NO: 213549 - DNA, 23 bp, Mus musculus
agaagacaacatgctcctgtctg

SEQ ID NO: 213550 - DNA, 23 bp, Mus musculus
cacagtctctctgcctctgtttg

SEQ ID NO: 213551 - DNA, 20 bp, Mus musculus
tgcctgcctgcctgcctctg

SEQ ID NO: 213552 - DNA, 23 bp, Mus musculus
aagtttcagcagcagcagcagat

SEQ ID NO: 213553 - DNA, 23 bp, Mus musculus
aatgcagtgtcaggaaggtcaaa

SEQ ID NO: 213554 - DNA, 23 bp, Mus musculus
cactctctctctcactgttctgc

SEQ ID NO: 213555 - DNA, 23 bp, Mus musculus
catgtgtgtgcatatatatacat

SEQ ID NO: 213556 - DNA, 23 bp, Mus musculus
gagaggacacagaggacagttgg

SEQ ID NO: 213557 - DNA, 23 bp, Mus musculus
tgttctctgtggctctgatggtg

SEQ ID NO: 213558 - DNA, 21 bp, Mus musculus
taacacatgttaatacatagt

SEQ ID NO: 213559 - DNA, 18 bp, Mus musculus
tatattaatatgtgttga

SEQ ID NO: 213560 - DNA, 23 bp, Mus musculus
caatgactcttcatgatgttcgt

SEQ ID NO: 213561 - DNA, 23 bp, Mus musculus
cacttgtgaatttcatgatgaca

SEQ ID NO: 213562 - DNA, 22 bp, Mus musculus
ttacctcacaaagacttgtgtg

SEQ ID NO: 213563 - DNA, 18 bp, Mus musculus
agacactgagcagtcacc

SEQ ID NO: 213564 - DNA, 22 bp, Mus musculus
gagttgtaatggggcagttgtt

SEQ ID NO: 213565 - DNA, 22 bp, Mus musculus
atagccattgagactccatgct

SEQ ID NO: 213566 - DNA, 23 bp, Mus musculus
gtgctctgtcacacaggctgtgt

SEQ ID NO: 213567 - DNA, 22 bp, Mus musculus
tttgtcagtggtgttacgtggt

SEQ ID NO: 213568 - DNA, 19 bp, Mus musculus
ttagcatgttccagggttt

SEQ ID NO: 213569 - DNA, 23 bp, Mus musculus
tgtcactgagtcactgagcagaa

SEQ ID NO: 213570 - DNA, 20 bp, Mus musculus
agcaggtggactttatttga

SEQ ID NO: 213571 - DNA, 19 bp, Mus musculus
attagggtttctattgctg

SEQ ID NO: 213572 - DNA, 21 bp, Mus musculus
ttaagagcactgactgctctt

SEQ ID NO: 213573 - DNA, 22 bp, Mus musculus
atgtatgtatgtatgtgtatat

SEQ ID NO: 213574 - DNA, 23 bp, Mus musculus
tctgctaaatggacagtatggag

SEQ ID NO: 213575 - DNA, 23 bp, Mus musculus
gtgcaggtctctctgtctctgac

SEQ ID NO: 213576 - DNA, 23 bp, Mus musculus
atctctctgtgcaatcttgactg

SEQ ID NO: 213577 - DNA, 21 bp, Mus musculus
ttcagagaaggaacagagcac

SEQ ID NO: 213578 - DNA, 19 bp, Mus musculus
tacagtggccagtgagcac

SEQ ID NO: 213579 - DNA, 23 bp, Mus musculus
tacagtggtcagtgagcacagtg

SEQ ID NO: 213580 - DNA, 23 bp, Mus musculus
tcccaggcaggctaacatttatg

SEQ ID NO: 213581 - DNA, 20 bp, Mus musculus
gtcactgtctctgcctgcat

SEQ ID NO: 213582 - DNA, 20 bp, Mus musculus
tgtagacgtcacacagctga

SEQ ID NO: 213583 - DNA, 23 bp, Mus musculus
tgaggcactggttagctttttgt

SEQ ID NO: 213584 - DNA, 23 bp, Mus musculus
cttgacagaagctagagttctct

SEQ ID NO: 213585 - DNA, 23 bp, Mus musculus
ctgactgctcttccagagttcct

SEQ ID NO: 213586 - DNA, 23 bp, Mus musculus
tggcagtcctagaactcactgtg

SEQ ID NO: 213587 - DNA, 20 bp, Mus musculus
gagtgtcactggggttggct

SEQ ID NO: 213588 - DNA, 21 bp, Mus musculus
tgtgtgtttatgtatatgtat

SEQ ID NO: 213589 - DNA, 22 bp, Mus musculus
atatgattagttcatattgtgg

SEQ ID NO: 213590 - DNA, 21 bp, Mus musculus
tactcagtttagccagctggt

SEQ ID NO: 213591 - DNA, 23 bp, Mus musculus
atctagctagtttagaatagttg

SEQ ID NO: 213592 - DNA, 23 bp, Mus musculus
ctctctctgtcagtctgccttgg

SEQ ID NO: 213593 - DNA, 23 bp, Mus musculus
gtcttcaagtgtttctctcagtc

SEQ ID NO: 213594 - DNA, 23 bp, Mus musculus
cataactactctcatgtctgtgc

SEQ ID NO: 213595 - DNA, 22 bp, Mus musculus
tctagagagaggaaatgtaggg

SEQ ID NO: 213596 - DNA, 21 bp, Mus musculus
tcagtgggtgagaagtagggg

SEQ ID NO: 213597 - DNA, 23 bp, Mus musculus
tgctgcatgaagaactgagttat

SEQ ID NO: 213598 - DNA, 23 bp, Mus musculus
ctgattggctatgttgacaggta

SEQ ID NO: 213599 - DNA, 23 bp, Mus musculus
tcttgtcactgtctccctgtcag

SEQ ID NO: 213600 - DNA, 23 bp, Mus musculus
aggctctgtctcagtctcttggg

SEQ ID NO: 213601 - DNA, 21 bp, Mus musculus
atgagcatagagtttgtgttt

SEQ ID NO: 213602 - DNA, 22 bp, Mus musculus
ttccagtgatgtgactgcccta

SEQ ID NO: 213603 - DNA, 21 bp, Mus musculus
tgtctgtctgtctgtctggag

SEQ ID NO: 213604 - DNA, 19 bp, Mus musculus
aggagagagctagtgcaga

SEQ ID NO: 213605 - DNA, 18 bp, Mus musculus
tccctttggctagctttg

SEQ ID NO: 213606 - DNA, 23 bp, Mus musculus
tattcctgcctttgaggtctgtg

SEQ ID NO: 213607 - DNA, 23 bp, Mus musculus
gtatgtgtgcaggcatgtgtgtt

SEQ ID NO: 213608 - DNA, 21 bp, Mus musculus
ctgtgtgtctctctgacagtt

SEQ ID NO: 213609 - DNA, 23 bp, Mus musculus
cctcatgtaatgtctgggacatt

SEQ ID NO: 213610 - DNA, 23 bp, Mus musculus
tggtactctccctctcacagagg

SEQ ID NO: 213611 - DNA, 23 bp, Mus musculus
tgtccctgtgactgggcctgtca

SEQ ID NO: 213612 - DNA, 23 bp, Mus musculus
tgtctctgtcactgtttatcttc

SEQ ID NO: 213613 - DNA, 23 bp, Mus musculus
cttctgaatctctgtgtgtcttg

SEQ ID NO: 213614 - DNA, 23 bp, Mus musculus
tcctactgcatctctttcagagt

SEQ ID NO: 213615 - DNA, 23 bp, Mus musculus
agagtctcattctctcactatac

SEQ ID NO: 213616 - DNA, 22 bp, Mus musculus
cataggacttgtgaccctccta

SEQ ID NO: 213617 - DNA, 21 bp, Mus musculus
tttacacagcaaaacatctca

SEQ ID NO: 213618 - DNA, 23 bp, Mus musculus
aaaagacaccatgaccaaagcaa

SEQ ID NO: 213619 - DNA, 22 bp, Mus musculus
tgtctgtatatgtatatgtgtg

SEQ ID NO: 213620 - DNA, 22 bp, Mus musculus
agactagactaaggctgtgcct

SEQ ID NO: 213621 - DNA, 22 bp, Mus musculus
caggttaacagaacttagttac

SEQ ID NO: 213622 - DNA, 20 bp, Mus musculus
acacacagacacatatgtgc

SEQ ID NO: 213623 - DNA, 21 bp, Mus musculus
tctctctccgtgttcacagcg

SEQ ID NO: 213624 - DNA, 23 bp, Mus musculus
taaggcacgcggtgaatgccaag

SEQ ID NO: 213625 - DNA, 18 bp, Mus musculus
tggggctgtctgagcacc

SEQ ID NO: 213626 - DNA, 20 bp, Mus musculus
ttaagagcactcactgctct

SEQ ID NO: 213627 - DNA, 18 bp, Mus musculus
agcttggagcctagactc

SEQ ID NO: 213628 - DNA, 23 bp, Mus musculus
agtgagtgtgtctgtctcaggtt

SEQ ID NO: 213629 - DNA, 18 bp, Mus musculus
ttggtcttggttatgatt

SEQ ID NO: 213630 - DNA, 23 bp, Mus musculus
tgctgggtgtgtctgtgcctctg

SEQ ID NO: 213631 - DNA, 23 bp, Mus musculus
tgcatctcactcgctttcctctg

SEQ ID NO: 213632 - DNA, 23 bp, Mus musculus
aggctacagatttggtttgtttt

SEQ ID NO: 213633 - DNA, 19 bp, Mus musculus
ttaaagaagatagctcaag

SEQ ID NO: 213634 - DNA, 23 bp, Mus musculus
actgactgttcttccagaggtcc

SEQ ID NO: 213635 - DNA, 20 bp, Mus musculus
gtatacatgcatgtgtgtat

SEQ ID NO: 213636 - DNA, 23 bp, Mus musculus
gtatgcatgtatgtaaatgtgta

SEQ ID NO: 213637 - DNA, 23 bp, Mus musculus
tctgtatatgtatgtacatatgt

SEQ ID NO: 213638 - DNA, 19 bp, Mus musculus
aaatcttggctttctctgt

SEQ ID NO: 213639 - DNA, 19 bp, Mus musculus
tcacactctgcctgtgcag

SEQ ID NO: 213640 - DNA, 23 bp, Mus musculus
tctcactctgcttgatcagagtg

SEQ ID NO: 213641 - DNA, 23 bp, Mus musculus
ctcacactctgcctgtgcaactg

SEQ ID NO: 213642 - DNA, 22 bp, Mus musculus
gtctcacactctgcctgagcag

SEQ ID NO: 213643 - DNA, 23 bp, Mus musculus
tgtctcacactctgcctgagcag

SEQ ID NO: 213644 - DNA, 23 bp, Mus musculus
cgtctcacactctgcctgagcag

SEQ ID NO: 213645 - DNA, 23 bp, Mus musculus
tgtctctcactctgcctgtgcag

SEQ ID NO: 213646 - DNA, 22 bp, Mus musculus
tgtctcacactttgcctgagca

SEQ ID NO: 213647 - DNA, 23 bp, Mus musculus
tgtctctcactctgcctgtgcag

SEQ ID NO: 213648 - DNA, 23 bp, Mus musculus
tctgcctgtacaactgtaagtta

SEQ ID NO: 213649 - DNA, 18 bp, Mus musculus
cagtctgcctgtgcactg

SEQ ID NO: 213650 - DNA, 23 bp, Mus musculus
tttgtttcacagtctgcctgtgc

SEQ ID NO: 213651 - DNA, 22 bp, Mus musculus
gtctcacactctgcctgaacag

SEQ ID NO: 213652 - DNA, 23 bp, Mus musculus
tcacactctgcatgtgcaggtgt

SEQ ID NO: 213653 - DNA, 23 bp, Mus musculus
tctcacattctgtacaagtcgga

SEQ ID NO: 213654 - DNA, 23 bp, Mus musculus
tctcacactctgcctgagcagag

SEQ ID NO: 213655 - DNA, 23 bp, Mus musculus
gtctcacactctgcctgagcaga

SEQ ID NO: 213656 - DNA, 21 bp, Mus musculus
tgtctcacactctgcctaagc

SEQ ID NO: 213657 - DNA, 22 bp, Mus musculus
tgtttcatactctgcctgagca

SEQ ID NO: 213658 - DNA, 23 bp, Mus musculus
tctgcttgagcaggagtaagtta

SEQ ID NO: 213659 - DNA, 23 bp, Mus musculus
tgtctcacactctgcctgagcag

SEQ ID NO: 213660 - DNA, 23 bp, Mus musculus
tgtctcacactctgcctgagcag

SEQ ID NO: 213661 - DNA, 23 bp, Mus musculus
gttttctcacactctgcctgagc

SEQ ID NO: 213662 - DNA, 19 bp, Mus musculus
gtctcatactctgcctgtg

SEQ ID NO: 213663 - DNA, 18 bp, Mus musculus
tgtatacatgtgtgtatg

SEQ ID NO: 213664 - DNA, 20 bp, Mus musculus
tgtgtctgtctgtgcctgtg

SEQ ID NO: 213665 - DNA, 22 bp, Mus musculus
tgacaaggagaggctcttttct

SEQ ID NO: 213666 - DNA, 19 bp, Mus musculus
tggacttcactatgtagcc

SEQ ID NO: 213667 - DNA, 20 bp, Mus musculus
tggctcagtggataagagca

SEQ ID NO: 213668 - DNA, 22 bp, Mus musculus
ggaggagacagtctccctctct

SEQ ID NO: 213669 - DNA, 22 bp, Mus musculus
tatatgtgtatatatgtgtgtg

SEQ ID NO: 213670 - DNA, 20 bp, Mus musculus
aagggtctttattatgatct

SEQ ID NO: 213671 - DNA, 19 bp, Mus musculus
agagtcactgtgtttcagg

SEQ ID NO: 213672 - DNA, 21 bp, Mus musculus
tgtgtatatatatatgtgtgt

SEQ ID NO: 213673 - DNA, 23 bp, Mus musculus
atctcagtggtagaacttagtgg

SEQ ID NO: 213674 - DNA, 22 bp, Mus musculus
ggaaaatgccaagttgtacatg

SEQ ID NO: 213675 - DNA, 20 bp, Mus musculus
gtctgtgacagtgtgtgagc

SEQ ID NO: 213676 - DNA, 18 bp, Mus musculus
atatgtgtatgtatatat

SEQ ID NO: 213677 - DNA, 23 bp, Mus musculus
ttaattcttcttcatgaaaagct

SEQ ID NO: 213678 - DNA, 22 bp, Mus musculus
agaggaagagtctttatgtggt

SEQ ID NO: 213679 - DNA, 19 bp, Mus musculus
cttgtgtgcacaagtgtgt

SEQ ID NO: 213680 - DNA, 23 bp, Mus musculus
caggatctctctccctgacctct

SEQ ID NO: 213681 - DNA, 23 bp, Mus musculus
tgtctctgactctgtctctgtct

SEQ ID NO: 213682 - DNA, 20 bp, Mus musculus
atgtgtatatatatgtatgt

SEQ ID NO: 213683 - DNA, 21 bp, Mus musculus
tatctctacctccgtatctgt

SEQ ID NO: 213684 - DNA, 23 bp, Mus musculus
tccctgtctctgtctcttaatcc

SEQ ID NO: 213685 - DNA, 19 bp, Mus musculus
tcatgggttatgatggact

SEQ ID NO: 213686 - DNA, 18 bp, Mus musculus
ctaaggtttgttctctgt

SEQ ID NO: 213687 - DNA, 23 bp, Mus musculus
tctgtctgtctgtctgtctcact

SEQ ID NO: 213688 - DNA, 21 bp, Mus musculus
atttctttgattataaaaagc

SEQ ID NO: 213689 - DNA, 23 bp, Mus musculus
tatgtctagttctatatgttttt

SEQ ID NO: 213690 - DNA, 23 bp, Mus musculus
agaaggagcagaggctgtctctg

SEQ ID NO: 213691 - DNA, 23 bp, Mus musculus
gacaggagtcagtctcctgcctt

SEQ ID NO: 213692 - DNA, 23 bp, Mus musculus
tccatgtgtgtatatgatcatgt

SEQ ID NO: 213693 - DNA, 21 bp, Mus musculus
agtccatttcttcacccagtc

SEQ ID NO: 213694 - DNA, 22 bp, Mus musculus
gactcagtgaagtggctgaggt

SEQ ID NO: 213695 - DNA, 23 bp, Mus musculus
tgtgtctgtgtctgtgcctgtgc

SEQ ID NO: 213696 - DNA, 23 bp, Mus musculus
tgacagaacagtgagaaatctct

SEQ ID NO: 213697 - DNA, 23 bp, Mus musculus
agagacaaggcagaaggcagaga

SEQ ID NO: 213698 - DNA, 22 bp, Mus musculus
tggaattgccactggaagtcct

SEQ ID NO: 213699 - DNA, 23 bp, Mus musculus
tcggtccctctgtctgtcatggc

SEQ ID NO: 213700 - DNA, 23 bp, Mus musculus
actgactgctcttccagaggtcc

SEQ ID NO: 213701 - DNA, 23 bp, Mus musculus
tgtatgtacatgtgcatgtgtgt

SEQ ID NO: 213702 - DNA, 23 bp, Mus musculus
ggctgtgtcactgagtgacagag

SEQ ID NO: 213703 - DNA, 23 bp, Mus musculus
tacaaccatctgtaatgggacct

SEQ ID NO: 213704 - DNA, 22 bp, Mus musculus
tgtctgaagacagagatgatgt

SEQ ID NO: 213705 - DNA, 23 bp, Mus musculus
ctgcctgtctctgtctctctggt

SEQ ID NO: 213706 - DNA, 20 bp, Mus musculus
catgccactcagagaggatg

SEQ ID NO: 213707 - DNA, 23 bp, Mus musculus
ctgactcccacactcacaccctc

SEQ ID NO: 213708 - DNA, 23 bp, Mus musculus
tgatatgataggatatgatatga

SEQ ID NO: 213709 - DNA, 23 bp, Mus musculus
gttggagagtgaggagagacagg

SEQ ID NO: 213710 - DNA, 22 bp, Mus musculus
atcttgcatttgtaaactgtgt

SEQ ID NO: 213711 - DNA, 20 bp, Mus musculus
tgtgcctgtacatactatgt

SEQ ID NO: 213712 - DNA, 23 bp, Mus musculus
ttatatgtagtatatgtgtatga

SEQ ID NO: 213713 - DNA, 20 bp, Mus musculus
gccaccaggcttgttagggc

SEQ ID NO: 213714 - DNA, 22 bp, Mus musculus
agagtccctttgttttgctttg

SEQ ID NO: 213715 - DNA, 23 bp, Mus musculus
catgagatttgtgattcagtgga

SEQ ID NO: 213716 - DNA, 18 bp, Mus musculus
tgcttctatattgagtgg

SEQ ID NO: 213717 - DNA, 21 bp, Mus musculus
ctgaatgtagaaagagacctc

SEQ ID NO: 213718 - DNA, 23 bp, Mus musculus
tggctctcacagtctttcagttc

SEQ ID NO: 213719 - DNA, 22 bp, Mus musculus
tgttttgtgaccaattatatgg

SEQ ID NO: 213720 - DNA, 23 bp, Mus musculus
cagtgagctctgaagtctgtctg

SEQ ID NO: 213721 - DNA, 19 bp, Mus musculus
cagtgtctctcactgaggc

SEQ ID NO: 213722 - DNA, 22 bp, Mus musculus
tgttttgtgaccaattatatgg

SEQ ID NO: 213723 - DNA, 22 bp, Mus musculus
tgttttgtgaccaattatatgg

SEQ ID NO: 213724 - DNA, 19 bp, Mus musculus
tagtagtttctcatttagt

SEQ ID NO: 213725 - DNA, 22 bp, Mus musculus
aagactgaagagtctctggagt

SEQ ID NO: 213726 - DNA, 23 bp, Mus musculus
tatgtgtgtatatatatgtgtgt

SEQ ID NO: 213727 - DNA, 18 bp, Mus musculus
aaggtcaggagctggaga

SEQ ID NO: 213728 - DNA, 23 bp, Mus musculus
tctcaagctcactgtcattcttg

SEQ ID NO: 213729 - DNA, 18 bp, Mus musculus
tgtgtgtgtcatatatat

SEQ ID NO: 213730 - DNA, 22 bp, Mus musculus
tcaatgaagatagagtcctcca

SEQ ID NO: 213731 - DNA, 23 bp, Mus musculus
tgacagactctctgtgcctgagc

SEQ ID NO: 213732 - DNA, 23 bp, Mus musculus
atacacacacatatacttatgta

SEQ ID NO: 213733 - DNA, 23 bp, Mus musculus
tgtgtgaagtcagtgaggagaag

SEQ ID NO: 213734 - DNA, 22 bp, Mus musculus
tgtctgtgaactcatgtgtcag

SEQ ID NO: 213735 - DNA, 22 bp, Mus musculus
agtgagccatgtgtgtcagtct

SEQ ID NO: 213736 - DNA, 23 bp, Mus musculus
aacacctctctctgtgactctgg

SEQ ID NO: 213737 - DNA, 23 bp, Mus musculus
agtagagggtgcatgtgagctgt

SEQ ID NO: 213738 - DNA, 22 bp, Mus musculus
actgacactctccttctctctg

SEQ ID NO: 213739 - DNA, 20 bp, Mus musculus
atgtgtatatatatatatgt

SEQ ID NO: 213740 - DNA, 19 bp, Mus musculus
tgcatttatgtatgtatgt

SEQ ID NO: 213741 - DNA, 19 bp, Mus musculus
ttgcagattttctagttct

SEQ ID NO: 213742 - DNA, 20 bp, Mus musculus
tggctccctctctactctgt

SEQ ID NO: 213743 - DNA, 23 bp, Mus musculus
aaactgtattctaaaaatgtctg

SEQ ID NO: 213744 - DNA, 23 bp, Mus musculus
gtcatgctctctctctctcagat

SEQ ID NO: 213745 - DNA, 23 bp, Mus musculus
tcaccctgtcaccctgtcacctg

SEQ ID NO: 213746 - DNA, 23 bp, Mus musculus
ctatgtctgtgtctatgtctgtg

SEQ ID NO: 213747 - DNA, 23 bp, Mus musculus
ctgtgtctgtgtctgtgtgtgca

SEQ ID NO: 213748 - DNA, 19 bp, Mus musculus
agaggacagtctcaggtgt

SEQ ID NO: 213749 - DNA, 23 bp, Mus musculus
agtccctgtctcactctttgcca

SEQ ID NO: 213750 - DNA, 23 bp, Mus musculus
actgaaggtgcttaggtgaagaa

SEQ ID NO: 213751 - DNA, 18 bp, Mus musculus
tggagtagatttctgggt

SEQ ID NO: 213752 - DNA, 23 bp, Mus musculus
tgtctgtctgtgtctgtctgtct

SEQ ID NO: 213753 - DNA, 23 bp, Mus musculus
cagaggctcacactgtgccactt

SEQ ID NO: 213754 - DNA, 18 bp, Mus musculus
acacatgtatatatgtgt

SEQ ID NO: 213755 - DNA, 23 bp, Mus musculus
tctggctctgtgacagggaaaga

SEQ ID NO: 213756 - DNA, 23 bp, Mus musculus
taagagcactgactgctcttcca

SEQ ID NO: 213757 - DNA, 22 bp, Mus musculus
tagtcagtggctcactggaggg

SEQ ID NO: 213758 - DNA, 23 bp, Mus musculus
gctgtgactgatcttgtttgttt

SEQ ID NO: 213759 - DNA, 21 bp, Mus musculus
gggtcccactctgtcgctctg

SEQ ID NO: 213760 - DNA, 22 bp, Mus musculus
atcggtgtacttcaccagctaa

SEQ ID NO: 213761 - DNA, 23 bp, Mus musculus
cctctcactgataacagctgtga

SEQ ID NO: 213762 - DNA, 21 bp, Mus musculus
aattgcatgggaagaaatcag

SEQ ID NO: 213763 - DNA, 23 bp, Mus musculus
tgtatatgtatatatacgtatgt

SEQ ID NO: 213764 - DNA, 21 bp, Mus musculus
tatatgtatatgtatatatgt

SEQ ID NO: 213765 - DNA, 23 bp, Mus musculus
atgtatatgatgtatacatgtat

SEQ ID NO: 213766 - DNA, 20 bp, Mus musculus
tatgtgtatatatatgtatg

SEQ ID NO: 213767 - DNA, 22 bp, Mus musculus
ggttctgacaggaatgcttcag

SEQ ID NO: 213768 - DNA, 23 bp, Mus musculus
tgtgttcagagaagactgtctgc

SEQ ID NO: 213769 - DNA, 22 bp, Mus musculus
tgttttgtgaccaattatatgg

SEQ ID NO: 213770 - DNA, 23 bp, Mus musculus
tgcatgtatgtttatgtatatat

SEQ ID NO: 213771 - DNA, 23 bp, Mus musculus
tatgcatgtatatatgtatatgt

SEQ ID NO: 213772 - DNA, 23 bp, Mus musculus
taatgtgtgtatatatgtgtgtg

SEQ ID NO: 213773 - DNA, 23 bp, Mus musculus
agactgactcttcctctctcagc

SEQ ID NO: 213774 - DNA, 23 bp, Mus musculus
tgtgtgtgtgcatgtgcatgtgc

SEQ ID NO: 213775 - DNA, 23 bp, Mus musculus
gtgtgtgtatgtgaatatgtgtg

SEQ ID NO: 213776 - DNA, 22 bp, Mus musculus
atgtatgtgtgcatgtgtgtgt

SEQ ID NO: 213777 - DNA, 23 bp, Mus musculus
atgtatgtgtgcatgtgtatgtg

SEQ ID NO: 213778 - DNA, 22 bp, Mus musculus
tgtgtatatatgtatatatgta

SEQ ID NO: 213779 - DNA, 22 bp, Mus musculus
atgtatatgtgtgtgtatatat

SEQ ID NO: 213780 - DNA, 23 bp, Mus musculus
atacacacacacatatatatgta

SEQ ID NO: 213781 - DNA, 23 bp, Mus musculus
tcaatctgtgtgtcacagtcccc

SEQ ID NO: 213782 - DNA, 23 bp, Mus musculus
tctctctatttgtctgtctgtct

SEQ ID NO: 213783 - DNA, 23 bp, Mus musculus
aggactgtatagaagaaagtgct

SEQ ID NO: 213784 - DNA, 23 bp, Mus musculus
tatgtcactgtctctctcactct

SEQ ID NO: 213785 - DNA, 23 bp, Mus musculus
tgtatctatatatatgtgtgtgt

SEQ ID NO: 213786 - DNA, 19 bp, Mus musculus
tatgtatatgtatacatat

SEQ ID NO: 213787 - DNA, 20 bp, Mus musculus
tcagagacctgagagtccag

SEQ ID NO: 213788 - DNA, 22 bp, Mus musculus
cttctcagtcagtctcactgcg

SEQ ID NO: 213789 - DNA, 23 bp, Mus musculus
tgtcactgaggtgggctttgggg

SEQ ID NO: 213790 - DNA, 21 bp, Mus musculus
tcagagatgacagttagctca

SEQ ID NO: 213791 - DNA, 21 bp, Mus musculus
tgtgtgtatatatatatgtgt

SEQ ID NO: 213792 - DNA, 23 bp, Mus musculus
atgcatatacatatgtatgtgta

SEQ ID NO: 213793 - DNA, 23 bp, Mus musculus
tatatgcatatacatatgtgtat

SEQ ID NO: 213794 - DNA, 23 bp, Mus musculus
tgtctgtctgtctctgtgtgtga

SEQ ID NO: 213795 - DNA, 23 bp, Mus musculus
tgtatgtatgtatgcatgtgagt

SEQ ID NO: 213796 - DNA, 22 bp, Mus musculus
tgaattccttgtaaatttttct

SEQ ID NO: 213797 - DNA, 23 bp, Mus musculus
gtggcaggatatctgatccttga

SEQ ID NO: 213798 - DNA, 23 bp, Mus musculus
aaatctctgagtctctctgagcc

SEQ ID NO: 213799 - DNA, 22 bp, Mus musculus
tgttttgtgaccaattatatgg

SEQ ID NO: 213800 - DNA, 21 bp, Mus musculus
tgtgtgtgtgcatgtgggtgc

SEQ ID NO: 213801 - DNA, 20 bp, Mus musculus
tgtgggtaactaactgcatg

SEQ ID NO: 213802 - DNA, 23 bp, Mus musculus
atcaggaagaagagctggaaaga

SEQ ID NO: 213803 - DNA, 23 bp, Mus musculus
tctctctctgggtataacatggc

SEQ ID NO: 213804 - DNA, 23 bp, Mus musculus
tgaatctttctacatattggtgt

SEQ ID NO: 213805 - DNA, 20 bp, Mus musculus
tcacagggagaacaagtgga

SEQ ID NO: 213806 - DNA, 23 bp, Mus musculus
tgatagtgagcagacatggaagt

SEQ ID NO: 213807 - DNA, 23 bp, Mus musculus
gtctgaagtggaagtcctgtact

SEQ ID NO: 213808 - DNA, 23 bp, Mus musculus
agaacagcagagaaacgagtcag

SEQ ID NO: 213809 - DNA, 20 bp, Mus musculus
ttcttagttcttacagagct

SEQ ID NO: 213810 - DNA, 18 bp, Mus musculus
cagaacttgccattctga

SEQ ID NO: 213811 - DNA, 19 bp, Mus musculus
tctaggtgtctctctgtgt

SEQ ID NO: 213812 - DNA, 23 bp, Mus musculus
tttacagttagaggtttccatat

SEQ ID NO: 213813 - DNA, 18 bp, Mus musculus
ccttgactctgtccctgt

SEQ ID NO: 213814 - DNA, 23 bp, Mus musculus
aggactctgtcaaagctgtgata

SEQ ID NO: 213815 - DNA, 21 bp, Mus musculus
tatgtgtgtgcaatgtgtgtg

SEQ ID NO: 213816 - DNA, 23 bp, Mus musculus
agtgtcagtagaaacctgatctt

SEQ ID NO: 213817 - DNA, 23 bp, Mus musculus
agacactgtagagagaagctgtt

SEQ ID NO: 213818 - DNA, 21 bp, Mus musculus
aatttgcttttctacgtcttc

SEQ ID NO: 213819 - DNA, 23 bp, Mus musculus
atgtgtatctgtgcatgtttatg

SEQ ID NO: 213820 - DNA, 19 bp, Mus musculus
tgtgcatatatatgcatct

SEQ ID NO: 213821 - DNA, 23 bp, Mus musculus
cctgtgtccctgtgactctggtt

SEQ ID NO: 213822 - DNA, 21 bp, Mus musculus
tattaccttgtgaatgtatgt

SEQ ID NO: 213823 - DNA, 23 bp, Mus musculus
tcagtagtgactgagctggcaag

SEQ ID NO: 213824 - DNA, 23 bp, Mus musculus
tagtccatggtgatctgatagga

SEQ ID NO: 213825 - DNA, 23 bp, Mus musculus
aaacagacatatacatgtggatg

SEQ ID NO: 213826 - DNA, 23 bp, Mus musculus
atgtatgtatgtatgtatgtatg

SEQ ID NO: 213827 - DNA, 23 bp, Mus musculus
agttctctgcctgtcttcagagg

SEQ ID NO: 213828 - DNA, 23 bp, Mus musculus
aattttcacagctatagtttgta

SEQ ID NO: 213829 - DNA, 22 bp, Mus musculus
tgttttgtgaccaattatatgg

SEQ ID NO: 213830 - DNA, 23 bp, Mus musculus
ctcatttgtctttctgtgtggga

SEQ ID NO: 213831 - DNA, 23 bp, Mus musculus
gtatgagaatgcaaattgatcca

SEQ ID NO: 213832 - DNA, 23 bp, Mus musculus
gcctcagtggctctgtggctccc

SEQ ID NO: 213833 - DNA, 19 bp, Mus musculus
attcagatgaggtaatgct

SEQ ID NO: 213834 - DNA, 19 bp, Mus musculus
agcatttatttcctgaaat

SEQ ID NO: 213835 - DNA, 23 bp, Mus musculus
tgctcactgagtctctgggtctc

SEQ ID NO: 213836 - DNA, 18 bp, Mus musculus
tcatattcatatgcatgc

SEQ ID NO: 213837 - DNA, 20 bp, Mus musculus
tgtgtgtgaatgtatacata

SEQ ID NO: 213838 - DNA, 23 bp, Mus musculus
tttatatctatatgaatacataa

SEQ ID NO: 213839 - DNA, 23 bp, Mus musculus
tatatatgtatatgtatgtgtat

SEQ ID NO: 213840 - DNA, 23 bp, Mus musculus
tgtgtgtgtgtgtgtgtagctgt

SEQ ID NO: 213841 - DNA, 21 bp, Mus musculus
gagacagagacagacagagag

SEQ ID NO: 213842 - DNA, 22 bp, Mus musculus
tgttttgtgaccaattatatgg

SEQ ID NO: 213843 - DNA, 23 bp, Mus musculus
tatatgtatatgtgtatgtgtat

SEQ ID NO: 213844 - DNA, 20 bp, Mus musculus
gtgtgtatatatatatgtgt

SEQ ID NO: 213845 - DNA, 23 bp, Mus musculus
tgtgtatatgtatatattcataa

SEQ ID NO: 213846 - DNA, 23 bp, Mus musculus
gaatgtgcaacatgagaactgtg

SEQ ID NO: 213847 - DNA, 23 bp, Mus musculus
agagtgtctacagtctctcaatt

SEQ ID NO: 213848 - DNA, 23 bp, Mus musculus
atgtatgtatgtatgtatgtatg

SEQ ID NO: 213849 - DNA, 23 bp, Mus musculus
atgtgtgtatgcatatgtatata

SEQ ID NO: 213850 - DNA, 22 bp, Mus musculus
tatatatgtatatatgtgtgtg

SEQ ID NO: 213851 - DNA, 23 bp, Mus musculus
gaggacttcctgaaacacagact

SEQ ID NO: 213852 - DNA, 19 bp, Mus musculus
gagtgaagattctgtgcag

SEQ ID NO: 213853 - DNA, 22 bp, Mus musculus
tgttttgtgaccaattatatgg

SEQ ID NO: 213854 - DNA, 21 bp, Mus musculus
agatgcttaatgtaactgtat

SEQ ID NO: 213855 - DNA, 23 bp, Mus musculus
tgtgtgtgtgtatatatatgtgt

SEQ ID NO: 213856 - DNA, 23 bp, Mus musculus
atgtatgtatgtgtatgtgtgtg

SEQ ID NO: 213857 - DNA, 22 bp, Mus musculus
acattgaatagatagggagaga

SEQ ID NO: 213858 - DNA, 21 bp, Mus musculus
tctctccatttaatttgatgt

SEQ ID NO: 213859 - DNA, 23 bp, Mus musculus
aagctgtatgcacataaaggttt

SEQ ID NO: 213860 - DNA, 23 bp, Mus musculus
tactgactgctcttccagaggac

SEQ ID NO: 213861 - DNA, 18 bp, Mus musculus
tccatttaattccactta

SEQ ID NO: 213862 - DNA, 23 bp, Mus musculus
atattgagtgcttaagttatcat

SEQ ID NO: 213863 - DNA, 22 bp, Mus musculus
tagagttgagatatagatgttc

SEQ ID NO: 213864 - DNA, 23 bp, Mus musculus
ccagtctgtctgtgacactccca

SEQ ID NO: 213865 - DNA, 23 bp, Mus musculus
aatatcgagcacattctctaggt

SEQ ID NO: 213866 - DNA, 23 bp, Mus musculus
actacagtgagtgctctctctgc

SEQ ID NO: 213867 - DNA, 22 bp, Mus musculus
attgcctccatcagattggcct

SEQ ID NO: 213868 - DNA, 20 bp, Mus musculus
agtctgtgaaagtattttct

SEQ ID NO: 213869 - DNA, 23 bp, Mus musculus
ctgtctctctctctcactcttac

SEQ ID NO: 213870 - DNA, 22 bp, Mus musculus
tgttttgtgaccaattatatgg

SEQ ID NO: 213871 - DNA, 22 bp, Mus musculus
tgttttgtgaccaattatatgg

SEQ ID NO: 213872 - DNA, 23 bp, Mus musculus
ctccattcactgctgtctactct

SEQ ID NO: 213873 - DNA, 21 bp, Mus musculus
agagagcatcgaaaaagagtg

SEQ ID NO: 213874 - DNA, 22 bp, Mus musculus
tgttttgtgaccaattatatgg

SEQ ID NO: 213875 - DNA, 22 bp, Mus musculus
tgttttgtgaccaattatatgg

SEQ ID NO: 213876 - DNA, 23 bp, Mus musculus
agtacctgtgtctgtctcagtca

SEQ ID NO: 213877 - DNA, 20 bp, Mus musculus
tagtttgtatgcaattgcat

SEQ ID NO: 213878 - DNA, 23 bp, Mus musculus
tctttgacagtctgcaaactatg

SEQ ID NO: 213879 - DNA, 22 bp, Mus musculus
tgttttgtgaccaattatatgg

SEQ ID NO: 213880 - DNA, 21 bp, Mus musculus
tccatggtggtctgataggat

SEQ ID NO: 213881 - DNA, 22 bp, Mus musculus
tgagatcaaacacaaagcctta

SEQ ID NO: 213882 - DNA, 19 bp, Mus musculus
attgatctccatgttattt

SEQ ID NO: 213883 - DNA, 18 bp, Mus musculus
ggtaagagtcataggagt

SEQ ID NO: 213884 - DNA, 22 bp, Mus musculus
atatgactaaagcttatcagtg

SEQ ID NO: 213885 - DNA, 23 bp, Mus musculus
actatcactgattctatgatgta

SEQ ID NO: 213886 - DNA, 22 bp, Mus musculus
atgaaagtagaaagagagcagc

SEQ ID NO: 213887 - DNA, 23 bp, Mus musculus
ttactgtgctgggatgtgaagca

SEQ ID NO: 213888 - DNA, 23 bp, Mus musculus
ttacagtagtgagacaggactag

SEQ ID NO: 213889 - DNA, 23 bp, Mus musculus
tattacactcatgtattcatgta

SEQ ID NO: 213890 - DNA, 22 bp, Mus musculus
tgttttgtgaccaattatatgg

SEQ ID NO: 213891 - DNA, 20 bp, Mus musculus
accttctgagttatcttgtt

SEQ ID NO: 213892 - DNA, 23 bp, Mus musculus
tgtgaggctctgtcagtgcctga

SEQ ID NO: 213893 - DNA, 23 bp, Mus musculus
tcagtttctcactgaattgttcg

SEQ ID NO: 213894 - DNA, 20 bp, Mus musculus
gtttacatacatatgtgtgt

SEQ ID NO: 213895 - DNA, 23 bp, Mus musculus
ttacagaatgcacatgtgtaagt

SEQ ID NO: 213896 - DNA, 23 bp, Mus musculus
ctacctgtctgtcactgtatcag

SEQ ID NO: 213897 - DNA, 23 bp, Mus musculus
tctgtagtacagcttgaggtcag

SEQ ID NO: 213898 - DNA, 18 bp, Mus musculus
aagtgtttttgtagtaca

SEQ ID NO: 213899 - DNA, 21 bp, Mus musculus
tccatggtgatctgataggat

SEQ ID NO: 213900 - DNA, 23 bp, Mus musculus
gtatatgtgtgtatgtgtatatg

SEQ ID NO: 213901 - DNA, 23 bp, Mus musculus
ttgtacatatatgtgtgtgtgtg

SEQ ID NO: 213902 - DNA, 22 bp, Mus musculus
tgttttgtgaccaattatatgg

SEQ ID NO: 213903 - DNA, 23 bp, Mus musculus
gtgattttgaagttgtggtgcag

SEQ ID NO: 213904 - DNA, 22 bp, Mus musculus
aagcatgtatttatttgtgttt

SEQ ID NO: 213905 - DNA, 22 bp, Mus musculus
tgttttgtgaccaattatatgg

SEQ ID NO: 213906 - DNA, 22 bp, Mus musculus
tgtgaagttggagtttcctaga

SEQ ID NO: 213907 - DNA, 23 bp, Mus musculus
tctacttcctacttaactcaaac

SEQ ID NO: 213908 - DNA, 19 bp, Mus musculus
agtatgtatgaatgtatgt

SEQ ID NO: 213909 - DNA, 22 bp, Mus musculus
tgttttgtgaccaattatatgg

SEQ ID NO: 213910 - DNA, 23 bp, Mus musculus
aggtgtgtcactgtgtgtgtggg

SEQ ID NO: 213911 - DNA, 23 bp, Mus musculus
tgtgtgtatgaatgtatatatgt

SEQ ID NO: 213912 - DNA, 21 bp, Mus musculus
tgatgtactagctagttttgt

SEQ ID NO: 213913 - DNA, 21 bp, Mus musculus
cttgacacagctggagttatc

SEQ ID NO: 213914 - DNA, 18 bp, Mus musculus
atgtgtgtgtgtgtatat

SEQ ID NO: 213915 - DNA, 23 bp, Mus musculus
tacatgcttctattgtacgtact

SEQ ID NO: 213916 - DNA, 23 bp, Mus musculus
ctctggcactctgtttcttcctt

SEQ ID NO: 213917 - DNA, 19 bp, Mus musculus
cagtgatgagtcttctctt

SEQ ID NO: 213918 - DNA, 19 bp, Mus musculus
cagtgatgagtcttctctt

SEQ ID NO: 213919 - DNA, 22 bp, Mus musculus
tgttttgtgaccaattatatgg

SEQ ID NO: 213920 - DNA, 23 bp, Mus musculus
ctggctttctctctctttgatgt

SEQ ID NO: 213921 - DNA, 18 bp, Mus musculus
actgcagtctgtgacaat

SEQ ID NO: 213922 - DNA, 19 bp, Mus musculus
ttatcagtgatatgctttt

SEQ ID NO: 213923 - DNA, 23 bp, Mus musculus
tctttctgcaagtctatgtggaa

SEQ ID NO: 213924 - DNA, 21 bp, Mus musculus
tgtgtacttatacctgtgttt

SEQ ID NO: 213925 - DNA, 23 bp, Mus musculus
aatctgtctgcctctgacactcc

SEQ ID NO: 213926 - DNA, 22 bp, Mus musculus
taactggggatcctcattctca

SEQ ID NO: 213927 - DNA, 19 bp, Mus musculus
tctctctctctctctctct

SEQ ID NO: 213928 - DNA, 23 bp, Mus musculus
ttggtgtgaagagagtgatcaca

SEQ ID NO: 213929 - DNA, 18 bp, Mus musculus
taattttgttttggaagc

SEQ ID NO: 213930 - DNA, 23 bp, Mus musculus
ttaatcagccagctttttatctg

SEQ ID NO: 213931 - DNA, 18 bp, Mus musculus
ttctatttgtagtgtttt

SEQ ID NO: 213932 - DNA, 20 bp, Mus musculus
tcatgtgggaactctgcccc

SEQ ID NO: 213933 - DNA, 21 bp, Mus musculus
tcagaatctcaggtttacagg

SEQ ID NO: 213934 - DNA, 20 bp, Mus musculus
ctggttttaggatgtttaaa

SEQ ID NO: 213935 - DNA, 21 bp, Mus musculus
tttccgtaattatctgtatct

SEQ ID NO: 213936 - DNA, 21 bp, Mus musculus
aattgcatttttgtatgatgg

SEQ ID NO: 213937 - DNA, 20 bp, Mus musculus
taaactgcttataattttga

SEQ ID NO: 213938 - DNA, 18 bp, Mus musculus
tatatgtgtatatgtata

SEQ ID NO: 213939 - DNA, 23 bp, Mus musculus
atgtggaggactgtttctcatga

SEQ ID NO: 213940 - DNA, 23 bp, Mus musculus
atttgtgtatatatatgtgtgta

SEQ ID NO: 213941 - DNA, 23 bp, Mus musculus
tgttaggagagagtttcatgact

SEQ ID NO: 213942 - DNA, 22 bp, Mus musculus
tgttttgtgaccaattatatgg

SEQ ID NO: 213943 - DNA, 22 bp, Mus musculus
tgttttgtgaccaattatatgg

SEQ ID NO: 213944 - DNA, 23 bp, Mus musculus
attaatgtttgcaatacttgtga

SEQ ID NO: 213945 - DNA, 22 bp, Mus musculus
cagtctctcttacatattggag

SEQ ID NO: 213946 - DNA, 23 bp, Mus musculus
ataactaaatatatgtatgtgta

SEQ ID NO: 213947 - DNA, 23 bp, Mus musculus
atctcgctgaagtgtgtgagcac

SEQ ID NO: 213948 - DNA, 23 bp, Mus musculus
tcacacattctctaattggtggg

SEQ ID NO: 213949 - DNA, 23 bp, Mus musculus
gatatgacactgtagcctgtctc

SEQ ID NO: 213950 - DNA, 22 bp, Mus musculus
tgttttgtgaccaattatatgg

SEQ ID NO: 213951 - DNA, 19 bp, Mus musculus
atgtccacttataagtgag

SEQ ID NO: 213952 - DNA, 23 bp, Mus musculus
tctgtgcttcttgaatgtggatg

SEQ ID NO: 213953 - DNA, 21 bp, Mus musculus
tgtgtgtatatacatatatgt

SEQ ID NO: 213954 - DNA, 21 bp, Mus musculus
tatgtgtatatatatgtatat

SEQ ID NO: 213955 - DNA, 23 bp, Mus musculus
tatctatttttatagcagttcca

SEQ ID NO: 213956 - DNA, 23 bp, Mus musculus
aaactcaggcagctatgaggaaa

SEQ ID NO: 213957 - DNA, 23 bp, Mus musculus
ttatatgtttgtatgtatgtgtg

SEQ ID NO: 213958 - DNA, 22 bp, Mus musculus
atgaattctgattatgttgttc

SEQ ID NO: 213959 - DNA, 19 bp, Mus musculus
atatattttattgctgact

SEQ ID NO: 213960 - DNA, 23 bp, Mus musculus
tgaaagtggcacatttatgtcct

SEQ ID NO: 213961 - DNA, 23 bp, Mus musculus
aggttttgtgattacatgctggt

SEQ ID NO: 213962 - DNA, 23 bp, Mus musculus
tctgagagcatttctatctgttt

SEQ ID NO: 213963 - DNA, 22 bp, Mus musculus
ctgcctgtctggctggctggct

SEQ ID NO: 213964 - DNA, 21 bp, Mus musculus
tttcagctatttttataagta

SEQ ID NO: 213965 - DNA, 23 bp, Mus musculus
gtttccatactattcaaaagtct

SEQ ID NO: 213966 - DNA, 23 bp, Mus musculus
tatagatgcattttgtttgtacc

SEQ ID NO: 213967 - DNA, 22 bp, Mus musculus
tgttttgtgaccaattatatgg

SEQ ID NO: 213968 - DNA, 23 bp, Mus musculus
tttgtttatctcaaaggtatgcc

SEQ ID NO: 213969 - DNA, 23 bp, Mus musculus
acacctgggagagacaggtcttg

SEQ ID NO: 213970 - DNA, 22 bp, Mus musculus
agagatgactcagtgctcaagg

SEQ ID NO: 213971 - DNA, 18 bp, Mus musculus
aaatgttgagtgtatggc

SEQ ID NO: 213972 - DNA, 21 bp, Mus musculus
tgtgcatatatgtatatatat

SEQ ID NO: 213973 - DNA, 23 bp, Mus musculus
agtgactctgcttcactgaatac

SEQ ID NO: 213974 - DNA, 22 bp, Mus musculus
tgaaatcaggatgctgatagct

SEQ ID NO: 213975 - DNA, 22 bp, Mus musculus
agaaatgttttggttctcctgg

SEQ ID NO: 213976 - DNA, 23 bp, Mus musculus
ttgtaagaagaaacagtggatag

SEQ ID NO: 213977 - DNA, 23 bp, Mus musculus
tgggagtcagaaagctcatggga

SEQ ID NO: 213978 - DNA, 22 bp, Mus musculus
tcacagaactgactctgctggt

SEQ ID NO: 213979 - DNA, 23 bp, Mus musculus
tggaagacttctgatatagaact

SEQ ID NO: 213980 - DNA, 20 bp, Mus musculus
tgcatatatatgtatgtgta

SEQ ID NO: 213981 - DNA, 18 bp, Mus musculus
gcctccactggggctcct

SEQ ID NO: 213982 - DNA, 23 bp, Mus musculus
gtctctggtagtactatgtccaa

SEQ ID NO: 213983 - DNA, 18 bp, Mus musculus
atatttatctactgagag

SEQ ID NO: 213984 - DNA, 21 bp, Mus musculus
taggtgccagtagttgagctg

SEQ ID NO: 213985 - DNA, 18 bp, Mus musculus
tgagtaccttatttgttc

SEQ ID NO: 213986 - DNA, 21 bp, Mus musculus
aatggtcaagtttctgaacca

SEQ ID NO: 213987 - DNA, 23 bp, Mus musculus
tgcctgcctgcctgcctgcctgc

SEQ ID NO: 213988 - DNA, 22 bp, Mus musculus
tcagacggttttatttatgtct

SEQ ID NO: 213989 - DNA, 23 bp, Mus musculus
actcctgactgtctgtctttctc

SEQ ID NO: 213990 - DNA, 20 bp, Mus musculus
tatagtctatatgtaattga

SEQ ID NO: 213991 - DNA, 23 bp, Mus musculus
acagtacgtgaaatactgagagc

SEQ ID NO: 213992 - DNA, 23 bp, Mus musculus
tgtctcagtggcagttgttactt

SEQ ID NO: 213993 - DNA, 20 bp, Mus musculus
tccagagctgactgtcctca

SEQ ID NO: 213994 - DNA, 19 bp, Mus musculus
tatgtgtatatatatttgt

SEQ ID NO: 213995 - DNA, 19 bp, Mus musculus
tatagagagtatatgtata

SEQ ID NO: 213996 - DNA, 20 bp, Mus musculus
atatatgcatgtgtgtgtgt

SEQ ID NO: 213997 - DNA, 23 bp, Mus musculus
ttattacagcaacagataccaga

SEQ ID NO: 213998 - DNA, 22 bp, Mus musculus
tgttttgtgaccaattatatgg

SEQ ID NO: 213999 - DNA, 23 bp, Mus musculus
atgttatcagagtgtggtcagct

SEQ ID NO: 214000 - DNA, 23 bp, Mus musculus
catcatgctaagaaaacaagtct

SEQ ID NO: 214001 - DNA, 21 bp, Mus musculus
atgtatgtttgcatgtgtatg

SEQ ID NO: 214002 - DNA, 22 bp, Mus musculus
atatatgtatagacacacacac

SEQ ID NO: 214003 - DNA, 21 bp, Mus musculus
acacacacacatatatatatg

SEQ ID NO: 214004 - DNA, 23 bp, Mus musculus
actttgtatgtatatatgtatag

SEQ ID NO: 214005 - DNA, 22 bp, Mus musculus
taggagacaggttctcttttgg

SEQ ID NO: 214006 - DNA, 19 bp, Mus musculus
tctggaacactctctctct

SEQ ID NO: 214007 - DNA, 23 bp, Mus musculus
attaagcttatatatatatgtgt

SEQ ID NO: 214008 - DNA, 22 bp, Mus musculus
tgcacatttatgttaatttgaa

SEQ ID NO: 214009 - DNA, 23 bp, Mus musculus
tctggttgtaccactgattattg

SEQ ID NO: 214010 - DNA, 23 bp, Mus musculus
ctcagtctgtggatcaggatgtg

SEQ ID NO: 214011 - DNA, 22 bp, Mus musculus
cgctactgctccagcattgagt

SEQ ID NO: 214012 - DNA, 23 bp, Mus musculus
ttttgaaaaaccatgtggaaata

SEQ ID NO: 214013 - DNA, 21 bp, Mus musculus
ctgtctgtctgtctgtctgcc

SEQ ID NO: 214014 - DNA, 23 bp, Mus musculus
actcacacactgtagaatgctgg

SEQ ID NO: 214015 - DNA, 21 bp, Mus musculus
gtgtgtgtgcccatgctttat

SEQ ID NO: 214016 - DNA, 19 bp, Mus musculus
acttcagtctctgtgagct

SEQ ID NO: 214017 - DNA, 23 bp, Mus musculus
tcagtcacacaggatcagctgag

SEQ ID NO: 214018 - DNA, 23 bp, Mus musculus
taacactgaactgagtctgctga

SEQ ID NO: 214019 - DNA, 21 bp, Mus musculus
tgagcagctctcactcatgtt

SEQ ID NO: 214020 - DNA, 22 bp, Mus musculus
tgttttgtgaccaattatatgg

SEQ ID NO: 214021 - DNA, 23 bp, Mus musculus
ctcatttgtaaatgtaacctcta

SEQ ID NO: 214022 - DNA, 20 bp, Mus musculus
tttttcatagaagaaggagg

SEQ ID NO: 214023 - DNA, 23 bp, Mus musculus
cagggactcactgagaggagtgc

SEQ ID NO: 214024 - DNA, 23 bp, Mus musculus
ctgtgtctctgtttagtttctgt

SEQ ID NO: 214025 - DNA, 23 bp, Mus musculus
tgtccattgatgagagtgtgctg

SEQ ID NO: 214026 - DNA, 23 bp, Mus musculus
atatgtacatatgtatgtgtgtg

SEQ ID NO: 214027 - DNA, 23 bp, Mus musculus
tatgaggatgcatatgtatgaat

SEQ ID NO: 214028 - DNA, 22 bp, Mus musculus
tatctatctatctatctctctc

SEQ ID NO: 214029 - DNA, 20 bp, Mus musculus
tggcatgcttagaagagtgt

SEQ ID NO: 214030 - DNA, 22 bp, Mus musculus
acaagagagcaaagatgtgagg

SEQ ID NO: 214031 - DNA, 23 bp, Mus musculus
agagaatctgtatgtttgatgaa

SEQ ID NO: 214032 - DNA, 23 bp, Mus musculus
tgtggctctctgggtggctgcct

SEQ ID NO: 214033 - DNA, 21 bp, Mus musculus
tgacgaggcttgtcttggcgt

SEQ ID NO: 214034 - DNA, 22 bp, Mus musculus
aacacagatgtggcagctgggt

SEQ ID NO: 214035 - DNA, 23 bp, Mus musculus
gcctcagtccctctgtgcttctg

SEQ ID NO: 214036 - DNA, 21 bp, Mus musculus
cagaggctgtcagggtctctg

SEQ ID NO: 214037 - DNA, 23 bp, Mus musculus
gtgtgtgtacatgtatatgtgtg

SEQ ID NO: 214038 - DNA, 21 bp, Mus musculus
ttaatcttgaagatgcttcaa

SEQ ID NO: 214039 - DNA, 22 bp, Mus musculus
acaaagtggatgtcaattgcat

SEQ ID NO: 214040 - DNA, 23 bp, Mus musculus
tttgagtgtttggtatggcagtg

SEQ ID NO: 214041 - DNA, 22 bp, Mus musculus
acattcaagactaggcactgct

SEQ ID NO: 214042 - DNA, 23 bp, Mus musculus
ctcttcatgatgttgatgctgct

SEQ ID NO: 214043 - DNA, 20 bp, Mus musculus
tcaactggtatagaacagct

SEQ ID NO: 214044 - DNA, 23 bp, Mus musculus
cactgtggaacttgaattgcaga

SEQ ID NO: 214045 - DNA, 22 bp, Mus musculus
ttgtatctatatgttgctgtat

SEQ ID NO: 214046 - DNA, 23 bp, Mus musculus
tctgaagcacacagttttgactg

SEQ ID NO: 214047 - DNA, 21 bp, Mus musculus
ctagtgtgacagtcaggtaat

SEQ ID NO: 214048 - DNA, 22 bp, Mus musculus
tgttttgtcaccaattatatgg

SEQ ID NO: 214049 - DNA, 18 bp, Mus musculus
ggtgtagaaggtgtgcac

SEQ ID NO: 214050 - DNA, 23 bp, Mus musculus
acactctgcttaagaactgtgat

SEQ ID NO: 214051 - DNA, 23 bp, Mus musculus
aacatcttaaaacaggtactgta

SEQ ID NO: 214052 - DNA, 22 bp, Mus musculus
cttttatactcacacatacacg

SEQ ID NO: 214053 - DNA, 22 bp, Mus musculus
tctcttctgactctctcagatc

SEQ ID NO: 214054 - DNA, 22 bp, Mus musculus
gtcaaatagtggcagctacata

SEQ ID NO: 214055 - DNA, 21 bp, Mus musculus
gaacacagtgagctttcattt

SEQ ID NO: 214056 - DNA, 23 bp, Mus musculus
tacaagtggaatatgaagtgttt

SEQ ID NO: 214057 - DNA, 22 bp, Mus musculus
tgagaggctctgtcagtgcctg

SEQ ID NO: 214058 - DNA, 23 bp, Mus musculus
agaccctctgagtctctttgtct

SEQ ID NO: 214059 - DNA, 23 bp, Mus musculus
aatcctgtgaagtcatttcctgc

SEQ ID NO: 214060 - DNA, 23 bp, Mus musculus
tgtatgagtgtgtccatatgaat

SEQ ID NO: 214061 - DNA, 23 bp, Mus musculus
attgataactagtttttgtctga

SEQ ID NO: 214062 - DNA, 23 bp, Mus musculus
acttagactgactggttaccatg

SEQ ID NO: 214063 - DNA, 22 bp, Mus musculus
tgttttgtgaccaattatatgg

SEQ ID NO: 214064 - DNA, 20 bp, Mus musculus
tagtttcatagttttagaag

SEQ ID NO: 214065 - DNA, 23 bp, Mus musculus
gtgtgtgtgtatactctatctgt

SEQ ID NO: 214066 - DNA, 21 bp, Mus musculus
agtattctctgtttatctctg

SEQ ID NO: 214067 - DNA, 20 bp, Mus musculus
tatatgtatatgtatgtgta

SEQ ID NO: 214068 - DNA, 23 bp, Mus musculus
tgtgtgtctatatgtgtgtgtgt

SEQ ID NO: 214069 - DNA, 23 bp, Mus musculus
ttgtgaccaattatattgtcaat

SEQ ID NO: 214070 - DNA, 21 bp, Mus musculus
ctggctgcctgatccctgttg

SEQ ID NO: 214071 - DNA, 22 bp, Mus musculus
ttcacagaacattgagatcaga

SEQ ID NO: 214072 - DNA, 23 bp, Mus musculus
agcctctcacactctattatatc

SEQ ID NO: 214073 - DNA, 22 bp, Mus musculus
tctttgtcacagctattcataa

SEQ ID NO: 214074 - DNA, 19 bp, Mus musculus
atgtgtgtgtatgtctgtg

SEQ ID NO: 214075 - DNA, 20 bp, Mus musculus
atgtgtatatgattataacc

SEQ ID NO: 214076 - DNA, 23 bp, Mus musculus
ggactcactctgtaactctttag

SEQ ID NO: 214077 - DNA, 23 bp, Mus musculus
tattcaagtttatcagatgatga

SEQ ID NO: 214078 - DNA, 21 bp, Mus musculus
tatatgtgcatgtgtatatat

SEQ ID NO: 214079 - DNA, 20 bp, Mus musculus
atacagggagggcatgatca

SEQ ID NO: 214080 - DNA, 23 bp, Mus musculus
gtgcctgactctctgtggctgtg

SEQ ID NO: 214081 - DNA, 21 bp, Mus musculus
aagagagagtggacactgagc

SEQ ID NO: 214082 - DNA, 21 bp, Mus musculus
ttccttgtatccaattcactg

SEQ ID NO: 214083 - DNA, 23 bp, Mus musculus
tgtacaatgtgcatatacattgt

SEQ ID NO: 214084 - DNA, 23 bp, Mus musculus
tgtgagttcatatgttctttgct

SEQ ID NO: 214085 - DNA, 23 bp, Mus musculus
atagattagtgataagaatgcat

SEQ ID NO: 214086 - DNA, 20 bp, Mus musculus
aggttgttggatgtttagtt

SEQ ID NO: 214087 - DNA, 21 bp, Mus musculus
taaactgtagtctgatacctg

SEQ ID NO: 214088 - DNA, 23 bp, Mus musculus
agtagctagattttgggttttct

SEQ ID NO: 214089 - DNA, 22 bp, Mus musculus
ttcgttgtgttcctcaggctta

SEQ ID NO: 214090 - DNA, 22 bp, Mus musculus
tgttttgtgaccaattatatgg

SEQ ID NO: 214091 - DNA, 23 bp, Mus musculus
taagcctcaggaagtgttacagt

SEQ ID NO: 214092 - DNA, 21 bp, Mus musculus
gtttatggcactccaagatga

SEQ ID NO: 214093 - DNA, 23 bp, Mus musculus
tactctgtggaatatatatctat

SEQ ID NO: 214094 - DNA, 20 bp, Mus musculus
atatagagagatatagatat

SEQ ID NO: 214095 - DNA, 21 bp, Mus musculus
ttatatgtataactgctctct

SEQ ID NO: 214096 - DNA, 22 bp, Mus musculus
tgttttgtgaccaattatatgg

SEQ ID NO: 214097 - DNA, 23 bp, Mus musculus
gtgtgtgcttctgcatgtgcatg

SEQ ID NO: 214098 - DNA, 23 bp, Mus musculus
attttagaggaagtaagagtcct

SEQ ID NO: 214099 - DNA, 23 bp, Mus musculus
ttctaatgctctgggacttttta

SEQ ID NO: 214100 - DNA, 22 bp, Mus musculus
tgatagtggttcttaaaggctt

SEQ ID NO: 214101 - DNA, 22 bp, Mus musculus
tgttttgtgaccaattatatgg

SEQ ID NO: 214102 - DNA, 19 bp, Mus musculus
aatatgaacacatacatat

SEQ ID NO: 214103 - DNA, 23 bp, Mus musculus
agtatgtatgtatgtatgcatgt

SEQ ID NO: 214104 - DNA, 22 bp, Mus musculus
tgttttgtgaccaattatatgg

SEQ ID NO: 214105 - DNA, 18 bp, Mus musculus
acagtgtccagggaagtc

SEQ ID NO: 214106 - DNA, 23 bp, Mus musculus
tttcatattgaaattgaaaatgt

SEQ ID NO: 214107 - DNA, 23 bp, Mus musculus
ttctctctgtatttctgtgtcct

SEQ ID NO: 214108 - DNA, 20 bp, Mus musculus
tgtgaacatgtgtagaaggg

SEQ ID NO: 214109 - DNA, 23 bp, Mus musculus
tctactgcagtgagggcacttgt

SEQ ID NO: 214110 - DNA, 22 bp, Mus musculus
taaggtgcatctagtgcagata

SEQ ID NO: 214111 - DNA, 21 bp, Mus musculus
tagcatctactgccctaagtg

SEQ ID NO: 214112 - DNA, 18 bp, Mus musculus
atatgtgtgtgtatgtgt

SEQ ID NO: 214113 - DNA, 22 bp, Mus musculus
tgttttgtgaccaattatatgg

SEQ ID NO: 214114 - DNA, 23 bp, Mus musculus
gtatcattttttatatagaatag

SEQ ID NO: 214115 - DNA, 19 bp, Mus musculus
actactttatataaagagt

SEQ ID NO: 214116 - DNA, 22 bp, Mus musculus
tgttttgtgaccaattatatgg

SEQ ID NO: 214117 - DNA, 22 bp, Mus musculus
taactccatagtgtgcaggatt

SEQ ID NO: 214118 - DNA, 20 bp, Mus musculus
taagtatttctgatagtgtc

SEQ ID NO: 214119 - DNA, 23 bp, Mus musculus
tctcctggttttatatggccttc

SEQ ID NO: 214120 - DNA, 23 bp, Mus musculus
atgtgtgagtgtgtgcatgtgca

SEQ ID NO: 214121 - DNA, 23 bp, Mus musculus
tctaaatttgatggaagtcataa

SEQ ID NO: 214122 - DNA, 23 bp, Mus musculus
agcctctctctgtttgtccctgc

SEQ ID NO: 214123 - DNA, 22 bp, Mus musculus
caatctcaagaacttggcatag

SEQ ID NO: 214124 - DNA, 23 bp, Mus musculus
tgttttatgagaggaatagatcc

SEQ ID NO: 214125 - DNA, 21 bp, Mus musculus
agacattggtcagtgttggag

SEQ ID NO: 214126 - DNA, 23 bp, Mus musculus
atgagcttttgaattctcagtgt

SEQ ID NO: 214127 - DNA, 21 bp, Mus musculus
tattttgtagctcacttaact

SEQ ID NO: 214128 - DNA, 23 bp, Mus musculus
tatgtgtatatgtgtatatgtgc

SEQ ID NO: 214129 - DNA, 23 bp, Mus musculus
atatgtgtatatgtatatatgtg

SEQ ID NO: 214130 - DNA, 23 bp, Mus musculus
gtgtgtgcatatatatgtgtgtg

SEQ ID NO: 214131 - DNA, 23 bp, Mus musculus
atgtgtgtatatatatatgtgtg

SEQ ID NO: 214132 - DNA, 23 bp, Mus musculus
agaagagagtgatgaatgcatgt

SEQ ID NO: 214133 - DNA, 22 bp, Mus musculus
tgttttgtgaccaattatatgg

SEQ ID NO: 214134 - DNA, 23 bp, Mus musculus
tcagaagagtcagagctctggta

SEQ ID NO: 214135 - DNA, 18 bp, Mus musculus
tgtctgtagaaagcttag

SEQ ID NO: 214136 - DNA, 20 bp, Mus musculus
ctatctcacagatatggcaa

SEQ ID NO: 214137 - DNA, 22 bp, Mus musculus
tgttttgtgaccaattatatgg

SEQ ID NO: 214138 - DNA, 23 bp, Mus musculus
tctgggacagtctctgacacata

SEQ ID NO: 214139 - DNA, 19 bp, Mus musculus
ggtacagttagatgactca

SEQ ID NO: 214140 - DNA, 23 bp, Mus musculus
tgtctgtctatctgtctgtctgt

SEQ ID NO: 214141 - DNA, 23 bp, Mus musculus
tcagagcctccttaagttgtggc

SEQ ID NO: 214142 - DNA, 22 bp, Mus musculus
tgtgagagaaaaggcagttgtt

SEQ ID NO: 214143 - DNA, 22 bp, Mus musculus
tgttttgtgaccaattatatgg

SEQ ID NO: 214144 - DNA, 22 bp, Mus musculus
ttgtcagtacaaagtcagcact

SEQ ID NO: 214145 - DNA, 21 bp, Mus musculus
actcacagaatcggtgtcatc

SEQ ID NO: 214146 - DNA, 20 bp, Mus musculus
tactctgtgtactctctcag

SEQ ID NO: 214147 - DNA, 23 bp, Mus musculus
tggcacagatcagcaggatgaga

SEQ ID NO: 214148 - DNA, 23 bp, Mus musculus
atatgtgcctccttgtgatctgg

SEQ ID NO: 214149 - DNA, 21 bp, Mus musculus
atagtagagacagtgctcaga

SEQ ID NO: 214150 - DNA, 18 bp, Mus musculus
aggtgtgtgagctgagag

SEQ ID NO: 214151 - DNA, 18 bp, Mus musculus
ctgtatatgtgtatgtga

SEQ ID NO: 214152 - DNA, 23 bp, Mus musculus
tatacacatatgtatacatgtaa

SEQ ID NO: 214153 - DNA, 23 bp, Mus musculus
taagtgcatatgtatacatacaa

SEQ ID NO: 214154 - DNA, 18 bp, Mus musculus
tgtgtgtgtgtgcatgtg

SEQ ID NO: 214155 - DNA, 23 bp, Mus musculus
atctcacagtgactgtttctgtc

SEQ ID NO: 214156 - DNA, 22 bp, Mus musculus
gaagagggtgactgtcaaccga

SEQ ID NO: 214157 - DNA, 20 bp, Mus musculus
acaggcttgaagcagtctga

SEQ ID NO: 214158 - DNA, 23 bp, Mus musculus
tattctgagttcaacgtggaacc

SEQ ID NO: 214159 - DNA, 23 bp, Mus musculus
ggttttactgctgtatacagaca

SEQ ID NO: 214160 - DNA, 23 bp, Mus musculus
cagttgctctctctctgactggt

SEQ ID NO: 214161 - DNA, 23 bp, Mus musculus
atgatgagctagttgcttggagt

SEQ ID NO: 214162 - DNA, 23 bp, Mus musculus
tatatgtatatgtatatgtatgt

SEQ ID NO: 214163 - DNA, 21 bp, Mus musculus
tcagaacagtgggtgctcagt

SEQ ID NO: 214164 - DNA, 23 bp, Mus musculus
aagacagtgacctctggaaatga

SEQ ID NO: 214165 - DNA, 23 bp, Mus musculus
tcacaagctgactgtgtctctga

SEQ ID NO: 214166 - DNA, 22 bp, Mus musculus
caggggctgtcactgagcctca

SEQ ID NO: 214167 - DNA, 21 bp, Mus musculus
taaagctgagtgtggaggctg

SEQ ID NO: 214168 - DNA, 23 bp, Mus musculus
gttctgtgtggaagagttggggt

SEQ ID NO: 214169 - DNA, 18 bp, Mus musculus
atacattcatacacactc

SEQ ID NO: 214170 - DNA, 22 bp, Mus musculus
tgttttgtgaccaattatatgg

SEQ ID NO: 214171 - DNA, 23 bp, Mus musculus
tgatgacaggattgctgtgtggc

SEQ ID NO: 214172 - DNA, 23 bp, Mus musculus
agtctgtctgtctgtctgtctaa

SEQ ID NO: 214173 - DNA, 23 bp, Mus musculus
tcttggggcacactctctctctg

SEQ ID NO: 214174 - DNA, 23 bp, Mus musculus
atgggttggacctgctcagtgtc

SEQ ID NO: 214175 - DNA, 23 bp, Mus musculus
tgagcttgcacacacacactggc

SEQ ID NO: 214176 - DNA, 23 bp, Mus musculus
gcctgcctggctgcctgtcagtc

SEQ ID NO: 214177 - DNA, 23 bp, Mus musculus
tgcctgcctgcctgcctgcctgc

SEQ ID NO: 214178 - DNA, 20 bp, Mus musculus
atgagctctgactcctcttc

SEQ ID NO: 214179 - DNA, 21 bp, Mus musculus
acagtgagtctggctgacttc

SEQ ID NO: 214180 - DNA, 18 bp, Mus musculus
tagaggtagtaggtatat

SEQ ID NO: 214181 - DNA, 20 bp, Mus musculus
atgtgtgtgtgtgtgtatac

SEQ ID NO: 214182 - DNA, 22 bp, Mus musculus
actccacttgctattgtgtaat

SEQ ID NO: 214183 - DNA, 18 bp, Mus musculus
agagtgagaacacagggg

SEQ ID NO: 214184 - DNA, 23 bp, Mus musculus
tgcctcacagtcactctgtccaa

SEQ ID NO: 214185 - DNA, 20 bp, Mus musculus
gacagcaatgccaatgagtc

SEQ ID NO: 214186 - DNA, 18 bp, Mus musculus
tcagacacataccagagc

SEQ ID NO: 214187 - DNA, 20 bp, Mus musculus
tctccctcactgactgcaag

SEQ ID NO: 214188 - DNA, 20 bp, Mus musculus
tgcatgtatgtatgaatgtt

SEQ ID NO: 214189 - DNA, 21 bp, Mus musculus
tgtttgcctgtctgtctgtca

SEQ ID NO: 214190 - DNA, 23 bp, Mus musculus
ctcgctgtcactgactctgaggt

SEQ ID NO: 214191 - DNA, 23 bp, Mus musculus
acaggagttcgtaaacagaggca

SEQ ID NO: 214192 - DNA, 18 bp, Mus musculus
cctctgagccgtttctcc

SEQ ID NO: 214193 - DNA, 23 bp, Mus musculus
tacctagttctggggctggagag

SEQ ID NO: 214194 - DNA, 20 bp, Mus musculus
aagagcactgactgctcttc

SEQ ID NO: 214195 - DNA, 23 bp, Mus musculus
ataatggctgtgctagaattgag

SEQ ID NO: 214196 - DNA, 19 bp, Mus musculus
agaggttccactttgaaaa

SEQ ID NO: 214197 - DNA, 23 bp, Mus musculus
tcaccgtatgataagttgtaccc

SEQ ID NO: 214198 - DNA, 23 bp, Mus musculus
attcactgtgcttctagtttctc

SEQ ID NO: 214199 - DNA, 22 bp, Mus musculus
gactgagttgtttagctgtggg

SEQ ID NO: 214200 - DNA, 19 bp, Mus musculus
ttagctagagactctgtct

SEQ ID NO: 214201 - DNA, 23 bp, Mus musculus
tgaggaagtactttgtattgctg

SEQ ID NO: 214202 - DNA, 21 bp, Mus musculus
tccatggtgatctgataggat

SEQ ID NO: 214203 - DNA, 20 bp, Mus musculus
tgaatgtttgtatgtatgta

SEQ ID NO: 214204 - DNA, 23 bp, Mus musculus
tgtctgtgtgtatgtgtgtgtga

SEQ ID NO: 214205 - DNA, 22 bp, Mus musculus
tatgttcgtgtgcatgtgcata

SEQ ID NO: 214206 - DNA, 20 bp, Mus musculus
ttgtgagtcagagatgtacc

SEQ ID NO: 214207 - DNA, 23 bp, Mus musculus
atacctctattacagtctctctg

SEQ ID NO: 214208 - DNA, 23 bp, Mus musculus
tcactctctgtataatatgtagc

SEQ ID NO: 214209 - DNA, 23 bp, Mus musculus
cctggctctctctcaggctgtgg

SEQ ID NO: 214210 - DNA, 23 bp, Mus musculus
tcttgcaccatttgacaagacta

SEQ ID NO: 214211 - DNA, 22 bp, Mus musculus
tgttttgtgaccaattatatgg

SEQ ID NO: 214212 - DNA, 23 bp, Mus musculus
ttccatggtggtctgataggatg

SEQ ID NO: 214213 - DNA, 23 bp, Mus musculus
tctgtgaccaattgtatggttaa

SEQ ID NO: 214214 - DNA, 22 bp, Mus musculus
tgttttgtgaccaattatatgg

SEQ ID NO: 214215 - DNA, 21 bp, Mus musculus
aatctctgtcacccttttcag

SEQ ID NO: 214216 - DNA, 18 bp, Mus musculus
aacagtacattgaaagca

SEQ ID NO: 214217 - DNA, 23 bp, Mus musculus
tgataggttgttgtttgtaatgt

SEQ ID NO: 214218 - DNA, 22 bp, Mus musculus
tatttccttcatcagctaatct

SEQ ID NO: 214219 - DNA, 20 bp, Mus musculus
aatgtcactaggcttggtgt

SEQ ID NO: 214220 - DNA, 23 bp, Mus musculus
cccacactctgtctgtgacacac

SEQ ID NO: 214221 - DNA, 23 bp, Mus musculus
ctgtgtctctgtttagtttctgt

SEQ ID NO: 214222 - DNA, 23 bp, Mus musculus
aggatctgtccattgatgagagt

SEQ ID NO: 214223 - DNA, 20 bp, Mus musculus
tgccacactcttttttaaga

SEQ ID NO: 214224 - DNA, 23 bp, Mus musculus
agagtttatcttaaagttagagg

SEQ ID NO: 214225 - DNA, 23 bp, Mus musculus
tccatggttgtctgataggatac

SEQ ID NO: 214226 - DNA, 23 bp, Mus musculus
tttgtgaccaattgtatggtcaa

SEQ ID NO: 214227 - DNA, 23 bp, Mus musculus
ttatttgtggctgattttctagt

SEQ ID NO: 214228 - DNA, 22 bp, Mus musculus
tgttttgtgaccaattatatgg

SEQ ID NO: 214229 - DNA, 23 bp, Mus musculus
tatgtgtatgtatatttatgtat

SEQ ID NO: 214230 - DNA, 22 bp, Mus musculus
tgttttgtgaccaattatatgg

SEQ ID NO: 214231 - DNA, 22 bp, Mus musculus
tgttttgtgaccaattatatgg

SEQ ID NO: 214232 - DNA, 21 bp, Mus musculus
tcagaggctgaaaagtcttgt

SEQ ID NO: 214233 - DNA, 22 bp, Mus musculus
gtcactgacactgtctcccaaa

SEQ ID NO: 214234 - DNA, 20 bp, Mus musculus
tgtgtgtgtgtgtgtgtgtg

SEQ ID NO: 214235 - DNA, 22 bp, Mus musculus
tgaggaatgaagtcaggtctgt

SEQ ID NO: 214236 - DNA, 23 bp, Mus musculus
tttactcactcagctagctcatt

SEQ ID NO: 214237 - DNA, 20 bp, Mus musculus
aggcacggtgtcttctgttg

SEQ ID NO: 214238 - DNA, 23 bp, Mus musculus
tactatgtgtgtgcatatgtggc

SEQ ID NO: 214239 - DNA, 19 bp, Mus musculus
acacgtatgtatgcatgtg

SEQ ID NO: 214240 - DNA, 23 bp, Mus musculus
tgtgtgtccgtctgtctgtctgt

SEQ ID NO: 214241 - DNA, 23 bp, Mus musculus
ccccacactgtctctctctctct

SEQ ID NO: 214242 - DNA, 23 bp, Mus musculus
gagtgagtgagtgagtgagtggg

SEQ ID NO: 214243 - DNA, 18 bp, Mus musculus
atatatgtatatgtatat

SEQ ID NO: 214244 - DNA, 23 bp, Mus musculus
ctgtctgtctctctctgtgtggg

SEQ ID NO: 214245 - DNA, 21 bp, Mus musculus
tgtgtgtgcatatatatgtgt

SEQ ID NO: 214246 - DNA, 23 bp, Mus musculus
gtgtgtgtatatatatatgtgtg

SEQ ID NO: 214247 - DNA, 21 bp, Mus musculus
tgtgcgcgtgtgtgtgcgcgt

SEQ ID NO: 214248 - DNA, 23 bp, Mus musculus
ccaccctctctctgtcacatgac

SEQ ID NO: 214249 - DNA, 22 bp, Mus musculus
actctgaagagagagtccacag

SEQ ID NO: 214250 - DNA, 18 bp, Mus musculus
tagatagtagctatctat

SEQ ID NO: 214251 - DNA, 18 bp, Mus musculus
agagttgtttgctggaac

SEQ ID NO: 214252 - DNA, 22 bp, Mus musculus
gtgtgcatgcatgtattcatgt

SEQ ID NO: 214253 - DNA, 23 bp, Mus musculus
ctgtgggactctcagactgagaa

SEQ ID NO: 214254 - DNA, 23 bp, Mus musculus
tatgtatatatgtatgtatgtgt

SEQ ID NO: 214255 - DNA, 22 bp, Mus musculus
cttgctctctgagacacactct

SEQ ID NO: 214256 - DNA, 23 bp, Mus musculus
atgagactggtatgctttcttaa

SEQ ID NO: 214257 - DNA, 22 bp, Mus musculus
atattattgaggttagtgtctc

SEQ ID NO: 214258 - DNA, 23 bp, Mus musculus
tgtctgtctgtctgtgtgtgtgc

SEQ ID NO: 214259 - DNA, 23 bp, Mus musculus
tcggaggctgcttcacctttggg

SEQ ID NO: 214260 - DNA, 21 bp, Mus musculus
tgtggtagtttgaatagaagt

SEQ ID NO: 214261 - DNA, 18 bp, Mus musculus
tgaatttctgagtctcct

SEQ ID NO: 214262 - DNA, 19 bp, Mus musculus
aatatctactttatacagt

SEQ ID NO: 214263 - DNA, 23 bp, Mus musculus
tctgtctgtctgtctgtctgtct

SEQ ID NO: 214264 - DNA, 23 bp, Mus musculus
attcacctctgtccctgagatta

SEQ ID NO: 214265 - DNA, 23 bp, Mus musculus
cttctgtcagtctctctgcctga

SEQ ID NO: 214266 - DNA, 21 bp, Mus musculus
tctctggtgtgtctgtttgtg

SEQ ID NO: 214267 - DNA, 22 bp, Mus musculus
tgttttgtgaccaattatatgg

SEQ ID NO: 214268 - DNA, 23 bp, Mus musculus
tgtgtcagtcaggattggctggc

SEQ ID NO: 214269 - DNA, 22 bp, Mus musculus
tgttttgtgaccaattatatgg

SEQ ID NO: 214270 - DNA, 18 bp, Mus musculus
agtgtctgtagcggtctc

SEQ ID NO: 214271 - DNA, 23 bp, Mus musculus
tgtatgtatgtatgtatgtatgt

SEQ ID NO: 214272 - DNA, 23 bp, Mus musculus
tgcatgcatgcatgtgagtatgc

SEQ ID NO: 214273 - DNA, 23 bp, Mus musculus
tctgtctcactgtgacatctgtc

SEQ ID NO: 214274 - DNA, 22 bp, Mus musculus
caggaggggaagatttggatgg

SEQ ID NO: 214275 - DNA, 23 bp, Mus musculus
ttaagaatttgtggaatctgctg

SEQ ID NO: 214276 - DNA, 23 bp, Mus musculus
tacaagtcacatcatgttgtagc

SEQ ID NO: 214277 - DNA, 21 bp, Mus musculus
gcagtgtggtagtagcttgta

SEQ ID NO: 214278 - DNA, 23 bp, Mus musculus
tggttaagagcactgactgctct

SEQ ID NO: 214279 - DNA, 23 bp, Mus musculus
tcatctacccacactctcactga

SEQ ID NO: 214280 - DNA, 23 bp, Mus musculus
tcgctcgctcggtccgtgtgacc

SEQ ID NO: 214281 - DNA, 22 bp, Mus musculus
atgactgacaggacagagtgtg

SEQ ID NO: 214282 - DNA, 23 bp, Mus musculus
actctctgtgtctctgtctctcc

SEQ ID NO: 214283 - DNA, 23 bp, Mus musculus
tctgtctgcctgtctgtctgtgt

SEQ ID NO: 214284 - DNA, 20 bp, Mus musculus
gcatgtgtctgtctgtctgc

SEQ ID NO: 214285 - DNA, 23 bp, Mus musculus
ctgcctgtctgtctgtgtgtgca

SEQ ID NO: 214286 - DNA, 22 bp, Mus musculus
gttctgggttcagtctgcatta

SEQ ID NO: 214287 - DNA, 23 bp, Mus musculus
tgaggtagtaggttgtcagttct

SEQ ID NO: 214288 - DNA, 23 bp, Mus musculus
atgtatgtatgtatgtatgtatg

SEQ ID NO: 214289 - DNA, 21 bp, Mus musculus
tatgtatgtatgtatgtatgt

SEQ ID NO: 214290 - DNA, 23 bp, Mus musculus
attttgagagggtattggctttg

SEQ ID NO: 214291 - DNA, 23 bp, Mus musculus
tgcatctatgtatgtatgtatgt

SEQ ID NO: 214292 - DNA, 22 bp, Mus musculus
agagagagagagcatgagcatg

SEQ ID NO: 214293 - DNA, 20 bp, Mus musculus
ttcttcctcttcctttctct

SEQ ID NO: 214294 - DNA, 19 bp, Mus musculus
agggaagaaaatggagtga

SEQ ID NO: 214295 - DNA, 22 bp, Mus musculus
tctcagtgtgaaagtcagcgtt

SEQ ID NO: 214296 - DNA, 23 bp, Mus musculus
tatgtatatgtatgtgtatgttt

SEQ ID NO: 214297 - DNA, 23 bp, Mus musculus
tatcttattatatatgtgtgtgt

SEQ ID NO: 214298 - DNA, 21 bp, Mus musculus
atcagctggtgtatgctgcct

SEQ ID NO: 214299 - DNA, 23 bp, Mus musculus
gtgcagagagagaagagagtggc

SEQ ID NO: 214300 - DNA, 23 bp, Mus musculus
ttcttagtcttgcttgtgttccc

SEQ ID NO: 214301 - DNA, 19 bp, Mus musculus
aggcccttggttttgtgga

SEQ ID NO: 214302 - DNA, 20 bp, Mus musculus
atatgtatatatgtatatgt

SEQ ID NO: 214303 - DNA, 21 bp, Mus musculus
atatatgtgtgcatatatatg

SEQ ID NO: 214304 - DNA, 21 bp, Mus musculus
agggtcctgaagactgtgctg

SEQ ID NO: 214305 - DNA, 23 bp, Mus musculus
tcagagctgttaacagtctgtga

SEQ ID NO: 214306 - DNA, 21 bp, Mus musculus
aaaaagtatacaagcaaagcc

SEQ ID NO: 214307 - DNA, 18 bp, Mus musculus
attctgattatacaattg

SEQ ID NO: 214308 - DNA, 20 bp, Mus musculus
aatgtatgcatgcatgtatg

SEQ ID NO: 214309 - DNA, 23 bp, Mus musculus
tgtactggagttgattctcttct

SEQ ID NO: 214310 - DNA, 20 bp, Mus musculus
tgtgtgtgtatgtgtgtgtg

SEQ ID NO: 214311 - DNA, 21 bp, Mus musculus
tgtggctgtgactgtgactga

SEQ ID NO: 214312 - DNA, 22 bp, Mus musculus
tgtaactacaactacatgtaca

SEQ ID NO: 214313 - DNA, 22 bp, Mus musculus
ttcttcatgactttgctgtttc

SEQ ID NO: 214314 - DNA, 23 bp, Mus musculus
gagaggctctgtcagtgcctgac

SEQ ID NO: 214315 - DNA, 21 bp, Mus musculus
atgtgtacatatatgtgtgtg

SEQ ID NO: 214316 - DNA, 23 bp, Mus musculus
gctagtcttcactgtgtttgtgc

SEQ ID NO: 214317 - DNA, 23 bp, Mus musculus
cacacacacacatatatgtgtat

SEQ ID NO: 214318 - DNA, 22 bp, Mus musculus
atgtatgtatgtatgtatgtat

SEQ ID NO: 214319 - DNA, 23 bp, Mus musculus
tgtggatttgtgtgcatatgtgt

SEQ ID NO: 214320 - DNA, 23 bp, Mus musculus
gagactcagaagatgctgagcac

SEQ ID NO: 214321 - DNA, 19 bp, Mus musculus
gggcctcagattcttgtct

SEQ ID NO: 214322 - DNA, 23 bp, Mus musculus
agatgagagtgagctttcctgga

SEQ ID NO: 214323 - DNA, 23 bp, Mus musculus
tatactatgtaaatgtatatatg

SEQ ID NO: 214324 - DNA, 23 bp, Mus musculus
atgtatgtatgtatgtatgtatg

SEQ ID NO: 214325 - DNA, 22 bp, Mus musculus
aaactgtggctgtgttcacagt

SEQ ID NO: 214326 - DNA, 22 bp, Mus musculus
tatatgcatatatattgggtat

SEQ ID NO: 214327 - DNA, 19 bp, Mus musculus
aattgtgagtcaaaggttt

SEQ ID NO: 214328 - DNA, 22 bp, Mus musculus
tacacaggtcagagtgtggact

SEQ ID NO: 214329 - DNA, 21 bp, Mus musculus
tgtacaggggagggaatcttg

SEQ ID NO: 214330 - DNA, 23 bp, Mus musculus
cggagtctctgtccctgtcatac

SEQ ID NO: 214331 - DNA, 23 bp, Mus musculus
tatgaagtgtactctgctgtttg

SEQ ID NO: 214332 - DNA, 19 bp, Mus musculus
gaaagcagatgctcagcag

SEQ ID NO: 214333 - DNA, 23 bp, Mus musculus
agaaatctcatattgaatagtgg

SEQ ID NO: 214334 - DNA, 23 bp, Mus musculus
ttatgtgtagatactcaaaacat

SEQ ID NO: 214335 - DNA, 23 bp, Mus musculus
tatatgtatatatatgtatgtgt

SEQ ID NO: 214336 - DNA, 19 bp, Mus musculus
tctctctctctctctctgt

SEQ ID NO: 214337 - DNA, 23 bp, Mus musculus
tgagagagagctaagtgtgtgtg

SEQ ID NO: 214338 - DNA, 23 bp, Mus musculus
gtcccccacagaaaccagaatgt

SEQ ID NO: 214339 - DNA, 23 bp, Mus musculus
agttattctcattttgttgttgt

SEQ ID NO: 214340 - DNA, 23 bp, Mus musculus
ctgagtctcagtcagtctgtaat

SEQ ID NO: 214341 - DNA, 23 bp, Mus musculus
ttcaatgggtaatgatactgaac

SEQ ID NO: 214342 - DNA, 22 bp, Mus musculus
atatttgtttttgacctaggtg

SEQ ID NO: 214343 - DNA, 23 bp, Mus musculus
ttaggttctttgtcagtcacaaa

SEQ ID NO: 214344 - DNA, 19 bp, Mus musculus
atttgcatggcattccttt

SEQ ID NO: 214345 - DNA, 23 bp, Mus musculus
ctcatgtagtactatgtataatt

SEQ ID NO: 214346 - DNA, 23 bp, Mus musculus
tattgaggttggttgtatatgaa

SEQ ID NO: 214347 - DNA, 22 bp, Mus musculus
tctcggtgtctctctctctctg

SEQ ID NO: 214348 - DNA, 20 bp, Mus musculus
atatgtatatatacatatct

SEQ ID NO: 214349 - DNA, 19 bp, Mus musculus
tgtgtgtagtattcacata

SEQ ID NO: 214350 - DNA, 23 bp, Mus musculus
aatatatgtatttgtatacgtca

SEQ ID NO: 214351 - DNA, 23 bp, Mus musculus
gtatgtatgtatgtatgtatgta

SEQ ID NO: 214352 - DNA, 23 bp, Mus musculus
ttcacagtgtagatcaatatggt

SEQ ID NO: 214353 - DNA, 18 bp, Mus musculus
tatgtatatatatatgta

SEQ ID NO: 214354 - DNA, 23 bp, Mus musculus
tgtgtgtatgtatgcatgtatat

SEQ ID NO: 214355 - DNA, 23 bp, Mus musculus
ctcacttgatgttctgtcttcct

SEQ ID NO: 214356 - DNA, 18 bp, Mus musculus
ttggtccttacgtagttc

SEQ ID NO: 214357 - DNA, 23 bp, Mus musculus
caggctgtctctgactgtgttga

SEQ ID NO: 214358 - DNA, 23 bp, Mus musculus
atatacctatacatatgtataag

SEQ ID NO: 214359 - DNA, 22 bp, Mus musculus
tttattcatgtttttcatgttg

SEQ ID NO: 214360 - DNA, 21 bp, Mus musculus
tatgagcatgtgcatgagcag

SEQ ID NO: 214361 - DNA, 23 bp, Mus musculus
atatgagtatgtatatgtgtgtg

SEQ ID NO: 214362 - DNA, 23 bp, Mus musculus
aatgtctaagtttttgatggata

SEQ ID NO: 214363 - DNA, 21 bp, Mus musculus
agtgagaaatgagtgtgcaga

SEQ ID NO: 214364 - DNA, 23 bp, Mus musculus
acagagatgagacagagaagaat

SEQ ID NO: 214365 - DNA, 23 bp, Mus musculus
aatatgaacttctggaagtgatg

SEQ ID NO: 214366 - DNA, 23 bp, Mus musculus
ggatagtctgtcaggtgagatgg

SEQ ID NO: 214367 - DNA, 21 bp, Mus musculus
ctccctcagtctctgcctcat

SEQ ID NO: 214368 - DNA, 23 bp, Mus musculus
tgtggtggaacattgtataggtc

SEQ ID NO: 214369 - DNA, 21 bp, Mus musculus
tgttttgtgaccaattctgtg

SEQ ID NO: 214370 - DNA, 23 bp, Mus musculus
taactggaaattttaggtgtgtg

SEQ ID NO: 214371 - DNA, 21 bp, Mus musculus
tctgtagtattttctatagtt

SEQ ID NO: 214372 - DNA, 22 bp, Mus musculus
tgtgtgtgtgtgtgtgcgagcg

SEQ ID NO: 214373 - DNA, 23 bp, Mus musculus
tctgtgtgtgtgtgacactatgc

SEQ ID NO: 214374 - DNA, 20 bp, Mus musculus
tgagggtctgcgagggcttc

SEQ ID NO: 214375 - DNA, 18 bp, Mus musculus
tctctctctctctctata

SEQ ID NO: 214376 - DNA, 23 bp, Mus musculus
tgagtggaagagcacagtttttg

SEQ ID NO: 214377 - DNA, 21 bp, Mus musculus
tcagtctttcagtctctgttc

SEQ ID NO: 214378 - DNA, 22 bp, Mus musculus
ttgtgtatatatgtatatgcat

SEQ ID NO: 214379 - DNA, 23 bp, Mus musculus
tctctctctgtgtctgtctctct

SEQ ID NO: 214380 - DNA, 23 bp, Mus musculus
tatagagttgaatgtaaagtgaa

SEQ ID NO: 214381 - DNA, 22 bp, Mus musculus
tattacagtcaactaagctggg

SEQ ID NO: 214382 - DNA, 23 bp, Mus musculus
gtaaagaaagtccaggcagtggt

SEQ ID NO: 214383 - DNA, 23 bp, Mus musculus
tctcagtactgtttctgtgagtt

SEQ ID NO: 214384 - DNA, 22 bp, Mus musculus
tgttttgtgaccaattatatgg

SEQ ID NO: 214385 - DNA, 22 bp, Mus musculus
aagctgtttgggttacatgtaa

SEQ ID NO: 214386 - DNA, 23 bp, Mus musculus
tgacttgatcctctgggagtctc

SEQ ID NO: 214387 - DNA, 23 bp, Mus musculus
gggtgtgaatatgtatatatgtg

SEQ ID NO: 214388 - DNA, 21 bp, Mus musculus
tctctcttattctcactgaaa

SEQ ID NO: 214389 - DNA, 20 bp, Mus musculus
ttaggggcttgatgatatga

SEQ ID NO: 214390 - DNA, 22 bp, Mus musculus
tgttttgtgaccaattatatgg

SEQ ID NO: 214391 - DNA, 23 bp, Mus musculus
tgtgtgtatacacacacacatat

SEQ ID NO: 214392 - DNA, 19 bp, Mus musculus
tacattagtcagagaggag

SEQ ID NO: 214393 - DNA, 23 bp, Mus musculus
attataccagcatatcttacaag

SEQ ID NO: 214394 - DNA, 23 bp, Mus musculus
tagactactgtgtttgtagctgt

SEQ ID NO: 214395 - DNA, 18 bp, Mus musculus
ggtgtagaaggtgtgcac

SEQ ID NO: 214396 - DNA, 18 bp, Mus musculus
ggtgtagaaggtgtgcac

SEQ ID NO: 214397 - DNA, 19 bp, Mus musculus
cgttgaggatactgtgttg

SEQ ID NO: 214398 - DNA, 19 bp, Mus musculus
ctttgtcttcatgtgggtc

SEQ ID NO: 214399 - DNA, 23 bp, Mus musculus
gactgtctctgactctgttgcct

SEQ ID NO: 214400 - DNA, 21 bp, Mus musculus
aagactagagagatggctcag

SEQ ID NO: 214401 - DNA, 23 bp, Mus musculus
gggttggattcctagcgtttgtg

SEQ ID NO: 214402 - DNA, 23 bp, Mus musculus
actctttaagcatgtctgtgaga

SEQ ID NO: 214403 - DNA, 23 bp, Mus musculus
tcaaatgacagggagctatcaag

SEQ ID NO: 214404 - DNA, 21 bp, Mus musculus
ctttgactcagtgagaactgt

SEQ ID NO: 214405 - DNA, 22 bp, Mus musculus
tctctgcccttctgttcatttt

SEQ ID NO: 214406 - DNA, 21 bp, Mus musculus
ttgggtgaagagaggcagcag

SEQ ID NO: 214407 - DNA, 21 bp, Mus musculus
tgtggatgaatgacagacaga

SEQ ID NO: 214408 - DNA, 23 bp, Mus musculus
gtgtctctttgactctctgtgat

SEQ ID NO: 214409 - DNA, 22 bp, Mus musculus
tgttttgtgaccaattatatgg

SEQ ID NO: 214410 - DNA, 18 bp, Mus musculus
aggcacagacaaagcgca

SEQ ID NO: 214411 - DNA, 22 bp, Mus musculus
tcactgagactgctatgcatca

SEQ ID NO: 214412 - DNA, 21 bp, Mus musculus
cacacacacacatatatatgt

SEQ ID NO: 214413 - DNA, 19 bp, Mus musculus
tgtaatgcaataaggtata

SEQ ID NO: 214414 - DNA, 22 bp, Mus musculus
atctgagcatgatattgtcatt

SEQ ID NO: 214415 - DNA, 23 bp, Mus musculus
tgtgtacatgtttctgtgtgtgt

SEQ ID NO: 214416 - DNA, 21 bp, Mus musculus
tgtgtgatcaaaatataacca

SEQ ID NO: 214417 - DNA, 23 bp, Mus musculus
tctgcctgtctgcctgcctgtct

SEQ ID NO: 214418 - DNA, 23 bp, Mus musculus
ctccaaaggatgtctgtctgtct

SEQ ID NO: 214419 - DNA, 20 bp, Mus musculus
tatatacacatatacatgta

SEQ ID NO: 214420 - DNA, 23 bp, Mus musculus
gtgtatgtatgtatgtgtgtatg

SEQ ID NO: 214421 - DNA, 22 bp, Mus musculus
atatgtgtttatatatatgtgt

SEQ ID NO: 214422 - DNA, 23 bp, Mus musculus
gggtgctgagagaggagagtgat

SEQ ID NO: 214423 - DNA, 23 bp, Mus musculus
aatctccaagattttgttgtgct

SEQ ID NO: 214424 - DNA, 22 bp, Mus musculus
acaatcacaatacagtcttcaa

SEQ ID NO: 214425 - DNA, 20 bp, Mus musculus
atcatacagactatgctgtg

SEQ ID NO: 214426 - DNA, 18 bp, Mus musculus
ttagtcctagatatacca

SEQ ID NO: 214427 - DNA, 22 bp, Mus musculus
atatgtgtgtgtatatatatgt

SEQ ID NO: 214428 - DNA, 18 bp, Mus musculus
ctgtctatctcagtcctt

SEQ ID NO: 214429 - DNA, 23 bp, Mus musculus
ctagtatagagaaaatgttgttg

SEQ ID NO: 214430 - DNA, 23 bp, Mus musculus
tctcactagagtggctgtgacac

SEQ ID NO: 214431 - DNA, 22 bp, Mus musculus
tgtgcatatatatatatatgta

SEQ ID NO: 214432 - DNA, 22 bp, Mus musculus
tattctcattgtgtagttgtca

SEQ ID NO: 214433 - DNA, 22 bp, Mus musculus
gcagtttggtcttcctgtgggt

SEQ ID NO: 214434 - DNA, 23 bp, Mus musculus
aagcagggactgtctctgactct

SEQ ID NO: 214435 - DNA, 23 bp, Mus musculus
aatagtgcgtgtgagagggggtc

SEQ ID NO: 214436 - DNA, 21 bp, Mus musculus
taaaagtctccagggtggggg

SEQ ID NO: 214437 - DNA, 22 bp, Mus musculus
tgttttgtgaccaattatatgg

SEQ ID NO: 214438 - DNA, 22 bp, Mus musculus
tgttttgtgaccaattatatgg

SEQ ID NO: 214439 - DNA, 23 bp, Mus musculus
ttaattgtccttctggtggacac

SEQ ID NO: 214440 - DNA, 22 bp, Mus musculus
tgttttgtgaccaattatatgg

SEQ ID NO: 214441 - DNA, 18 bp, Mus musculus
gagcagcgctgtttacct

SEQ ID NO: 214442 - DNA, 20 bp, Mus musculus
tgatatgtatgtatgtatgt

SEQ ID NO: 214443 - DNA, 21 bp, Mus musculus
ttattggccttcgtagatgtc

SEQ ID NO: 214444 - DNA, 23 bp, Mus musculus
tctctcagcctctctctctctct

SEQ ID NO: 214445 - DNA, 23 bp, Mus musculus
tcacccactgagtcactggtgac

SEQ ID NO: 214446 - DNA, 23 bp, Mus musculus
cacacagacactcaaatggcatc

SEQ ID NO: 214447 - DNA, 23 bp, Mus musculus
actggggctgttgagatggctca

SEQ ID NO: 214448 - DNA, 19 bp, Mus musculus
tgtctctctacctgcatgc

SEQ ID NO: 214449 - DNA, 21 bp, Mus musculus
tctatgtctcatttggtaggc

SEQ ID NO: 214450 - DNA, 20 bp, Mus musculus
tgtgtgtgtgtgtcagtggg

SEQ ID NO: 214451 - DNA, 19 bp, Mus musculus
tcagcttttgagactaatc

SEQ ID NO: 214452 - DNA, 22 bp, Mus musculus
tgcaaggatcatgatgctagaa

SEQ ID NO: 214453 - DNA, 23 bp, Mus musculus
gatatctcatttctggctgagtg

SEQ ID NO: 214454 - DNA, 23 bp, Mus musculus
attgcatgtatatatgtatgtat

SEQ ID NO: 214455 - DNA, 23 bp, Mus musculus
ggcagagagtaaagagagtccac

SEQ ID NO: 214456 - DNA, 22 bp, Mus musculus
tgttttgtgaccaattatatgg

SEQ ID NO: 214457 - DNA, 23 bp, Mus musculus
tgattggacttcagtgggagaga

SEQ ID NO: 214458 - DNA, 23 bp, Mus musculus
ctgccaatcactcactcactcac

SEQ ID NO: 214459 - DNA, 23 bp, Mus musculus
tagtccatggtgatctgatagga

SEQ ID NO: 214460 - DNA, 23 bp, Mus musculus
tttttgtatctgttgaggcttgt

SEQ ID NO: 214461 - DNA, 23 bp, Mus musculus
tgtgtctctgtgtgtgtacgtgc

SEQ ID NO: 214462 - DNA, 22 bp, Mus musculus
tttgtgagcttttccagaggct

SEQ ID NO: 214463 - DNA, 19 bp, Mus musculus
agagggtggttgggtggtt

SEQ ID NO: 214464 - DNA, 23 bp, Mus musculus
tgcctgcctgcctgcatgcctgt

SEQ ID NO: 214465 - DNA, 23 bp, Mus musculus
agtggagggagatctcactgttg

SEQ ID NO: 214466 - DNA, 22 bp, Mus musculus
tgtgtcagcaaagtgtctcatt

SEQ ID NO: 214467 - DNA, 21 bp, Mus musculus
tgtgatcaatgtgacatgcat

SEQ ID NO: 214468 - DNA, 23 bp, Mus musculus
atgtatgcatgtttgtatgagtg

SEQ ID NO: 214469 - DNA, 20 bp, Mus musculus
aatcctccaggttctgtata

SEQ ID NO: 214470 - DNA, 23 bp, Mus musculus
atgtctgttcttatgtattggtt

SEQ ID NO: 214471 - DNA, 23 bp, Mus musculus
tgtatgtatgtatgtatgtatgt

SEQ ID NO: 214472 - DNA, 18 bp, Mus musculus
aggtatgtatatatgtat

SEQ ID NO: 214473 - DNA, 23 bp, Mus musculus
gtgtttgtgtgtgcatgtgcatg

SEQ ID NO: 214474 - DNA, 23 bp, Mus musculus
tttaaggatgtattacatttatc

SEQ ID NO: 214475 - DNA, 23 bp, Mus musculus
ataagtatatatgtatatgtgta

SEQ ID NO: 214476 - DNA, 21 bp, Mus musculus
tgtacatatatatacatatgt

SEQ ID NO: 214477 - DNA, 23 bp, Mus musculus
ttagtgtctctgctttgacagtg

SEQ ID NO: 214478 - DNA, 23 bp, Mus musculus
tgcgtgtatgtgtctctgtgtgt

SEQ ID NO: 214479 - DNA, 23 bp, Mus musculus
aaggctactgatttatttgagtt

SEQ ID NO: 214480 - DNA, 22 bp, Mus musculus
tgttttgtgaccaattatatgg

SEQ ID NO: 214481 - DNA, 23 bp, Mus musculus
tcagtgacagaaaagtgagatca

SEQ ID NO: 214482 - DNA, 19 bp, Mus musculus
tatgtctgtattattaggc

SEQ ID NO: 214483 - DNA, 21 bp, Mus musculus
atgagagggatgtgatgaggt

SEQ ID NO: 214484 - DNA, 18 bp, Mus musculus
tatagcatgactttcatt

SEQ ID NO: 214485 - DNA, 23 bp, Mus musculus
atgtgtgggtgtgtgtgcgcgag

SEQ ID NO: 214486 - DNA, 22 bp, Mus musculus
acataaacatttgccaaagcat

SEQ ID NO: 214487 - DNA, 20 bp, Mus musculus
tgtgtatatatgtatatatg

SEQ ID NO: 214488 - DNA, 23 bp, Mus musculus
attacagctgagcctggaagctg

SEQ ID NO: 214489 - DNA, 22 bp, Mus musculus
tgactcactctctgtatcttct

SEQ ID NO: 214490 - DNA, 23 bp, Mus musculus
aagtcacagaagagtctgtgctc

SEQ ID NO: 214491 - DNA, 23 bp, Mus musculus
tattttattctgaaatggaaagt

SEQ ID NO: 214492 - DNA, 20 bp, Mus musculus
tgtgtgtgtgtgtgtataca

SEQ ID NO: 214493 - DNA, 21 bp, Mus musculus
tgtatgtgtatgcatatgatg

SEQ ID NO: 214494 - DNA, 21 bp, Mus musculus
attatgtatatgatgtatatg

SEQ ID NO: 214495 - DNA, 19 bp, Mus musculus
gtatatatatatgtgtgtg

SEQ ID NO: 214496 - DNA, 23 bp, Mus musculus
ctatgtccatgtcctttgctgct

SEQ ID NO: 214497 - DNA, 22 bp, Mus musculus
tgttttgtgaccaattatatgg

SEQ ID NO: 214498 - DNA, 22 bp, Mus musculus
tgttttgtgaccaattatatgg

SEQ ID NO: 214499 - DNA, 23 bp, Mus musculus
tctctgctccacactttgtctct

SEQ ID NO: 214500 - DNA, 22 bp, Mus musculus
tgttttgtgaccaattatatgg

SEQ ID NO: 214501 - DNA, 23 bp, Mus musculus
ttttttctaagcaaggacagtgt

SEQ ID NO: 214502 - DNA, 23 bp, Mus musculus
tatgtggttaattttggagaatg

SEQ ID NO: 214503 - DNA, 23 bp, Mus musculus
tctatctcactgacaaatccctc

SEQ ID NO: 214504 - DNA, 23 bp, Mus musculus
tgctgacagaagagagtctgtgg

SEQ ID NO: 214505 - DNA, 22 bp, Mus musculus
tgttttgtgaccaattatatgg

SEQ ID NO: 214506 - DNA, 23 bp, Mus musculus
acagacagacagattcttgtttg

SEQ ID NO: 214507 - DNA, 23 bp, Mus musculus
tttatctgtatctgatttgggat

SEQ ID NO: 214508 - DNA, 22 bp, Mus musculus
tgttttgtgaccaattatatgg

SEQ ID NO: 214509 - DNA, 22 bp, Mus musculus
tgtgtgtatatatatatgtgtg

SEQ ID NO: 214510 - DNA, 22 bp, Mus musculus
tgttttgtgaccaattatatgg

SEQ ID NO: 214511 - DNA, 21 bp, Mus musculus
agttctcattttctttaactg

SEQ ID NO: 214512 - DNA, 22 bp, Mus musculus
tgttttgtgaccaattatatgg

SEQ ID NO: 214513 - DNA, 22 bp, Mus musculus
tgtgtgtatatatatatgtgtg

SEQ ID NO: 214514 - DNA, 22 bp, Mus musculus
tgttttgtgaccaattatatgg

SEQ ID NO: 214515 - DNA, 21 bp, Mus musculus
agttctcattttctttaactg

SEQ ID NO: 214516 - DNA, 23 bp, Mus musculus
atgtgtgtctgggtgtgtattca

SEQ ID NO: 214517 - DNA, 23 bp, Mus musculus
tcagactcagtgtgtctagtttt

SEQ ID NO: 214518 - DNA, 22 bp, Mus musculus
tgttttgtgaccaattatatgg

SEQ ID NO: 214519 - DNA, 23 bp, Mus musculus
ggaatgtaaagttgttgcaacac

SEQ ID NO: 214520 - DNA, 19 bp, Mus musculus
tttatctgctattttttgt

SEQ ID NO: 214521 - DNA, 23 bp, Mus musculus
tatcagtctttggccatggtggt

SEQ ID NO: 214522 - DNA, 23 bp, Mus musculus
tcatgtgtgagtttatgcatgtg

SEQ ID NO: 214523 - DNA, 23 bp, Mus musculus
atgtctatgtctatgtctgtgtc

SEQ ID NO: 214524 - DNA, 23 bp, Mus musculus
tgttttgtgacctattatgttgt

SEQ ID NO: 214525 - DNA, 23 bp, Mus musculus
tcaatccactaaatgtatatatg

SEQ ID NO: 214526 - DNA, 23 bp, Mus musculus
ttagtgactcagtgtctgagaga

SEQ ID NO: 214527 - DNA, 21 bp, Mus musculus
taatgttttaggttgaattca

SEQ ID NO: 214528 - DNA, 23 bp, Mus musculus
cagagtatgtgtgtgtctgtgtg

SEQ ID NO: 214529 - DNA, 23 bp, Mus musculus
aaaaatgttattgactaaagtaa

SEQ ID NO: 214530 - DNA, 23 bp, Mus musculus
ttgtttcctcatgttttgtgtct

SEQ ID NO: 214531 - DNA, 23 bp, Mus musculus
tatgaatatatatgtatatgtac

SEQ ID NO: 214532 - DNA, 23 bp, Mus musculus
tatgtgtatatatatgtatgtag

SEQ ID NO: 214533 - DNA, 23 bp, Mus musculus
tagtgcatggtgatctgatagga

SEQ ID NO: 214534 - DNA, 22 bp, Mus musculus
tgttttgtgacctattatgtgg

SEQ ID NO: 214535 - DNA, 23 bp, Mus musculus
tgcggttatgatatgtaatcaag

SEQ ID NO: 214536 - DNA, 22 bp, Mus musculus
tttctctggctctgtctcccgc

SEQ ID NO: 214537 - DNA, 20 bp, Mus musculus
cttagtccatggtgatttga

SEQ ID NO: 214538 - DNA, 20 bp, Mus musculus
gagagagagagagagagaga

SEQ ID NO: 214539 - DNA, 23 bp, Mus musculus
ttgtctctgtctctctatgcctc

SEQ ID NO: 214540 - DNA, 23 bp, Mus musculus
cacagtgggtgcagtgagtgcag

SEQ ID NO: 214541 - DNA, 23 bp, Mus musculus
tacagtgcagtgagtgcagtgag

SEQ ID NO: 214542 - DNA, 23 bp, Mus musculus
gcagtgagtgcagtgagtgcagt

SEQ ID NO: 214543 - DNA, 21 bp, Mus musculus
taaaacatacattatgtattg

SEQ ID NO: 214544 - DNA, 18 bp, Mus musculus
tagaaagtttaattgtag

SEQ ID NO: 214545 - DNA, 23 bp, Mus musculus
aggtcagaggcttacatctccat

SEQ ID NO: 214546 - DNA, 23 bp, Mus musculus
atatgtgtgtatgtatatgtgag

SEQ ID NO: 214547 - DNA, 23 bp, Mus musculus
tttcactatcttttggtttgagt

SEQ ID NO: 214548 - DNA, 23 bp, Mus musculus
tctgtgagtatctgcatctgtat

SEQ ID NO: 214549 - DNA, 23 bp, Mus musculus
tgtgtgtgtatatgtgtatgtgt

SEQ ID NO: 214550 - DNA, 22 bp, Mus musculus
taagggtgtggtactttggaca

SEQ ID NO: 214551 - DNA, 23 bp, Mus musculus
tagtccatggtgatctgatagga

SEQ ID NO: 214552 - DNA, 22 bp, Mus musculus
tgttttgtgaccaactatatgg

SEQ ID NO: 214553 - DNA, 19 bp, Mus musculus
ttattgattatatagcaat

SEQ ID NO: 214554 - DNA, 22 bp, Mus musculus
acatgtgtgagtgtatgtctgt

SEQ ID NO: 214555 - DNA, 23 bp, Mus musculus
tgtatgtatatgtatgtgtatac

SEQ ID NO: 214556 - DNA, 23 bp, Mus musculus
catttatacagtgttttctgtag

SEQ ID NO: 214557 - DNA, 23 bp, Mus musculus
atatgtgtatgtgtatatgtata

SEQ ID NO: 214558 - DNA, 23 bp, Mus musculus
agtcagcctcactctctggcagc

SEQ ID NO: 214559 - DNA, 18 bp, Mus musculus
taatggctgtattgccaa

SEQ ID NO: 214560 - DNA, 23 bp, Mus musculus
aagaaatgtatttgtttatctga

SEQ ID NO: 214561 - DNA, 23 bp, Mus musculus
atgtgtatatatgtatatgtgtg

SEQ ID NO: 214562 - DNA, 23 bp, Mus musculus
tgtatgtgtatatgtatatatgt

SEQ ID NO: 214563 - DNA, 23 bp, Mus musculus
ctgtgtctctgtttagtttctgt

SEQ ID NO: 214564 - DNA, 23 bp, Mus musculus
aggatctgtccattgatgagagt

SEQ ID NO: 214565 - DNA, 20 bp, Mus musculus
tactgtatttatatctatgt

SEQ ID NO: 214566 - DNA, 23 bp, Mus musculus
tatgtatatgtatatgtatatga

SEQ ID NO: 214567 - DNA, 19 bp, Mus musculus
tgtatgtatgtatatatgt

SEQ ID NO: 214568 - DNA, 23 bp, Mus musculus
tgtacgtatgtatgtatgtatgt

SEQ ID NO: 214569 - DNA, 23 bp, Mus musculus
actacactacagagtgtggtgaa

SEQ ID NO: 214570 - DNA, 19 bp, Mus musculus
atatatgtatatgtgtaag

SEQ ID NO: 214571 - DNA, 22 bp, Mus musculus
aatggaacttgaaccagtcctc

SEQ ID NO: 214572 - DNA, 22 bp, Mus musculus
tgacatctagtcctgcaacatg

SEQ ID NO: 214573 - DNA, 23 bp, Mus musculus
actcagtgggagagttctgtctg

SEQ ID NO: 214574 - DNA, 23 bp, Mus musculus
tgcgtgcgtgcgtgcgtgtgtgt

SEQ ID NO: 214575 - DNA, 18 bp, Mus musculus
atacatatgatatatgtg

SEQ ID NO: 214576 - DNA, 23 bp, Mus musculus
tcaatttcataatctgtctgaag

SEQ ID NO: 214577 - DNA, 23 bp, Mus musculus
tgactggagtctgtgacaacatt

SEQ ID NO: 214578 - DNA, 22 bp, Mus musculus
tgttttgtgaccaattatatgg

SEQ ID NO: 214579 - DNA, 23 bp, Mus musculus
agtctacagtctatcttgatctc

SEQ ID NO: 214580 - DNA, 19 bp, Mus musculus
gggatttgatgaaggcatc

SEQ ID NO: 214581 - DNA, 19 bp, Mus musculus
ttgtgggtctctgttttag

SEQ ID NO: 214582 - DNA, 23 bp, Mus musculus
tacatcagtgagactcttcctag

SEQ ID NO: 214583 - DNA, 23 bp, Mus musculus
actggctcagtgcctgatttgtg

SEQ ID NO: 214584 - DNA, 23 bp, Mus musculus
acctggaaggttgtttagtactt

SEQ ID NO: 214585 - DNA, 23 bp, Mus musculus
atgcatgtgttgtgatattgttg

SEQ ID NO: 214586 - DNA, 22 bp, Mus musculus
agagcaagcacagtgtatatgt

SEQ ID NO: 214587 - DNA, 21 bp, Mus musculus
tgtgtgagcattcattatctc

SEQ ID NO: 214588 - DNA, 22 bp, Mus musculus
tgttttgtgaccaattatatgg

SEQ ID NO: 214589 - DNA, 18 bp, Mus musculus
atatgatgtagagtgatt

SEQ ID NO: 214590 - DNA, 22 bp, Mus musculus
aaatggatgttaagataagctt

SEQ ID NO: 214591 - DNA, 22 bp, Mus musculus
ttatagctatgttttgtagaag

SEQ ID NO: 214592 - DNA, 22 bp, Mus musculus
tgttttgtgaccaattatatgg

SEQ ID NO: 214593 - DNA, 23 bp, Mus musculus
aatgtgtgtgtatgtatacatat

SEQ ID NO: 214594 - DNA, 23 bp, Mus musculus
tagtccatggtgatctgatagga

SEQ ID NO: 214595 - DNA, 22 bp, Mus musculus
tgttttgtgaccaattatatgg

SEQ ID NO: 214596 - DNA, 22 bp, Mus musculus
tgttttgtgaccaattatatgg

SEQ ID NO: 214597 - DNA, 22 bp, Mus musculus
tgtgcttctcaacatttgcagc

SEQ ID NO: 214598 - DNA, 19 bp, Mus musculus
ttaatggagcttttcttgt

SEQ ID NO: 214599 - DNA, 23 bp, Mus musculus
aatatttttgtatctgttgaagg

SEQ ID NO: 214600 - DNA, 22 bp, Mus musculus
cagtctctcccactgagaccag

SEQ ID NO: 214601 - DNA, 23 bp, Mus musculus
tgagtttttgatcttagcaattc

SEQ ID NO: 214602 - DNA, 23 bp, Mus musculus
gttctgagtggtactggttagtc

SEQ ID NO: 214603 - DNA, 23 bp, Mus musculus
caggctcagtctctgtgcctgtg

SEQ ID NO: 214604 - DNA, 23 bp, Mus musculus
tgatctgaatatttttatgtata

SEQ ID NO: 214605 - DNA, 18 bp, Mus musculus
acacttcagcttgctcac

SEQ ID NO: 214606 - DNA, 23 bp, Mus musculus
ggcatcctgcagtgcaaatttcc

SEQ ID NO: 214607 - DNA, 23 bp, Mus musculus
ttcaagtacaaggttgaataggt

SEQ ID NO: 214608 - DNA, 22 bp, Mus musculus
aaagtggacagccttgtctagt

SEQ ID NO: 214609 - DNA, 21 bp, Mus musculus
agcagattttgcattcttgtt

SEQ ID NO: 214610 - DNA, 23 bp, Mus musculus
taacagtctcctgttgcagagag

SEQ ID NO: 214611 - DNA, 23 bp, Mus musculus
tctgccactggcagtcttcagaa

SEQ ID NO: 214612 - DNA, 20 bp, Mus musculus
aacagcaggagcaggggctc

SEQ ID NO: 214613 - DNA, 23 bp, Mus musculus
gcctgcctgcctgcctgcctgcc

SEQ ID NO: 214614 - DNA, 21 bp, Mus musculus
actgactgactgtcacatgag

SEQ ID NO: 214615 - DNA, 23 bp, Mus musculus
ttacaggcactgagatgtataga

SEQ ID NO: 214616 - DNA, 21 bp, Mus musculus
aacaggttggtgtcctctatc

SEQ ID NO: 214617 - DNA, 22 bp, Mus musculus
ggacacctctctcactgtcagc

SEQ ID NO: 214618 - DNA, 23 bp, Mus musculus
aagatctgagaacagagtgtggg

SEQ ID NO: 214619 - DNA, 23 bp, Mus musculus
tatatgcatatatatgtgtatgt

SEQ ID NO: 214620 - DNA, 23 bp, Mus musculus
tactcattgattggttaggcaga

SEQ ID NO: 214621 - DNA, 20 bp, Mus musculus
tgaccatctatgtttaccag

SEQ ID NO: 214622 - DNA, 22 bp, Mus musculus
tgtcactctctgcttatcttca

SEQ ID NO: 214623 - DNA, 23 bp, Mus musculus
atgataaagataatgtatcccac

SEQ ID NO: 214624 - DNA, 23 bp, Mus musculus
ttatatgtacatatacatgtatg

SEQ ID NO: 214625 - DNA, 20 bp, Mus musculus
tattcacacatgaatatatg

SEQ ID NO: 214626 - DNA, 23 bp, Mus musculus
tttagtgtgtgcatttgcacact

SEQ ID NO: 214627 - DNA, 22 bp, Mus musculus
tgttttgtgaccaattatatgg

SEQ ID NO: 214628 - DNA, 21 bp, Mus musculus
acagtggtttttctatgactc

SEQ ID NO: 214629 - DNA, 23 bp, Mus musculus
gtatgtatgcatgtatgtgtaca

SEQ ID NO: 214630 - DNA, 23 bp, Mus musculus
tgtgtgtgtatgcatatgtgtgc

SEQ ID NO: 214631 - DNA, 23 bp, Mus musculus
cacttcagtctctgtgagcccct

SEQ ID NO: 214632 - DNA, 19 bp, Mus musculus
aatgatgctgactgagcct

SEQ ID NO: 214633 - DNA, 23 bp, Mus musculus
gtacatgtacatgtgcacgtgca

SEQ ID NO: 214634 - DNA, 23 bp, Mus musculus
atcactactggaggagctagaga

SEQ ID NO: 214635 - DNA, 18 bp, Mus musculus
ttacactcagattccaca

SEQ ID NO: 214636 - DNA, 23 bp, Mus musculus
tgtgtgtctgtttgtcattcatc

SEQ ID NO: 214637 - DNA, 23 bp, Mus musculus
cctgcctgcctgcctgcctgtct

SEQ ID NO: 214638 - DNA, 23 bp, Mus musculus
taagagcactgactgctcctcca

SEQ ID NO: 214639 - DNA, 23 bp, Mus musculus
tatatgtatatgtatagtatgtg

SEQ ID NO: 214640 - DNA, 23 bp, Mus musculus
agtgcctctgactgactggctgg

SEQ ID NO: 214641 - DNA, 18 bp, Mus musculus
gctaagttgatttgggtt

SEQ ID NO: 214642 - DNA, 19 bp, Mus musculus
gagacactctcacagtgtc

SEQ ID NO: 214643 - DNA, 18 bp, Mus musculus
tgtatgtatgtatgtttg

SEQ ID NO: 214644 - DNA, 23 bp, Mus musculus
ctgagcctgtgtgactatggaat

SEQ ID NO: 214645 - DNA, 18 bp, Mus musculus
gatgagacacagtgctca

SEQ ID NO: 214646 - DNA, 23 bp, Mus musculus
atgtgagaacataatgtgctcac

SEQ ID NO: 214647 - DNA, 23 bp, Mus musculus
ttctcagctgtgtctctctcagc

SEQ ID NO: 214648 - DNA, 23 bp, Mus musculus
tcagagaagtgactgtggaatgg

SEQ ID NO: 214649 - DNA, 23 bp, Mus musculus
atgtccatccttgaactcactgt

SEQ ID NO: 214650 - DNA, 23 bp, Mus musculus
tgcttagttctgtctctgtctta

SEQ ID NO: 214651 - DNA, 23 bp, Mus musculus
tctctgtgtgctagtggatggga

SEQ ID NO: 214652 - DNA, 18 bp, Mus musculus
aagtatattatatgtaat

SEQ ID NO: 214653 - DNA, 21 bp, Mus musculus
attcactcactgagttttgct

SEQ ID NO: 214654 - DNA, 22 bp, Mus musculus
tttttgctatagattagagatt

SEQ ID NO: 214655 - DNA, 22 bp, Mus musculus
ttgaacactccatagcagtgga

SEQ ID NO: 214656 - DNA, 21 bp, Mus musculus
caacccttaggacttaggagt

SEQ ID NO: 214657 - DNA, 23 bp, Mus musculus
tcttaagttccacttctcttatt

SEQ ID NO: 214658 - DNA, 21 bp, Mus musculus
tgactggagtgagtgtcatct

SEQ ID NO: 214659 - DNA, 18 bp, Mus musculus
tgtatatgtatgtgtgta

SEQ ID NO: 214660 - DNA, 21 bp, Mus musculus
atacacacacatatatgtgtg

SEQ ID NO: 214661 - DNA, 22 bp, Mus musculus
atgtgtatatatatgtgtgtgt

SEQ ID NO: 214662 - DNA, 23 bp, Mus musculus
tatgtatgtgtgtatatatgtgt

SEQ ID NO: 214663 - DNA, 23 bp, Mus musculus
ctctgcctgtgtctcagaggaag

SEQ ID NO: 214664 - DNA, 23 bp, Mus musculus
agacaggagagtctgagcagtga

SEQ ID NO: 214665 - DNA, 23 bp, Mus musculus
tgagtgaacaaagagaggtctgg

SEQ ID NO: 214666 - DNA, 23 bp, Mus musculus
tgtgtgtatatatgtatgtgtgt

SEQ ID NO: 214667 - DNA, 23 bp, Mus musculus
aaggtaaaagtggattagatgag

SEQ ID NO: 214668 - DNA, 22 bp, Mus musculus
tccctcacttctggtggaagtg

SEQ ID NO: 214669 - DNA, 23 bp, Mus musculus
atctgagtgtgatgagtgtctgc

SEQ ID NO: 214670 - DNA, 23 bp, Mus musculus
tttatgtccagcatatgcatgta

SEQ ID NO: 214671 - DNA, 21 bp, Mus musculus
tctgtgtatttctctgtgtgt

SEQ ID NO: 214672 - DNA, 23 bp, Mus musculus
tgtgtatgtgcatgtgtatatgt

SEQ ID NO: 214673 - DNA, 23 bp, Mus musculus
ttatatgtatatgtatatgtgtg

SEQ ID NO: 214674 - DNA, 23 bp, Mus musculus
gggtgtctctgtctctgcctccc

SEQ ID NO: 214675 - DNA, 18 bp, Mus musculus
agactgttgtaagcaagt

SEQ ID NO: 214676 - DNA, 23 bp, Mus musculus
atatgtatatatgtatatgtgtg

SEQ ID NO: 214677 - DNA, 20 bp, Mus musculus
atatatgtacatatatatgt

SEQ ID NO: 214678 - DNA, 23 bp, Mus musculus
tctctctgtgtgcctgtgtatct

SEQ ID NO: 214679 - DNA, 23 bp, Mus musculus
tcctagtctcctgattttgttga

SEQ ID NO: 214680 - DNA, 23 bp, Mus musculus
aatgaaaagctgttggtgagctg

SEQ ID NO: 214681 - DNA, 23 bp, Mus musculus
tgagtgtgtacacatgtgtgtgc

SEQ ID NO: 214682 - DNA, 20 bp, Mus musculus
gatatttgggttgaaaacat

SEQ ID NO: 214683 - DNA, 19 bp, Mus musculus
tccaggtaatatttgattg

SEQ ID NO: 214684 - DNA, 23 bp, Mus musculus
tatgtgtatatatatatgtatgt

SEQ ID NO: 214685 - DNA, 22 bp, Mus musculus
acagttgcttctaatctcttgt

SEQ ID NO: 214686 - DNA, 21 bp, Mus musculus
atgaatgtgtgcatgtgcatg

SEQ ID NO: 214687 - DNA, 20 bp, Mus musculus
cctgtccctcagtctcccag

SEQ ID NO: 214688 - DNA, 23 bp, Mus musculus
gtgtgtgcatgttcatgcatgtg

SEQ ID NO: 214689 - DNA, 22 bp, Mus musculus
tacacgtgcatgagctgtgtgt

SEQ ID NO: 214690 - DNA, 21 bp, Mus musculus
tgtgtgcatgtgtatgtgcat

SEQ ID NO: 214691 - DNA, 20 bp, Mus musculus
atttgcatgcatatgtattc

SEQ ID NO: 214692 - DNA, 19 bp, Mus musculus
acaggccctgaagaagagg

SEQ ID NO: 214693 - DNA, 21 bp, Mus musculus
tgtatatatacatatgtgtat

SEQ ID NO: 214694 - DNA, 23 bp, Mus musculus
atgtatgtgcatatgtatgtata

SEQ ID NO: 214695 - DNA, 18 bp, Mus musculus
agggggagttgagatgct

SEQ ID NO: 214696 - DNA, 22 bp, Mus musculus
tttcagagtctttttctctgtg

SEQ ID NO: 214697 - DNA, 23 bp, Mus musculus
tgtgtgtgtgtgtgtgtgcatgt

SEQ ID NO: 214698 - DNA, 20 bp, Mus musculus
tcacagcatgcatgtgaaag

SEQ ID NO: 214699 - DNA, 22 bp, Mus musculus
tgttctagggattgaagttagg

SEQ ID NO: 214700 - DNA, 23 bp, Mus musculus
ctgctgagagagtgaacagtgtg

SEQ ID NO: 214701 - DNA, 22 bp, Mus musculus
ggaatagatctgcatcaagttc

SEQ ID NO: 214702 - DNA, 22 bp, Mus musculus
atgagatcatattatgttctac

SEQ ID NO: 214703 - DNA, 23 bp, Mus musculus
tgcatatgagatcacattatgct

SEQ ID NO: 214704 - DNA, 22 bp, Mus musculus
tgttttgtgaccaattatatgg

SEQ ID NO: 214705 - DNA, 21 bp, Mus musculus
gtctctgtgtgtgtgtgcatg

SEQ ID NO: 214706 - DNA, 22 bp, Mus musculus
acatatgcatatgtatagatat

SEQ ID NO: 214707 - DNA, 23 bp, Mus musculus
aagtgtgtgtgcatgtgcatgtg

SEQ ID NO: 214708 - DNA, 23 bp, Mus musculus
tctctttggttatgttcctttag

SEQ ID NO: 214709 - DNA, 22 bp, Mus musculus
taaggaggacataaagagggta

SEQ ID NO: 214710 - DNA, 23 bp, Mus musculus
tctatgcatgtacatatgtgtat

SEQ ID NO: 214711 - DNA, 19 bp, Mus musculus
tatatctatgtgtataggt

SEQ ID NO: 214712 - DNA, 22 bp, Mus musculus
tgttttgtgaccaattatatgg

SEQ ID NO: 214713 - DNA, 22 bp, Mus musculus
tgttttgtgaccaattatatgg

SEQ ID NO: 214714 - DNA, 22 bp, Mus musculus
aagagcacagactgatcttcca

SEQ ID NO: 214715 - DNA, 23 bp, Mus musculus
tggctcagaggctaagagcactg

SEQ ID NO: 214716 - DNA, 19 bp, Mus musculus
cagaggtcctgagttcaat

SEQ ID NO: 214717 - DNA, 20 bp, Mus musculus
aaacacagccagttttcttc

SEQ ID NO: 214718 - DNA, 22 bp, Mus musculus
agatgattttttttctagaatt

SEQ ID NO: 214719 - DNA, 20 bp, Mus musculus
aaagaaagctgtcagaggct

SEQ ID NO: 214720 - DNA, 20 bp, Mus musculus
tctgcctgcttgtctgtctt

SEQ ID NO: 214721 - DNA, 21 bp, Mus musculus
taacttggtctttatcctgtt

SEQ ID NO: 214722 - DNA, 23 bp, Mus musculus
gtgaaaacagcctagaggcaaag

SEQ ID NO: 214723 - DNA, 23 bp, Mus musculus
atttttgttttgaaagctttcac

SEQ ID NO: 214724 - DNA, 23 bp, Mus musculus
gtcacagagcagagtcagcatcc

SEQ ID NO: 214725 - DNA, 23 bp, Mus musculus
ttcaggatgtagattgaatagtg

SEQ ID NO: 214726 - DNA, 23 bp, Mus musculus
tgtgcctgtgtgcctctctgtgt

SEQ ID NO: 214727 - DNA, 19 bp, Mus musculus
tccgcctggattcatctgc

SEQ ID NO: 214728 - DNA, 23 bp, Mus musculus
aggtgagtgtcaggagagactgg

SEQ ID NO: 214729 - DNA, 23 bp, Mus musculus
caagtcctgacactggaggactt

SEQ ID NO: 214730 - DNA, 22 bp, Mus musculus
tgttttgtgaccaattatatgg

SEQ ID NO: 214731 - DNA, 19 bp, Mus musculus
tttctctctccatctctct

SEQ ID NO: 214732 - DNA, 20 bp, Mus musculus
tgcatgtatgtatgtatgta

SEQ ID NO: 214733 - DNA, 22 bp, Mus musculus
tgttttgtgaccaattatatgg

SEQ ID NO: 214734 - DNA, 20 bp, Mus musculus
aactacttggcttggtctgt

SEQ ID NO: 214735 - DNA, 18 bp, Mus musculus
tgacagtgcagacagggc

SEQ ID NO: 214736 - DNA, 21 bp, Mus musculus
atgtgtatgtgcatgtgcatg

SEQ ID NO: 214737 - DNA, 22 bp, Mus musculus
atcctacattgtggtaggacat

SEQ ID NO: 214738 - DNA, 22 bp, Mus musculus
ttagtagtgttgacatggcttt

SEQ ID NO: 214739 - DNA, 23 bp, Mus musculus
tactagtttagcattggtaatca

SEQ ID NO: 214740 - DNA, 22 bp, Mus musculus
tgtatgtatgtatgcatgtata

SEQ ID NO: 214741 - DNA, 23 bp, Mus musculus
ctgacagagactggaactgcact

SEQ ID NO: 214742 - DNA, 23 bp, Mus musculus
aaaagtacacaggcacaatgaag

SEQ ID NO: 214743 - DNA, 23 bp, Mus musculus
tagctcagtggttgagatctgaa

SEQ ID NO: 214744 - DNA, 21 bp, Mus musculus
tttgtgtagctcaaaagcttg

SEQ ID NO: 214745 - DNA, 23 bp, Mus musculus
cttgtctcagactcactaagtaa

SEQ ID NO: 214746 - DNA, 23 bp, Mus musculus
tgatgttgcaggtcttgcagctg

SEQ ID NO: 214747 - DNA, 18 bp, Mus musculus
acaggctcatgagctggt

SEQ ID NO: 214748 - DNA, 23 bp, Mus musculus
cttcacactcaggctgtgacact

SEQ ID NO: 214749 - DNA, 18 bp, Mus musculus
tgcatgtatgtatatatg

SEQ ID NO: 214750 - DNA, 23 bp, Mus musculus
tgtatgtgtgtgtgtacatgtat

SEQ ID NO: 214751 - DNA, 21 bp, Mus musculus
tgtgagtgtgttacctggggc

SEQ ID NO: 214752 - DNA, 19 bp, Mus musculus
agtggctccctgcctgcct

SEQ ID NO: 214753 - DNA, 21 bp, Mus musculus
agtgagctagtcagatccacc

SEQ ID NO: 214754 - DNA, 23 bp, Mus musculus
cctgcctgaagatgtgtttgtat

SEQ ID NO: 214755 - DNA, 22 bp, Mus musculus
agagctttagaagatgggatca

SEQ ID NO: 214756 - DNA, 23 bp, Mus musculus
tctggctctcagtctcttctcca

SEQ ID NO: 214757 - DNA, 21 bp, Mus musculus
aaagctttaagagctagaaca

SEQ ID NO: 214758 - DNA, 18 bp, Mus musculus
ctctgtgtttgatggatg

SEQ ID NO: 214759 - DNA, 23 bp, Mus musculus
caacgatgcttaagtatatgcca

SEQ ID NO: 214760 - DNA, 19 bp, Mus musculus
cctagaccacaagctccag

SEQ ID NO: 214761 - DNA, 23 bp, Mus musculus
agtcccttgagacaatgtctata

SEQ ID NO: 214762 - DNA, 23 bp, Mus musculus
tgactccctctgtggcatttgtg

SEQ ID NO: 214763 - DNA, 22 bp, Mus musculus
tgggtcacacgcactgactgag

SEQ ID NO: 214764 - DNA, 22 bp, Mus musculus
gctgttcatttgtttggctggt

SEQ ID NO: 214765 - DNA, 22 bp, Mus musculus
actccagccaggataagtgtca

SEQ ID NO: 214766 - DNA, 22 bp, Mus musculus
tgttttgtgaccaattatatgg

SEQ ID NO: 214767 - DNA, 22 bp, Mus musculus
catctattcctgcctctgagtc

SEQ ID NO: 214768 - DNA, 23 bp, Mus musculus
tttctttagcaaagaggaatgct

SEQ ID NO: 214769 - DNA, 23 bp, Mus musculus
ttttttttcttcttctggagttg

SEQ ID NO: 214770 - DNA, 23 bp, Mus musculus
ctcaaagagactgagtgactgag

SEQ ID NO: 214771 - DNA, 18 bp, Mus musculus
tgtgcatgcatgtgcatg

SEQ ID NO: 214772 - DNA, 19 bp, Mus musculus
atctatctatagatgatag

SEQ ID NO: 214773 - DNA, 19 bp, Mus musculus
cagaacagagacaggtctc

SEQ ID NO: 214774 - DNA, 20 bp, Mus musculus
acacacacagatatatatgt

SEQ ID NO: 214775 - DNA, 23 bp, Mus musculus
gtggctgacagtagactgtcaca

SEQ ID NO: 214776 - DNA, 23 bp, Mus musculus
ggagagaagacagtgaagacatg

SEQ ID NO: 214777 - DNA, 19 bp, Mus musculus
atcagggatccttatgatc

SEQ ID NO: 214778 - DNA, 18 bp, Mus musculus
gtatatgattggtgtttg

SEQ ID NO: 214779 - DNA, 19 bp, Mus musculus
catccagggttcactggcc

SEQ ID NO: 214780 - DNA, 22 bp, Mus musculus
actgacagatgctagtgagcac

SEQ ID NO: 214781 - DNA, 23 bp, Mus musculus
ggtctgagtctgtgtgatatcac

SEQ ID NO: 214782 - DNA, 23 bp, Mus musculus
tttattgtcaggttctgatctcc

SEQ ID NO: 214783 - DNA, 23 bp, Mus musculus
tgtctgtctgtctgtctgtctgt

SEQ ID NO: 214784 - DNA, 23 bp, Mus musculus
ctgtgtgtgtgtgagagacagta

SEQ ID NO: 214785 - DNA, 23 bp, Mus musculus
atagaggttgtaaaatgtgttaa

SEQ ID NO: 214786 - DNA, 18 bp, Mus musculus
ctggttgtctcatcttgg

SEQ ID NO: 214787 - DNA, 19 bp, Mus musculus
agcctgattgggttagtag

SEQ ID NO: 214788 - DNA, 23 bp, Mus musculus
gtgatagacttttgatttgtggt

SEQ ID NO: 214789 - DNA, 21 bp, Mus musculus
tcactgctgagtctctcagaa

SEQ ID NO: 214790 - DNA, 21 bp, Mus musculus
actcacagagatctgcctgcc

SEQ ID NO: 214791 - DNA, 23 bp, Mus musculus
cattctctctgtctctgctactg

SEQ ID NO: 214792 - DNA, 23 bp, Mus musculus
ttgttctctcaggtaatctggct

SEQ ID NO: 214793 - DNA, 23 bp, Mus musculus
gtctgactaacacatagcctgag

SEQ ID NO: 214794 - DNA, 22 bp, Mus musculus
tacatgagcatgcctttcttgt

SEQ ID NO: 214795 - DNA, 23 bp, Mus musculus
atgttgacagtagagagactggg

SEQ ID NO: 214796 - DNA, 23 bp, Mus musculus
agtgagtctttttctgtgtctga

SEQ ID NO: 214797 - DNA, 23 bp, Mus musculus
gatcattgctgatcttgctatga

SEQ ID NO: 214798 - DNA, 23 bp, Mus musculus
tctgactcccactgtgcctgtgt

SEQ ID NO: 214799 - DNA, 23 bp, Mus musculus
cttctcactgtcagtctctgtcc

SEQ ID NO: 214800 - DNA, 18 bp, Mus musculus
cagagactttggaggaac

SEQ ID NO: 214801 - DNA, 23 bp, Mus musculus
gtctcactcacagctactcatct

SEQ ID NO: 214802 - DNA, 23 bp, Mus musculus
ctctgtttctctgtgtgtgcgtg

SEQ ID NO: 214803 - DNA, 21 bp, Mus musculus
atgcgcacacagtgtttacag

SEQ ID NO: 214804 - DNA, 20 bp, Mus musculus
tctgtctgtctgtctgtatg

SEQ ID NO: 214805 - DNA, 21 bp, Mus musculus
acatgagatggaggactggag

SEQ ID NO: 214806 - DNA, 23 bp, Mus musculus
aaatggcaccaaaagatgagagc

SEQ ID NO: 214807 - DNA, 23 bp, Mus musculus
agctgcatctccatgtccatgtg

SEQ ID NO: 214808 - DNA, 20 bp, Mus musculus
tcactcggtctctgagtgat

SEQ ID NO: 214809 - DNA, 23 bp, Mus musculus
gcactgagttcagtcactgtcac

SEQ ID NO: 214810 - DNA, 19 bp, Mus musculus
tggtgtgccacagtgcttc

SEQ ID NO: 214811 - DNA, 23 bp, Mus musculus
tatgtgcatgtccatgtgtgtac

SEQ ID NO: 214812 - DNA, 23 bp, Mus musculus
agctttggatttgaggtagtcct

SEQ ID NO: 214813 - DNA, 23 bp, Mus musculus
ggtaagtcagtcactctctcgat

SEQ ID NO: 214814 - DNA, 23 bp, Mus musculus
gtgtctgtgttactaagatgtgt

SEQ ID NO: 214815 - DNA, 23 bp, Mus musculus
aggagctcactctcacagactca

SEQ ID NO: 214816 - DNA, 20 bp, Mus musculus
atatgtataatatataagca

SEQ ID NO: 214817 - DNA, 20 bp, Mus musculus
tctgtggattgttgtatggt

SEQ ID NO: 214818 - DNA, 21 bp, Mus musculus
atttactctctcttactctgt

SEQ ID NO: 214819 - DNA, 23 bp, Mus musculus
cctctgtctctatgtctctgtct

SEQ ID NO: 214820 - DNA, 21 bp, Mus musculus
taggcagaacagacagagctc

SEQ ID NO: 214821 - DNA, 23 bp, Mus musculus
ttaacaagataaaccatacaagt

SEQ ID NO: 214822 - DNA, 23 bp, Mus musculus
tcgagtgtgtgttaagtgtgtgt

SEQ ID NO: 214823 - DNA, 21 bp, Mus musculus
catatgtacatatgtatgtag

SEQ ID NO: 214824 - DNA, 23 bp, Mus musculus
tcagtctgtctgtctgtctgtct

SEQ ID NO: 214825 - DNA, 23 bp, Mus musculus
gactgccagactgtcactttctc

SEQ ID NO: 214826 - DNA, 21 bp, Mus musculus
aggaagtggtcatgcagctca

SEQ ID NO: 214827 - DNA, 23 bp, Mus musculus
aatgtgagcctccctgagctgag

SEQ ID NO: 214828 - DNA, 22 bp, Mus musculus
tgtgtgtgtgaatgctgattct

SEQ ID NO: 214829 - DNA, 23 bp, Mus musculus
tcagacattctcactctctctct

SEQ ID NO: 214830 - DNA, 22 bp, Mus musculus
tgtctgtctgtctatctctctc

SEQ ID NO: 214831 - DNA, 19 bp, Mus musculus
ggtgactctagatcatggc

SEQ ID NO: 214832 - DNA, 19 bp, Mus musculus
actgcgagagatttgagga

SEQ ID NO: 214833 - DNA, 23 bp, Mus musculus
aacgatgcttctctttctgacca

SEQ ID NO: 214834 - DNA, 22 bp, Mus musculus
tgtttctgtctccatttctgct

SEQ ID NO: 214835 - DNA, 23 bp, Mus musculus
gtctgagaagtgactttgtactt

SEQ ID NO: 214836 - DNA, 19 bp, Mus musculus
tctgtatgtgtatacatat

SEQ ID NO: 214837 - DNA, 21 bp, Mus musculus
tatgtgtatctgtatgtgcat

SEQ ID NO: 214838 - DNA, 20 bp, Mus musculus
tatgtatgtatatttgtatg

SEQ ID NO: 214839 - DNA, 23 bp, Mus musculus
atatatgtgtgtatatgtatcta

SEQ ID NO: 214840 - DNA, 22 bp, Mus musculus
tatatgcatgtatatacatata

SEQ ID NO: 214841 - DNA, 21 bp, Mus musculus
atatctatatatgtaactgta

SEQ ID NO: 214842 - DNA, 23 bp, Mus musculus
tgtgtgcatctatatgtatgttt

SEQ ID NO: 214843 - DNA, 19 bp, Mus musculus
tgtgtgtgtgcatgtgtat

SEQ ID NO: 214844 - DNA, 23 bp, Mus musculus
agctcacatcttttgcagcagga

SEQ ID NO: 214845 - DNA, 23 bp, Mus musculus
tctctcagtgcctgtgtgtggcc

SEQ ID NO: 214846 - DNA, 20 bp, Mus musculus
agtgctgttggagaacattc

SEQ ID NO: 214847 - DNA, 18 bp, Mus musculus
ctgtctagaggctattct

SEQ ID NO: 214848 - DNA, 23 bp, Mus musculus
tgagtgtgcgtgtgcatgtgcat

SEQ ID NO: 214849 - DNA, 23 bp, Mus musculus
tgtgtctgtctgtctgtctatcc

SEQ ID NO: 214850 - DNA, 23 bp, Mus musculus
ttaaatactcaaattgtttttga

SEQ ID NO: 214851 - DNA, 19 bp, Mus musculus
cagtgaacatagaaagctc

SEQ ID NO: 214852 - DNA, 22 bp, Mus musculus
agagagctttgagaagacatct

SEQ ID NO: 214853 - DNA, 23 bp, Mus musculus
cctgacttctgactcattgtgct

SEQ ID NO: 214854 - DNA, 23 bp, Mus musculus
aggctcagtgtctcactgtcttc

SEQ ID NO: 214855 - DNA, 23 bp, Mus musculus
tttgagacaggtgtgactgtgct

SEQ ID NO: 214856 - DNA, 23 bp, Mus musculus
aatgtatatatgtgtgtgtgtgt

SEQ ID NO: 214857 - DNA, 23 bp, Mus musculus
agtgcatatgtgttggtttcttt

SEQ ID NO: 214858 - DNA, 22 bp, Mus musculus
tagcagcacataatggtttgtg

SEQ ID NO: 214859 - DNA, 23 bp, Mus musculus
tagcagcacgtaaatattggcgt

SEQ ID NO: 214860 - DNA, 23 bp, Mus musculus
aattacctccagtattgactgtg

SEQ ID NO: 214861 - DNA, 23 bp, Mus musculus
gtctgtctgtctgataatgttct

SEQ ID NO: 214862 - DNA, 23 bp, Mus musculus
aagcacaactcagaattcagttc

SEQ ID NO: 214863 - DNA, 23 bp, Mus musculus
ttctctgtcagtcagagcgggaa

SEQ ID NO: 214864 - DNA, 21 bp, Mus musculus
tgtgtcgctccctgattggct

SEQ ID NO: 214865 - DNA, 21 bp, Mus musculus
agctctgtctctgtccctctg

SEQ ID NO: 214866 - DNA, 22 bp, Mus musculus
aagatacacacactccttgttc

SEQ ID NO: 214867 - DNA, 23 bp, Mus musculus
acactcacacattgccaaatctc

SEQ ID NO: 214868 - DNA, 22 bp, Mus musculus
tttggcagtggtagtgtatact

SEQ ID NO: 214869 - DNA, 23 bp, Mus musculus
agtaactctgagtctcaggtcta

SEQ ID NO: 214870 - DNA, 23 bp, Mus musculus
tcactaattcttctgatcctctc

SEQ ID NO: 214871 - DNA, 19 bp, Mus musculus
ctcagtggttaagagtgct

SEQ ID NO: 214872 - DNA, 23 bp, Mus musculus
tgactgctcttccagaggtcctg

SEQ ID NO: 214873 - DNA, 21 bp, Mus musculus
actgagagtagagtgtgtgtt

SEQ ID NO: 214874 - DNA, 23 bp, Mus musculus
tagagtctgtctctgtgtgccag

SEQ ID NO: 214875 - DNA, 19 bp, Mus musculus
actatatatgtatatatgt

SEQ ID NO: 214876 - DNA, 20 bp, Mus musculus
tgtcttcctcagagacatgt

SEQ ID NO: 214877 - DNA, 20 bp, Mus musculus
atgtgtgtgtgcatgtgtat

SEQ ID NO: 214878 - DNA, 22 bp, Mus musculus
agagaagatgaagcgttagttg

SEQ ID NO: 214879 - DNA, 22 bp, Mus musculus
atgaatagttaaggaaaacaag

SEQ ID NO: 214880 - DNA, 23 bp, Mus musculus
gtgcgtgtgtgtatctgtgtgtc

SEQ ID NO: 214881 - DNA, 23 bp, Mus musculus
ctctgtctgtctgtctgtctgtc

SEQ ID NO: 214882 - DNA, 22 bp, Mus musculus
ctgactggctgactggctggct

SEQ ID NO: 214883 - DNA, 21 bp, Mus musculus
catgactgagttttgagaagg

SEQ ID NO: 214884 - DNA, 20 bp, Mus musculus
tgagaagtcactgtcctcaa

SEQ ID NO: 214885 - DNA, 23 bp, Mus musculus
tatgcatgtatatgtgtatgtat

SEQ ID NO: 214886 - DNA, 23 bp, Mus musculus
agcgtctggagtgtgtgtcactg

SEQ ID NO: 214887 - DNA, 23 bp, Mus musculus
ttactatgtctgtgtggttttgg

SEQ ID NO: 214888 - DNA, 23 bp, Mus musculus
tctctgtctgtctgtctgtctgt

SEQ ID NO: 214889 - DNA, 22 bp, Mus musculus
tgtatatatgtatgtatgtgtg

SEQ ID NO: 214890 - DNA, 22 bp, Mus musculus
tgttttgtgaccaattatatgg

SEQ ID NO: 214891 - DNA, 23 bp, Mus musculus
attggctctgatattattgagtg

SEQ ID NO: 214892 - DNA, 23 bp, Mus musculus
cttgtgaattgagaatttgttga

SEQ ID NO: 214893 - DNA, 23 bp, Mus musculus
tataagcttctagagttttgatt

SEQ ID NO: 214894 - DNA, 22 bp, Mus musculus
tgtgtctgtgtttttaaggaat

SEQ ID NO: 214895 - DNA, 23 bp, Mus musculus
tgtcaagttgtgagtctctgtgt

SEQ ID NO: 214896 - DNA, 21 bp, Mus musculus
tcacacactgaaatcccagcc

SEQ ID NO: 214897 - DNA, 23 bp, Mus musculus
atgtgtgaacatgggtttctgtg

SEQ ID NO: 214898 - DNA, 23 bp, Mus musculus
atgcttgtgtccttgtgcatgca

SEQ ID NO: 214899 - DNA, 22 bp, Mus musculus
acctggctctgtctgtttgctt

SEQ ID NO: 214900 - DNA, 22 bp, Mus musculus
gctgagagtagagtcagagcag

SEQ ID NO: 214901 - DNA, 23 bp, Mus musculus
attagcaaaacatttctaaaggt

SEQ ID NO: 214902 - DNA, 23 bp, Mus musculus
tatgtgtgtgctatatgtgtgtg

SEQ ID NO: 214903 - DNA, 23 bp, Mus musculus
agtgagaatacagtgtgctccca

SEQ ID NO: 214904 - DNA, 21 bp, Mus musculus
tgtctgtctgtctgtgtgatg

SEQ ID NO: 214905 - DNA, 20 bp, Mus musculus
tgtctagttgtggatctcat

SEQ ID NO: 214906 - DNA, 20 bp, Mus musculus
atgcctgtgatctaagctgt

SEQ ID NO: 214907 - DNA, 23 bp, Mus musculus
gtgtatgtgtgtctgtatgtgtg

SEQ ID NO: 214908 - DNA, 21 bp, Mus musculus
actatctagtgatttagttgt

SEQ ID NO: 214909 - DNA, 23 bp, Mus musculus
taagcaataggctcagttgtcct

SEQ ID NO: 214910 - DNA, 20 bp, Mus musculus
tgtgggatctgtcttcctta

SEQ ID NO: 214911 - DNA, 23 bp, Mus musculus
cagggtctctcactgacttggat

SEQ ID NO: 214912 - DNA, 23 bp, Mus musculus
ctgactggagaagcaggagggtg

SEQ ID NO: 214913 - DNA, 19 bp, Mus musculus
tgaaatgtatacatgtgtg

SEQ ID NO: 214914 - DNA, 23 bp, Mus musculus
tgcctcttactgactgactgcct

SEQ ID NO: 214915 - DNA, 20 bp, Mus musculus
tgcctggttcaagtaggcaa

SEQ ID NO: 214916 - DNA, 23 bp, Mus musculus
tgtctgtctctctcagggtatca

SEQ ID NO: 214917 - DNA, 20 bp, Mus musculus
tgcctgcctgcctgtctctg

SEQ ID NO: 214918 - DNA, 22 bp, Mus musculus
gttttcacagatgacccaggaa

SEQ ID NO: 214919 - DNA, 23 bp, Mus musculus
tgcaggtgactgaggagacagcg

SEQ ID NO: 214920 - DNA, 23 bp, Mus musculus
tttctctctcactcagttactgg

SEQ ID NO: 214921 - DNA, 19 bp, Mus musculus
tctgtctcttgtctccgcc

SEQ ID NO: 214922 - DNA, 23 bp, Mus musculus
tgtgtggcacagtcctaggctga

SEQ ID NO: 214923 - DNA, 23 bp, Mus musculus
tcagcctgcctgactggctgcct

SEQ ID NO: 214924 - DNA, 23 bp, Mus musculus
tgtgtggcacagtcctaggctga

SEQ ID NO: 214925 - DNA, 22 bp, Mus musculus
agtctgcctgactggctgcctc

SEQ ID NO: 214926 - DNA, 23 bp, Mus musculus
ataagacgagcaaaaagcttgtt

SEQ ID NO: 214927 - DNA, 19 bp, Mus musculus
tcagaggagctatcatcat

SEQ ID NO: 214928 - DNA, 22 bp, Mus musculus
ctcttggtctttctgtctctgt

SEQ ID NO: 214929 - DNA, 23 bp, Mus musculus
agatctgttgtcttactgttgtt

SEQ ID NO: 214930 - DNA, 23 bp, Mus musculus
acagatgacagacagaaatgaga

SEQ ID NO: 214931 - DNA, 19 bp, Mus musculus
atacacacacacacatata

SEQ ID NO: 214932 - DNA, 23 bp, Mus musculus
tgtatgtatatgtatatatgtgt

SEQ ID NO: 214933 - DNA, 21 bp, Mus musculus
atatatgtatgtgtatatgtg

SEQ ID NO: 214934 - DNA, 23 bp, Mus musculus
tagtgcatggtgatctgatagga

SEQ ID NO: 214935 - DNA, 21 bp, Mus musculus
tgttttgtgacctattatgtg

SEQ ID NO: 214936 - DNA, 22 bp, Mus musculus
aattttgtatagaatagtatag

SEQ ID NO: 214937 - DNA, 23 bp, Mus musculus
ttattcaggattgttttagctgt

SEQ ID NO: 214938 - DNA, 23 bp, Mus musculus
atttctgtgaggaattgtaattt

SEQ ID NO: 214939 - DNA, 23 bp, Mus musculus
tgagaggctctgtcagtgcctga

SEQ ID NO: 214940 - DNA, 23 bp, Mus musculus
aatggtgtgtggatatgtgtatg

SEQ ID NO: 214941 - DNA, 23 bp, Mus musculus
tctcttcaatcaattgtctcttt

SEQ ID NO: 214942 - DNA, 21 bp, Mus musculus
taagagctaaagaggcagttt

SEQ ID NO: 214943 - DNA, 23 bp, Mus musculus
ctctctgtgtctcattttcctca

SEQ ID NO: 214944 - DNA, 23 bp, Mus musculus
actgagtggcattgtagctttta

SEQ ID NO: 214945 - DNA, 21 bp, Mus musculus
taagagcactgactgctcttc

SEQ ID NO: 214946 - DNA, 23 bp, Mus musculus
gtatgaatgtatgtatttatgta

SEQ ID NO: 214947 - DNA, 23 bp, Mus musculus
tctcacacacacatgtctagcag

SEQ ID NO: 214948 - DNA, 23 bp, Mus musculus
tgcctctcaagtgctggggtaaa

SEQ ID NO: 214949 - DNA, 23 bp, Mus musculus
agaaagcatctacttcagattct

SEQ ID NO: 214950 - DNA, 22 bp, Mus musculus
tgttttgtgaccaattatatgg

SEQ ID NO: 214951 - DNA, 23 bp, Mus musculus
gagactctgtcagtgcctgtcaa

SEQ ID NO: 214952 - DNA, 23 bp, Mus musculus
gatgtgtcgctccctgattggct

SEQ ID NO: 214953 - DNA, 22 bp, Mus musculus
ttgtgacttgaagggtgttgtt

SEQ ID NO: 214954 - DNA, 23 bp, Mus musculus
atcaagagagtgagctctgaggg

SEQ ID NO: 214955 - DNA, 20 bp, Mus musculus
atcacggacttgattgtggt

SEQ ID NO: 214956 - DNA, 23 bp, Mus musculus
ttatgcagcaactctgttttatt

SEQ ID NO: 214957 - DNA, 22 bp, Mus musculus
atgggtgtgaggtcatgtgtgc

SEQ ID NO: 214958 - DNA, 23 bp, Mus musculus
tgtctctgtgtgtctgtgcacat

SEQ ID NO: 214959 - DNA, 18 bp, Mus musculus
atgctagtagaagacata

SEQ ID NO: 214960 - DNA, 20 bp, Mus musculus
tcctttccaagcagttctac

SEQ ID NO: 214961 - DNA, 22 bp, Mus musculus
caatctgagggaattggctcac

SEQ ID NO: 214962 - DNA, 22 bp, Mus musculus
ctcacacagacacacttgtagg

SEQ ID NO: 214963 - DNA, 23 bp, Mus musculus
agacatagaaacttatagccttt

SEQ ID NO: 214964 - DNA, 22 bp, Mus musculus
agtttcttcgatgaattgtttt

SEQ ID NO: 214965 - DNA, 22 bp, Mus musculus
gggagactagctttttcctgag

SEQ ID NO: 214966 - DNA, 22 bp, Mus musculus
tgttttgtgaccaattatatgg

SEQ ID NO: 214967 - DNA, 23 bp, Mus musculus
tgtatgtatgtatgtgtatgtac

SEQ ID NO: 214968 - DNA, 21 bp, Mus musculus
gtatgtatgtatatatgtatg

SEQ ID NO: 214969 - DNA, 19 bp, Mus musculus
atgtatgtatgtatttatg

SEQ ID NO: 214970 - DNA, 23 bp, Mus musculus
tgatctcattttgtttttgaatt

SEQ ID NO: 214971 - DNA, 23 bp, Mus musculus
acttcaaatactatgttgaaaag

SEQ ID NO: 214972 - DNA, 20 bp, Mus musculus
ttaggatatatatatatatg

SEQ ID NO: 214973 - DNA, 19 bp, Mus musculus
tatgtagtaggatttttat

SEQ ID NO: 214974 - DNA, 23 bp, Mus musculus
tgtgtatatatatgtatgtgtat

SEQ ID NO: 214975 - DNA, 19 bp, Mus musculus
tcccacaatgctttggtgt

SEQ ID NO: 214976 - DNA, 22 bp, Mus musculus
ttttccaagtcagacagacaga

SEQ ID NO: 214977 - DNA, 20 bp, Mus musculus
tggtaagatgaagagatttc

SEQ ID NO: 214978 - DNA, 23 bp, Mus musculus
gttttactaggaggatttgagat

SEQ ID NO: 214979 - DNA, 23 bp, Mus musculus
attcccagtgcctgcctctctgt

SEQ ID NO: 214980 - DNA, 23 bp, Mus musculus
tgaatctggttctgtgaacatct

SEQ ID NO: 214981 - DNA, 23 bp, Mus musculus
tgtgcctgcctgcctgcctgcca

SEQ ID NO: 214982 - DNA, 23 bp, Mus musculus
tctgtatgcttatgtagctgtca

SEQ ID NO: 214983 - DNA, 23 bp, Mus musculus
cttctgtcggtctctctctcctt

SEQ ID NO: 214984 - DNA, 23 bp, Mus musculus
atctctgttattgatgtatagtg

SEQ ID NO: 214985 - DNA, 20 bp, Mus musculus
attaagaaaaatagtctctg

SEQ ID NO: 214986 - DNA, 23 bp, Mus musculus
agacaggcacaggaaagcttctc

SEQ ID NO: 214987 - DNA, 23 bp, Mus musculus
tgtctgtctgtctgtctgtctgt

SEQ ID NO: 214988 - DNA, 23 bp, Mus musculus
cacagttgacagtgatgagagag

SEQ ID NO: 214989 - DNA, 23 bp, Mus musculus
tgacaggagagtgtgaggggcag

SEQ ID NO: 214990 - DNA, 22 bp, Mus musculus
tgcagctcctctatgttctgtt

SEQ ID NO: 214991 - DNA, 20 bp, Mus musculus
ctgcttttagacctcttagt

SEQ ID NO: 214992 - DNA, 19 bp, Mus musculus
tgtctctgtgaatctcagg

SEQ ID NO: 214993 - DNA, 21 bp, Mus musculus
aacggcttccacattgccagc

SEQ ID NO: 214994 - DNA, 23 bp, Mus musculus
ttagtgtgtgcatgtgcatgtgg

SEQ ID NO: 214995 - DNA, 23 bp, Mus musculus
tctgctagaaggttgtaaggttg

SEQ ID NO: 214996 - DNA, 23 bp, Mus musculus
tgtgccacacacacacacatgtg

SEQ ID NO: 214997 - DNA, 23 bp, Mus musculus
cagggtcgctgtgtgactctgac

SEQ ID NO: 214998 - DNA, 18 bp, Mus musculus
gactggagagatggctca

SEQ ID NO: 214999 - DNA, 23 bp, Mus musculus
tctcatctcactctgaatgacct

SEQ ID NO: 215000 - DNA, 22 bp, Mus musculus
tgattagtttgaaagacaattg

SEQ ID NO: 215001 - DNA, 21 bp, Mus musculus
tctcactcagtcatcatccag

SEQ ID NO: 215002 - DNA, 21 bp, Mus musculus
tgtgacattttgtctgtgtga

SEQ ID NO: 215003 - DNA, 20 bp, Mus musculus
tctggccctgtgactatcca

SEQ ID NO: 215004 - DNA, 22 bp, Mus musculus
ctgcctgcctgcctgcctgcct

SEQ ID NO: 215005 - DNA, 21 bp, Mus musculus
tccctgccacagagcctgcga

SEQ ID NO: 215006 - DNA, 23 bp, Mus musculus
cttagacagttctctgggtggtg

SEQ ID NO: 215007 - DNA, 20 bp, Mus musculus
ctctgtaggtctgtgagtct

SEQ ID NO: 215008 - DNA, 19 bp, Mus musculus
acacacacgagtgtgtgga

SEQ ID NO: 215009 - DNA, 23 bp, Mus musculus
tgtctgtgacactctcaatggag

SEQ ID NO: 215010 - DNA, 23 bp, Mus musculus
tgtctgggtgtgtctctccctgt

SEQ ID NO: 215011 - DNA, 19 bp, Mus musculus
atgtgtgtgtgcatgtgca

SEQ ID NO: 215012 - DNA, 23 bp, Mus musculus
aatgaatatgatgatgaatatgt

SEQ ID NO: 215013 - DNA, 18 bp, Mus musculus
tctgtctttggtgtttga

SEQ ID NO: 215014 - DNA, 22 bp, Mus musculus
tgttttgtgaccaattatatgg

SEQ ID NO: 215015 - DNA, 19 bp, Mus musculus
gagcaaacatatacagtga

SEQ ID NO: 215016 - DNA, 21 bp, Mus musculus
tcagtctatcatttatgttat

SEQ ID NO: 215017 - DNA, 23 bp, Mus musculus
gtcagagtacagtgtgaccaggt

SEQ ID NO: 215018 - DNA, 23 bp, Mus musculus
ggcattcactggctgtgtctgtc

SEQ ID NO: 215019 - DNA, 21 bp, Mus musculus
tatgtgtccgggtgtttgtgt

SEQ ID NO: 215020 - DNA, 23 bp, Mus musculus
agtgcatggatgtgagggtccaa

SEQ ID NO: 215021 - DNA, 23 bp, Mus musculus
ctatggttgtagaatgtctcctg

SEQ ID NO: 215022 - DNA, 21 bp, Mus musculus
agaccttctatttctttcctt

SEQ ID NO: 215023 - DNA, 20 bp, Mus musculus
acacgtcccagaccactcag

SEQ ID NO: 215024 - DNA, 23 bp, Mus musculus
tatgactgaagtgttgtgaaagc

SEQ ID NO: 215025 - DNA, 23 bp, Mus musculus
tggtcaaggctatcccagagagt

SEQ ID NO: 215026 - DNA, 23 bp, Mus musculus
tgagtctctctgctttagcagtc

SEQ ID NO: 215027 - DNA, 23 bp, Mus musculus
tctgagtgagtgagtgagtgagt

SEQ ID NO: 215028 - DNA, 22 bp, Mus musculus
tgttttgtgaccaattatatgg

SEQ ID NO: 215029 - DNA, 23 bp, Mus musculus
caatatatgtgtgtgtgtgtatg

SEQ ID NO: 215030 - DNA, 23 bp, Mus musculus
atgagtatatctatatgtatgtg

SEQ ID NO: 215031 - DNA, 22 bp, Mus musculus
tgttttgtgaccaattatatgg

SEQ ID NO: 215032 - DNA, 23 bp, Mus musculus
agtcatgatgatctgataggatg

SEQ ID NO: 215033 - DNA, 21 bp, Mus musculus
tgttattgcatgcacatatgt

SEQ ID NO: 215034 - DNA, 21 bp, Mus musculus
tgccgacactgtctgtctgtg

SEQ ID NO: 215035 - DNA, 19 bp, Mus musculus
ttatgttaatcatttgaaa

SEQ ID NO: 215036 - DNA, 23 bp, Mus musculus
tgtgtgtgtgtgtctatgtgtgt

SEQ ID NO: 215037 - DNA, 19 bp, Mus musculus
taaagtatatatgtaaaca

SEQ ID NO: 215038 - DNA, 22 bp, Mus musculus
tgttttgtgaccaattatatgg

SEQ ID NO: 215039 - DNA, 22 bp, Mus musculus
tgttttgtgaccaattatatgg

SEQ ID NO: 215040 - DNA, 23 bp, Mus musculus
gagggtctcagtctgtgcctgtg

SEQ ID NO: 215041 - DNA, 23 bp, Mus musculus
gagatgagcatcactattcttgt

SEQ ID NO: 215042 - DNA, 22 bp, Mus musculus
taatcagctttcacagctctaa

SEQ ID NO: 215043 - DNA, 23 bp, Mus musculus
tatgtgtatgtatatatatgtgt

SEQ ID NO: 215044 - DNA, 23 bp, Mus musculus
tgttagaagtagtagcagagatg

SEQ ID NO: 215045 - DNA, 19 bp, Mus musculus
tctgtctgtctgtctgtat

SEQ ID NO: 215046 - DNA, 20 bp, Mus musculus
tgacagacagacaaacagga

SEQ ID NO: 215047 - DNA, 21 bp, Mus musculus
aacacaggtgccttctctgtt

SEQ ID NO: 215048 - DNA, 23 bp, Mus musculus
catctgactctgagataattagc

SEQ ID NO: 215049 - DNA, 23 bp, Mus musculus
tgtgtgtctgcatgtgcatgtcc

SEQ ID NO: 215050 - DNA, 22 bp, Mus musculus
atgtatgaatatgagtatgtgg

SEQ ID NO: 215051 - DNA, 20 bp, Mus musculus
acagggccaggatagaatgt

SEQ ID NO: 215052 - DNA, 18 bp, Mus musculus
tgtgttgaaagacccctg

SEQ ID NO: 215053 - DNA, 23 bp, Mus musculus
tcatagactgtggataaagagag

SEQ ID NO: 215054 - DNA, 22 bp, Mus musculus
tcatctgtatatcaggaggttc

SEQ ID NO: 215055 - DNA, 23 bp, Mus musculus
tgtgaaactctctctgtatactg

SEQ ID NO: 215056 - DNA, 20 bp, Mus musculus
tgtgtatgcatgcctgtgtg

SEQ ID NO: 215057 - DNA, 23 bp, Mus musculus
tctgtgtcagtcactgtcactca

SEQ ID NO: 215058 - DNA, 23 bp, Mus musculus
tgtgtgtctggtagaggtcaggg

SEQ ID NO: 215059 - DNA, 23 bp, Mus musculus
tagtccatggtgatcagatagga

SEQ ID NO: 215060 - DNA, 22 bp, Mus musculus
tgttttgtgaccaattatatgg

SEQ ID NO: 215061 - DNA, 19 bp, Mus musculus
acaggggctggagagatgg

SEQ ID NO: 215062 - DNA, 21 bp, Mus musculus
attcagtagtgtgtgaccact

SEQ ID NO: 215063 - DNA, 23 bp, Mus musculus
gcagtgatcatcttctgaggctg

SEQ ID NO: 215064 - DNA, 21 bp, Mus musculus
ttcctctgttgcttatcactg

SEQ ID NO: 215065 - DNA, 20 bp, Mus musculus
cagtgaagtcacagagcact

SEQ ID NO: 215066 - DNA, 21 bp, Mus musculus
cagtgtgtgtgcatgtgcatg

SEQ ID NO: 215067 - DNA, 23 bp, Mus musculus
gtgggtctctgtatctgtttctg

SEQ ID NO: 215068 - DNA, 23 bp, Mus musculus
tatatttctatatgaatctgaaa

SEQ ID NO: 215069 - DNA, 20 bp, Mus musculus
atactggaatttgaattagg

SEQ ID NO: 215070 - DNA, 23 bp, Mus musculus
ctgcattcaggatgttcaggaag

SEQ ID NO: 215071 - DNA, 21 bp, Mus musculus
cactgtctctgtgtgttcagt

SEQ ID NO: 215072 - DNA, 21 bp, Mus musculus
tgagaggctttgatcaaactg

SEQ ID NO: 215073 - DNA, 23 bp, Mus musculus
tgttacgtttcttgtttaagctc

SEQ ID NO: 215074 - DNA, 23 bp, Mus musculus
gggattgtattgaatctgtagat

SEQ ID NO: 215075 - DNA, 19 bp, Mus musculus
ttttctatattaatcctgt

SEQ ID NO: 215076 - DNA, 22 bp, Mus musculus
gtcactgggtctgtggctctgt

SEQ ID NO: 215077 - DNA, 19 bp, Mus musculus
agtgctaagatcagttggt

SEQ ID NO: 215078 - DNA, 22 bp, Mus musculus
aggatctgtccattgatgagac

SEQ ID NO: 215079 - DNA, 20 bp, Mus musculus
gtgctgcttacattctagtg

SEQ ID NO: 215080 - DNA, 19 bp, Mus musculus
agccccaagttatttctga

SEQ ID NO: 215081 - DNA, 23 bp, Mus musculus
tactgaaacagcatgtggaggtc

SEQ ID NO: 215082 - DNA, 23 bp, Mus musculus
cagaaggagcaactgtctgccaa

SEQ ID NO: 215083 - DNA, 23 bp, Mus musculus
actggctgcctctgtccttgcca

SEQ ID NO: 215084 - DNA, 21 bp, Mus musculus
taacagcatcagcttctgcac

SEQ ID NO: 215085 - DNA, 18 bp, Mus musculus
gatgtatgtatgtatgta

SEQ ID NO: 215086 - DNA, 23 bp, Mus musculus
tgtgtgcatgtatgtgtgtgtat

SEQ ID NO: 215087 - DNA, 23 bp, Mus musculus
accaccttgcatattttaagtat

SEQ ID NO: 215088 - DNA, 18 bp, Mus musculus
acagggttcagaagagct

SEQ ID NO: 215089 - DNA, 21 bp, Mus musculus
tacatggtagaggagcccatt

SEQ ID NO: 215090 - DNA, 23 bp, Mus musculus
tggcactggtagaagaatgtttt

SEQ ID NO: 215091 - DNA, 23 bp, Mus musculus
agtggcaggctgacttgtgtgtc

SEQ ID NO: 215092 - DNA, 20 bp, Mus musculus
acttttgaatcttctctggg

SEQ ID NO: 215093 - DNA, 23 bp, Mus musculus
acacatgagactgaggagggtgg

SEQ ID NO: 215094 - DNA, 22 bp, Mus musculus
atatgcttcttaagtgagtttt

SEQ ID NO: 215095 - DNA, 23 bp, Mus musculus
agaccctcagtctctggctttgg

SEQ ID NO: 215096 - DNA, 23 bp, Mus musculus
tgtctctgtgtctgtgtcctgac

SEQ ID NO: 215097 - DNA, 23 bp, Mus musculus
aacactggctgagtttatgaagt

SEQ ID NO: 215098 - DNA, 23 bp, Mus musculus
tggtagtcttgagatattgtctt

SEQ ID NO: 215099 - DNA, 22 bp, Mus musculus
tgcaatatatatgtatatgcat

SEQ ID NO: 215100 - DNA, 23 bp, Mus musculus
atgtatatgcatatgtatatgta

SEQ ID NO: 215101 - DNA, 18 bp, Mus musculus
ttcagttgtaaagccact

SEQ ID NO: 215102 - DNA, 22 bp, Mus musculus
gagttctgaacctcgagcatag

SEQ ID NO: 215103 - DNA, 18 bp, Mus musculus
aagagtgccaggacttag

SEQ ID NO: 215104 - DNA, 18 bp, Mus musculus
tatgtgtttcacatgtgt

SEQ ID NO: 215105 - DNA, 23 bp, Mus musculus
atgtatgcatgtgcatgtgcatg

SEQ ID NO: 215106 - DNA, 22 bp, Mus musculus
tatgtgtgtgtgcatgtgcatg

SEQ ID NO: 215107 - DNA, 22 bp, Mus musculus
tgtatgtatgtgtgcctgtgca

SEQ ID NO: 215108 - DNA, 19 bp, Mus musculus
acagagcctatcagcagcc

SEQ ID NO: 215109 - DNA, 23 bp, Mus musculus
catgtctgtgtctctgtcacagc

SEQ ID NO: 215110 - DNA, 23 bp, Mus musculus
gtgtgggtgtctctgactcagtt

SEQ ID NO: 215111 - DNA, 23 bp, Mus musculus
tgaatagtagatggagctcaggc

SEQ ID NO: 215112 - DNA, 23 bp, Mus musculus
acacactctcgcacactcacatg

SEQ ID NO: 215113 - DNA, 23 bp, Mus musculus
tgcctctggatctctgtctctgt

SEQ ID NO: 215114 - DNA, 23 bp, Mus musculus
tccttcagctccttctgtaacca

SEQ ID NO: 215115 - DNA, 22 bp, Mus musculus
atcaagctggttaaaaatgtgc

SEQ ID NO: 215116 - DNA, 20 bp, Mus musculus
tgggacagggactcctcagc

SEQ ID NO: 215117 - DNA, 23 bp, Mus musculus
ctctctcttgctctcagtgtcct

SEQ ID NO: 215118 - DNA, 22 bp, Mus musculus
aagagcatgacaaaggttgacc

SEQ ID NO: 215119 - DNA, 22 bp, Mus musculus
ctcagcctctctgtctctgctg

SEQ ID NO: 215120 - DNA, 23 bp, Mus musculus
tgtctcactgtgtgacctgtgcc

SEQ ID NO: 215121 - DNA, 21 bp, Mus musculus
tctcattgcaaaccttggttc

SEQ ID NO: 215122 - DNA, 23 bp, Mus musculus
ctgtctgcctgcctgtctgcctg

SEQ ID NO: 215123 - DNA, 21 bp, Mus musculus
tctgtcactgggagaagtcag

SEQ ID NO: 215124 - DNA, 22 bp, Mus musculus
agacacagcaataaagagtgtg

SEQ ID NO: 215125 - DNA, 21 bp, Mus musculus
tacacatgctgacactcgtgt

SEQ ID NO: 215126 - DNA, 19 bp, Mus musculus
atgtgcttatggtatgggt

SEQ ID NO: 215127 - DNA, 23 bp, Mus musculus
tgtctagctcactctctcgctct

SEQ ID NO: 215128 - DNA, 23 bp, Mus musculus
ggagagagagaactgactccgga

SEQ ID NO: 215129 - DNA, 18 bp, Mus musculus
agtgttctggaaacgttg

SEQ ID NO: 215130 - DNA, 23 bp, Mus musculus
attgtcacagtgattagggttac

SEQ ID NO: 215131 - DNA, 23 bp, Mus musculus
gtatgtgtgtctgtgtgtataca

SEQ ID NO: 215132 - DNA, 23 bp, Mus musculus
atgtgtatatatatatgtgtgtg

SEQ ID NO: 215133 - DNA, 22 bp, Mus musculus
tatgcgtgtgtatatatatgta

SEQ ID NO: 215134 - DNA, 23 bp, Mus musculus
tcacattggtgtgtgtgtgcact

SEQ ID NO: 215135 - DNA, 22 bp, Mus musculus
tctcactgtggctcaggcactt

SEQ ID NO: 215136 - DNA, 23 bp, Mus musculus
actctctgtggctcacttcagcg

SEQ ID NO: 215137 - DNA, 20 bp, Mus musculus
tctgtctcacagacagtctc

SEQ ID NO: 215138 - DNA, 23 bp, Mus musculus
ctgtcacagtagagtgtggccac

SEQ ID NO: 215139 - DNA, 23 bp, Mus musculus
taagagcactgactcctcttcca

SEQ ID NO: 215140 - DNA, 23 bp, Mus musculus
gtccctgtgtctctgacccagtc

SEQ ID NO: 215141 - DNA, 19 bp, Mus musculus
tctctttctctctctctct

SEQ ID NO: 215142 - DNA, 23 bp, Mus musculus
gagtgctgactgctcttccagag

SEQ ID NO: 215143 - DNA, 23 bp, Mus musculus
ctgtccctgtgtgagaaggatgt

SEQ ID NO: 215144 - DNA, 23 bp, Mus musculus
tctgcttgcctgcctgcctgcct

SEQ ID NO: 215145 - DNA, 23 bp, Mus musculus
acagcagactcactcttctcagt

SEQ ID NO: 215146 - DNA, 23 bp, Mus musculus
gctagacagtgagctgagagggc

SEQ ID NO: 215147 - DNA, 20 bp, Mus musculus
tcttagaactcactctgtag

SEQ ID NO: 215148 - DNA, 23 bp, Mus musculus
tgtctcagaggttaagagcactg

SEQ ID NO: 215149 - DNA, 22 bp, Mus musculus
ttctgtttgactctcttcttca

SEQ ID NO: 215150 - DNA, 23 bp, Mus musculus
actgtagtgaagaatctgcctct

SEQ ID NO: 215151 - DNA, 20 bp, Mus musculus
gtgtctgcatgtgcagatgg

SEQ ID NO: 215152 - DNA, 18 bp, Mus musculus
tctttaagaatagtgctc

SEQ ID NO: 215153 - DNA, 23 bp, Mus musculus
tgtgttcctagtcaattggttcg

SEQ ID NO: 215154 - DNA, 23 bp, Mus musculus
tgactgtacactgtgtggaatgg

SEQ ID NO: 215155 - DNA, 18 bp, Mus musculus
tctgccaggatctgctta

SEQ ID NO: 215156 - DNA, 18 bp, Mus musculus
aatgaccctgctaaagga

SEQ ID NO: 215157 - DNA, 23 bp, Mus musculus
atgtgcttgttcattgaattgat

SEQ ID NO: 215158 - DNA, 23 bp, Mus musculus
gtctgtgagtctgtcagtgggtg

SEQ ID NO: 215159 - DNA, 22 bp, Mus musculus
ctctgtctgtgtatgtgtctgg

SEQ ID NO: 215160 - DNA, 23 bp, Mus musculus
atagtctctctgagttagcagtc

SEQ ID NO: 215161 - DNA, 21 bp, Mus musculus
agcaactgcatgtcaatgtgg

SEQ ID NO: 215162 - DNA, 23 bp, Mus musculus
tcagagctactgagtttgtgcct

SEQ ID NO: 215163 - DNA, 21 bp, Mus musculus
tgtggaagaagagacagtggt

SEQ ID NO: 215164 - DNA, 21 bp, Mus musculus
taagacagacagattttacac

SEQ ID NO: 215165 - DNA, 23 bp, Mus musculus
gtatgtatgtatgtatgtgtgtg

SEQ ID NO: 215166 - DNA, 23 bp, Mus musculus
ctctgtccctctgttcacagtag

SEQ ID NO: 215167 - DNA, 23 bp, Mus musculus
ctgactcactgcatctcaaaccc

SEQ ID NO: 215168 - DNA, 23 bp, Mus musculus
tatatgaaactggttttgtagag

SEQ ID NO: 215169 - DNA, 22 bp, Mus musculus
tgttttgtgaccaattatatgg

SEQ ID NO: 215170 - DNA, 23 bp, Mus musculus
acacggcactcactctgtgtatg

SEQ ID NO: 215171 - DNA, 23 bp, Mus musculus
gaggagctctgactgctcttaca

SEQ ID NO: 215172 - DNA, 23 bp, Mus musculus
ttaatgactttttctatttcttt

SEQ ID NO: 215173 - DNA, 22 bp, Mus musculus
tttagatcgttaatctgatcct

SEQ ID NO: 215174 - DNA, 23 bp, Mus musculus
tgtatgtatatatgtatatgtgt

SEQ ID NO: 215175 - DNA, 23 bp, Mus musculus
tctgagcaatgatgtgtctgtgt

SEQ ID NO: 215176 - DNA, 23 bp, Mus musculus
ctgtctgtccgtgtctgtgtgtc

SEQ ID NO: 215177 - DNA, 23 bp, Mus musculus
agacctgcatttgtcttggccaa

SEQ ID NO: 215178 - DNA, 23 bp, Mus musculus
tagatctatataaatgctgtctc

SEQ ID NO: 215179 - DNA, 23 bp, Mus musculus
ttatgcagagggcttgacatgag

SEQ ID NO: 215180 - DNA, 23 bp, Mus musculus
atgtagttcagttgatcgaatgc

SEQ ID NO: 215181 - DNA, 23 bp, Mus musculus
tgtctgtctgtgtgcctgcctgc

SEQ ID NO: 215182 - DNA, 23 bp, Mus musculus
tgtttagctccaccacagacacg

SEQ ID NO: 215183 - DNA, 23 bp, Mus musculus
gtatgtatgtacatatgtatatg

SEQ ID NO: 215184 - DNA, 23 bp, Mus musculus
tgtctgtcttactgtctgtctgt

SEQ ID NO: 215185 - DNA, 22 bp, Mus musculus
ctctctctgggtcactgtgcag

SEQ ID NO: 215186 - DNA, 20 bp, Mus musculus
atgtatgtatgtatgtatgt

SEQ ID NO: 215187 - DNA, 23 bp, Mus musculus
ttatgtgaatgtgttatgcatgt

SEQ ID NO: 215188 - DNA, 23 bp, Mus musculus
tatgtgtgtgcatgtgcatgtgt

SEQ ID NO: 215189 - DNA, 23 bp, Mus musculus
ggcacagaattgattttcttgtt

SEQ ID NO: 215190 - DNA, 23 bp, Mus musculus
tgtctgtctctgtgcatgtctgt

SEQ ID NO: 215191 - DNA, 23 bp, Mus musculus
tgttaaagccacttgttttcatc

SEQ ID NO: 215192 - DNA, 23 bp, Mus musculus
tctgtcacactgaaagctgttga

SEQ ID NO: 215193 - DNA, 23 bp, Mus musculus
ctgagcctctgagtctgagtaga

SEQ ID NO: 215194 - DNA, 18 bp, Mus musculus
ctctctctcagacacggc

SEQ ID NO: 215195 - DNA, 23 bp, Mus musculus
ctttgtccttgttctgctgagag

SEQ ID NO: 215196 - DNA, 23 bp, Mus musculus
tctcagcatctaagacagtgagt

SEQ ID NO: 215197 - DNA, 23 bp, Mus musculus
ttcaacctcacactctctctcag

SEQ ID NO: 215198 - DNA, 23 bp, Mus musculus
gtgggtggagccctggttttatg

SEQ ID NO: 215199 - DNA, 21 bp, Mus musculus
agggtcagaggtgaagtcttg

SEQ ID NO: 215200 - DNA, 23 bp, Mus musculus
agcctgggtgggtctgttttcct

SEQ ID NO: 215201 - DNA, 23 bp, Mus musculus
ggctcagtggctccctcactgcc

SEQ ID NO: 215202 - DNA, 23 bp, Mus musculus
agcctgcctgcctgcctgcctga

SEQ ID NO: 215203 - DNA, 23 bp, Mus musculus
ggaatgagactcaggggtactgt

SEQ ID NO: 215204 - DNA, 23 bp, Mus musculus
tggctctgactctgtctgcttca

SEQ ID NO: 215205 - DNA, 23 bp, Mus musculus
tcatgtgtgtgcatgtccatgtg

SEQ ID NO: 215206 - DNA, 23 bp, Mus musculus
tgtctgtctgcctgcctgtctgt

SEQ ID NO: 215207 - DNA, 22 bp, Mus musculus
gggacagacagtcagactcacc

SEQ ID NO: 215208 - DNA, 23 bp, Mus musculus
gctgtcactgtctgagttgtgtc

SEQ ID NO: 215209 - DNA, 18 bp, Mus musculus
catcaggctcagctcaga

SEQ ID NO: 215210 - DNA, 22 bp, Mus musculus
tgtttgtgtgcatgtacatgtg

SEQ ID NO: 215211 - DNA, 23 bp, Mus musculus
aatgagattatatttttctgtca

SEQ ID NO: 215212 - DNA, 23 bp, Mus musculus
agtcgtgtgactcaacgtagtta

SEQ ID NO: 215213 - DNA, 23 bp, Mus musculus
gcttggagagagaagtctcagtg

SEQ ID NO: 215214 - DNA, 22 bp, Mus musculus
agagaggagactgagagcacca

SEQ ID NO: 215215 - DNA, 21 bp, Mus musculus
tgtgtgtctgtctgtctgtct

SEQ ID NO: 215216 - DNA, 23 bp, Mus musculus
cccctgtgtgtcactcattgtgc

SEQ ID NO: 215217 - DNA, 23 bp, Mus musculus
tagtgcatggtgatctgatagga

SEQ ID NO: 215218 - DNA, 23 bp, Mus musculus
tttgtgacctattatgtggttaa

SEQ ID NO: 215219 - DNA, 23 bp, Mus musculus
tatgtgtgtgatatacatgtgtg

SEQ ID NO: 215220 - DNA, 23 bp, Mus musculus
tagactgactgcctctctctctg

SEQ ID NO: 215221 - DNA, 23 bp, Mus musculus
atgtgcatgtgcatatgtttgca

SEQ ID NO: 215222 - DNA, 23 bp, Mus musculus
tgtcactctcagatagaagtgag

SEQ ID NO: 215223 - DNA, 21 bp, Mus musculus
tgtggtttttatttgtggaga

SEQ ID NO: 215224 - DNA, 23 bp, Mus musculus
ctgtgtgcatatgcatgtacatg

SEQ ID NO: 215225 - DNA, 18 bp, Mus musculus
atatgatacatgtttgtg

SEQ ID NO: 215226 - DNA, 23 bp, Mus musculus
atggtggcaggttttgtgagctt

SEQ ID NO: 215227 - DNA, 23 bp, Mus musculus
gatgtgtctctctgtctctctgc

SEQ ID NO: 215228 - DNA, 23 bp, Mus musculus
tctctagtgtatttgaagatgtg

SEQ ID NO: 215229 - DNA, 23 bp, Mus musculus
cagaggaatgaagtatccgtgca

SEQ ID NO: 215230 - DNA, 23 bp, Mus musculus
cagacagaacactgtctgggcat

SEQ ID NO: 215231 - DNA, 23 bp, Mus musculus
ttctaggtgctgtgtaaggtagg

SEQ ID NO: 215232 - DNA, 23 bp, Mus musculus
ttactggcttctcatttgtgtct

SEQ ID NO: 215233 - DNA, 18 bp, Mus musculus
tgggattgaactcaggtc

SEQ ID NO: 215234 - DNA, 21 bp, Mus musculus
actgtattgttattgctgaga

SEQ ID NO: 215235 - DNA, 23 bp, Mus musculus
atcttagtctgacccattcttca

SEQ ID NO: 215236 - DNA, 22 bp, Mus musculus
tgtgagtgaagtgacagagctg

SEQ ID NO: 215237 - DNA, 19 bp, Mus musculus
atgtgtgtgtgcatgtgca

SEQ ID NO: 215238 - DNA, 23 bp, Mus musculus
acagctcacgcacagactgtgag

SEQ ID NO: 215239 - DNA, 23 bp, Mus musculus
tagaatggttgaataaacatgca

SEQ ID NO: 215240 - DNA, 20 bp, Mus musculus
tgtatgcgtgtgtatacaca

SEQ ID NO: 215241 - DNA, 22 bp, Mus musculus
acttgacagtgtgtacagtggc

SEQ ID NO: 215242 - DNA, 22 bp, Mus musculus
ctgcctgcctgcctgcctgcct

SEQ ID NO: 215243 - DNA, 23 bp, Mus musculus
cgtctgcctgtctgtctgtgtgt

SEQ ID NO: 215244 - DNA, 18 bp, Mus musculus
actctttctctgatgttg

SEQ ID NO: 215245 - DNA, 21 bp, Mus musculus
aaacaagacagtgagcagaag

SEQ ID NO: 215246 - DNA, 21 bp, Mus musculus
tgtgtgtgtatatatgtgtgt

SEQ ID NO: 215247 - DNA, 21 bp, Mus musculus
atttctgtgtttgggaatgtc

SEQ ID NO: 215248 - DNA, 23 bp, Mus musculus
tatgacacccagctatgttctta

SEQ ID NO: 215249 - DNA, 23 bp, Mus musculus
tctgtgtgtgacttcgtgcgtgt

SEQ ID NO: 215250 - DNA, 22 bp, Mus musculus
tgtctgcctgcctgcctgcctt

SEQ ID NO: 215251 - DNA, 23 bp, Mus musculus
agggtagaagaagacattggtct

SEQ ID NO: 215252 - DNA, 21 bp, Mus musculus
ggctgtctgagacactgtgtc

SEQ ID NO: 215253 - DNA, 23 bp, Mus musculus
tggtcactgtactgactgtggtg

SEQ ID NO: 215254 - DNA, 22 bp, Mus musculus
agtcagagacctgtgtgtgtgt

SEQ ID NO: 215255 - DNA, 23 bp, Mus musculus
taactgcttgtgcttctcagtct

SEQ ID NO: 215256 - DNA, 23 bp, Mus musculus
agactctggaagtctagacctat

SEQ ID NO: 215257 - DNA, 23 bp, Mus musculus
gatctctgagagtgacagttgct

SEQ ID NO: 215258 - DNA, 18 bp, Mus musculus
aattgacagacagacaga

SEQ ID NO: 215259 - DNA, 19 bp, Mus musculus
gaatctgaatgtattgtca

SEQ ID NO: 215260 - DNA, 23 bp, Mus musculus
atgaatgtatttgtatatgtaat

SEQ ID NO: 215261 - DNA, 18 bp, Mus musculus
ggtagaaggttggctgct

SEQ ID NO: 215262 - DNA, 23 bp, Mus musculus
tagtccatggtgatctgatagga

SEQ ID NO: 215263 - DNA, 20 bp, Mus musculus
ttgtatctattgaggcctgt

SEQ ID NO: 215264 - DNA, 23 bp, Mus musculus
catctcactgtgtcagaaagcag

SEQ ID NO: 215265 - DNA, 21 bp, Mus musculus
agccaagctctgtctctgtca

SEQ ID NO: 215266 - DNA, 23 bp, Mus musculus
ttcacagaagacagagtattcag

SEQ ID NO: 215267 - DNA, 23 bp, Mus musculus
tgtctgcctgcctgcctgtctgt

SEQ ID NO: 215268 - DNA, 18 bp, Mus musculus
tatgagagctagagtttg

SEQ ID NO: 215269 - DNA, 23 bp, Mus musculus
tgtatgtatgtatgtatgtatgt

SEQ ID NO: 215270 - DNA, 23 bp, Mus musculus
ttctgtcagggtgtttttatcat

SEQ ID NO: 215271 - DNA, 20 bp, Mus musculus
aaacactacagaggcagcag

SEQ ID NO: 215272 - DNA, 23 bp, Mus musculus
tatgtgtatgtatttgtatatgt

SEQ ID NO: 215273 - DNA, 20 bp, Mus musculus
ttccatgtgaatgttggctt

SEQ ID NO: 215274 - DNA, 21 bp, Mus musculus
agacactaaggatatgtatgt

SEQ ID NO: 215275 - DNA, 23 bp, Mus musculus
tcagccttagtctgtggtgatct

SEQ ID NO: 215276 - DNA, 20 bp, Mus musculus
ctgggtttgttttgcttgtg

SEQ ID NO: 215277 - DNA, 23 bp, Mus musculus
tatgtgtgtgtatgtatatgtgt

SEQ ID NO: 215278 - DNA, 23 bp, Mus musculus
acatatgtgtgtatgtatatatg

SEQ ID NO: 215279 - DNA, 19 bp, Mus musculus
atgtgtgtatttatatatg

SEQ ID NO: 215280 - DNA, 23 bp, Mus musculus
tatgtgtgtatgtatatgtgtct

SEQ ID NO: 215281 - DNA, 23 bp, Mus musculus
cagcattactgtctcatgtcaag

SEQ ID NO: 215282 - DNA, 20 bp, Mus musculus
taaagtccttttcatgtaca

SEQ ID NO: 215283 - DNA, 22 bp, Mus musculus
tacactttctctcccactctca

SEQ ID NO: 215284 - DNA, 23 bp, Mus musculus
actacttggatcactcacacagt

SEQ ID NO: 215285 - DNA, 23 bp, Mus musculus
ctgcctgcctgcctgtctgcctc

SEQ ID NO: 215286 - DNA, 22 bp, Mus musculus
gtcagtactgaggctgcagaga

SEQ ID NO: 215287 - DNA, 21 bp, Mus musculus
atgtctgtctggcaaggagga

SEQ ID NO: 215288 - DNA, 23 bp, Mus musculus
tccatggtcatctgatatgatgc

SEQ ID NO: 215289 - DNA, 23 bp, Mus musculus
cactggctctctctgtgggtcgc

SEQ ID NO: 215290 - DNA, 23 bp, Mus musculus
atatctgtatatgtacatgtgtg

SEQ ID NO: 215291 - DNA, 23 bp, Mus musculus
atagcagagatatatgtatgtgt

SEQ ID NO: 215292 - DNA, 18 bp, Mus musculus
agggcatggtgattccac

SEQ ID NO: 215293 - DNA, 23 bp, Mus musculus
aggtcactctcactgagggagtc

SEQ ID NO: 215294 - DNA, 23 bp, Mus musculus
ctgtcctagatagttctattgtt

SEQ ID NO: 215295 - DNA, 23 bp, Mus musculus
agactgagcaacaggaactgaga

SEQ ID NO: 215296 - DNA, 23 bp, Mus musculus
acagaagaatgatagtagagagc

SEQ ID NO: 215297 - DNA, 22 bp, Mus musculus
aagatgctaccatctttctgag

SEQ ID NO: 215298 - DNA, 21 bp, Mus musculus
cttcagagttcactttcactc

SEQ ID NO: 215299 - DNA, 21 bp, Mus musculus
taaagagcagataaaggagaa

SEQ ID NO: 215300 - DNA, 23 bp, Mus musculus
acacagagcagactgaagtcaga

SEQ ID NO: 215301 - DNA, 23 bp, Mus musculus
tgatgacactggctgtattgagc

SEQ ID NO: 215302 - DNA, 23 bp, Mus musculus
ttctgagatgtgtttgtgatgtt

SEQ ID NO: 215303 - DNA, 21 bp, Mus musculus
gactctgagaaacacattacc

SEQ ID NO: 215304 - DNA, 19 bp, Mus musculus
aggatctgtccattggtga

SEQ ID NO: 215305 - DNA, 21 bp, Mus musculus
tccatggtggtctgataggat

SEQ ID NO: 215306 - DNA, 22 bp, Mus musculus
ttttgtatctattgaggcctgt

SEQ ID NO: 215307 - DNA, 23 bp, Mus musculus
ttaactaatgcttctcaagggaa

SEQ ID NO: 215308 - DNA, 23 bp, Mus musculus
gtatgtatatcttcatcttcgtg

SEQ ID NO: 215309 - DNA, 23 bp, Mus musculus
atatgtgtgtatatatatgtgtg

SEQ ID NO: 215310 - DNA, 23 bp, Mus musculus
gcacagaatgtcctgaagtagag

SEQ ID NO: 215311 - DNA, 23 bp, Mus musculus
atactcactttggtagtgtctgg

SEQ ID NO: 215312 - DNA, 21 bp, Mus musculus
gcaatgcaagtatgtctcagc

SEQ ID NO: 215313 - DNA, 21 bp, Mus musculus
tttgtttattttatgtgctga

SEQ ID NO: 215314 - DNA, 23 bp, Mus musculus
ctgctaaatgctctccctctctt

SEQ ID NO: 215315 - DNA, 19 bp, Mus musculus
taagaccttcattttagct

SEQ ID NO: 215316 - DNA, 21 bp, Mus musculus
taaggcaccttgagttttgtt

SEQ ID NO: 215317 - DNA, 22 bp, Mus musculus
tgtctgagtgtctttgtacagc

SEQ ID NO: 215318 - DNA, 23 bp, Mus musculus
gcagacaaactgtgttgttctgg

SEQ ID NO: 215319 - DNA, 23 bp, Mus musculus
tattaacatgttcatatgtgctt

SEQ ID NO: 215320 - DNA, 23 bp, Mus musculus
tagtccatggtgatctgatagga

SEQ ID NO: 215321 - DNA, 21 bp, Mus musculus
tgttttgttaccaattatatg

SEQ ID NO: 215322 - DNA, 20 bp, Mus musculus
tgactacagacaccatgaga

SEQ ID NO: 215323 - DNA, 23 bp, Mus musculus
tctccctgagtgttgtgtggtac

SEQ ID NO: 215324 - DNA, 18 bp, Mus musculus
tgggagttgttagcctga

SEQ ID NO: 215325 - DNA, 23 bp, Mus musculus
ttaggtgtctagagatactgttg

SEQ ID NO: 215326 - DNA, 20 bp, Mus musculus
tctttgtaattgtctgttga

SEQ ID NO: 215327 - DNA, 23 bp, Mus musculus
tgtgtgcgtgcgtgcgtgcgtgt

SEQ ID NO: 215328 - DNA, 19 bp, Mus musculus
tacatgtatgttcatgtgt

SEQ ID NO: 215329 - DNA, 23 bp, Mus musculus
actctgtctctgtctgtctctct

SEQ ID NO: 215330 - DNA, 22 bp, Mus musculus
tctgtctctctgtgtgtgtctg

SEQ ID NO: 215331 - DNA, 22 bp, Mus musculus
tactttcttggtttgggtgtat

SEQ ID NO: 215332 - DNA, 18 bp, Mus musculus
ctctagaagggaaattct

SEQ ID NO: 215333 - DNA, 23 bp, Mus musculus
tgtgtgtgtgcttttgatctata

SEQ ID NO: 215334 - DNA, 23 bp, Mus musculus
attgagtgccgcagagaggggtt

SEQ ID NO: 215335 - DNA, 22 bp, Mus musculus
agttcttcatctagacctgtaa

SEQ ID NO: 215336 - DNA, 23 bp, Mus musculus
tgtctctcacactgacagaccta

SEQ ID NO: 215337 - DNA, 22 bp, Mus musculus
tactttcttggtttgggtgtat

SEQ ID NO: 215338 - DNA, 18 bp, Mus musculus
ctctagaagggaaattct

SEQ ID NO: 215339 - DNA, 23 bp, Mus musculus
tgtgtgtgtgcttttgatctata

SEQ ID NO: 215340 - DNA, 23 bp, Mus musculus
attgagtgccgcagagaggggtt

SEQ ID NO: 215341 - DNA, 22 bp, Mus musculus
tttgtgtgtgtgtatctgtgtg

SEQ ID NO: 215342 - DNA, 20 bp, Mus musculus
gtctgaggtatgtctgtgtg

SEQ ID NO: 215343 - DNA, 20 bp, Mus musculus
tatgagtgtgtgtgtatgtg

SEQ ID NO: 215344 - DNA, 22 bp, Mus musculus
tcagcttttagcttgaatagca

SEQ ID NO: 215345 - DNA, 22 bp, Mus musculus
tttgtgtgtgtgtatctgtgtg

SEQ ID NO: 215346 - DNA, 20 bp, Mus musculus
gtctgaggtatgtctgtgtg

SEQ ID NO: 215347 - DNA, 20 bp, Mus musculus
tatgagtgtgtgtgtatgtg

SEQ ID NO: 215348 - DNA, 22 bp, Mus musculus
tcagcttttagcttgaatagca

SEQ ID NO: 215349 - DNA, 23 bp, Mus musculus
atgtatgtatatatgtatacaca

SEQ ID NO: 215350 - DNA, 22 bp, Mus musculus
tatgtgtatatgtatatatgtg

SEQ ID NO: 215351 - DNA, 23 bp, Mus musculus
atatgtgtatatgtatatatgtg

SEQ ID NO: 215352 - DNA, 23 bp, Mus musculus
gtttagtgacctaatcttgattt

SEQ ID NO: 215353 - DNA, 21 bp, Mus musculus
tgtccagttttttcaagtttg

SEQ ID NO: 215354 - DNA, 20 bp, Mus musculus
agtgtttccatattctttga

SEQ ID NO: 215355 - DNA, 23 bp, Mus musculus
aaaactgtgtgaatatcttcatg

SEQ ID NO: 215356 - DNA, 22 bp, Mus musculus
atatatgtatgtatatgtatgt

SEQ ID NO: 215357 - DNA, 23 bp, Mus musculus
gcatctctgtggtagaagttagg

SEQ ID NO: 215358 - DNA, 22 bp, Mus musculus
taggagctgcagataatgtttt

SEQ ID NO: 215359 - DNA, 23 bp, Mus musculus
acaccctctctctgactctaatc

SEQ ID NO: 215360 - DNA, 23 bp, Mus musculus
aggctcagtggctcagtctcttc

SEQ ID NO: 215361 - DNA, 23 bp, Mus musculus
gtgtctgtctctcagtcctacca

SEQ ID NO: 215362 - DNA, 21 bp, Mus musculus
gtgatgctctctgagtcagtg

SEQ ID NO: 215363 - DNA, 23 bp, Mus musculus
gtctctgtgtccctggcaaacat

SEQ ID NO: 215364 - DNA, 23 bp, Mus musculus
tcacagcagctgtgtttacctgt

SEQ ID NO: 215365 - DNA, 22 bp, Mus musculus
tgttttgtgaccaattatatgg

SEQ ID NO: 215366 - DNA, 18 bp, Mus musculus
gtacaacatacacgtaag

SEQ ID NO: 215367 - DNA, 23 bp, Mus musculus
ttcacagcagctgtgtttaccca

SEQ ID NO: 215368 - DNA, 21 bp, Mus musculus
agaaccattgtgaaagctttt

SEQ ID NO: 215369 - DNA, 23 bp, Mus musculus
ttcacagcagctgtgtttaccca

SEQ ID NO: 215370 - DNA, 20 bp, Mus musculus
attttttctagcatttgaat

SEQ ID NO: 215371 - DNA, 23 bp, Mus musculus
attgaagtagagctacgaaaggt

SEQ ID NO: 215372 - DNA, 23 bp, Mus musculus
tcacagcagctgtgtttacctgt

SEQ ID NO: 215373 - DNA, 23 bp, Mus musculus
ttcacagcagctgtgtttaccca

SEQ ID NO: 215374 - DNA, 23 bp, Mus musculus
tccaggttgtggatgccttttat

SEQ ID NO: 215375 - DNA, 23 bp, Mus musculus
actgagggtgtgaatttggatag

SEQ ID NO: 215376 - DNA, 19 bp, Mus musculus
tatgtatatgtatatgtat

SEQ ID NO: 215377 - DNA, 19 bp, Mus musculus
tatgtatgtatgtatgtat

SEQ ID NO: 215378 - DNA, 21 bp, Mus musculus
cattctctgtgcctctgagac

SEQ ID NO: 215379 - DNA, 23 bp, Mus musculus
tctcttgctctcagtgtccttgt

SEQ ID NO: 215380 - DNA, 23 bp, Mus musculus
tagcttcatgatgttgagtaaag

SEQ ID NO: 215381 - DNA, 22 bp, Mus musculus
aatctcagaatctttgaactgt

SEQ ID NO: 215382 - DNA, 23 bp, Mus musculus
tctcactctgtctcttaagtcgg

SEQ ID NO: 215383 - DNA, 20 bp, Mus musculus
ctatctatctatgtgtgtgt

SEQ ID NO: 215384 - DNA, 22 bp, Mus musculus
tatattgtgcatatcatatatt

SEQ ID NO: 215385 - DNA, 23 bp, Mus musculus
tttgacacaagacagagtcatct

SEQ ID NO: 215386 - DNA, 23 bp, Mus musculus
gtgtgtgtatatgaatgtgtgtg

SEQ ID NO: 215387 - DNA, 22 bp, Mus musculus
tgttttgtgaccaattatatgg

SEQ ID NO: 215388 - DNA, 23 bp, Mus musculus
agcagcaaaatgttgggtcctgt

SEQ ID NO: 215389 - DNA, 19 bp, Mus musculus
tctcggggtgtaatagtgg

SEQ ID NO: 215390 - DNA, 23 bp, Mus musculus
ttagtccgtggtcatcagatagg

SEQ ID NO: 215391 - DNA, 22 bp, Mus musculus
tgttttgtgaccaattatatgg

SEQ ID NO: 215392 - DNA, 19 bp, Mus musculus
catggtgatcagataggat

SEQ ID NO: 215393 - DNA, 23 bp, Mus musculus
atttttgtatctgtggaggcctg

SEQ ID NO: 215394 - DNA, 23 bp, Mus musculus
tgctgactgctgaaactgactct

SEQ ID NO: 215395 - DNA, 22 bp, Mus musculus
accagggagacaatgaagtttg

SEQ ID NO: 215396 - DNA, 20 bp, Mus musculus
aagagcactgactgctcttc

SEQ ID NO: 215397 - DNA, 19 bp, Mus musculus
ctggaactcagtctgtgtc

SEQ ID NO: 215398 - DNA, 23 bp, Mus musculus
atggatgtgttatgtatatatgt

SEQ ID NO: 215399 - DNA, 22 bp, Mus musculus
tgtatgtgtatgatcattgtgc

SEQ ID NO: 215400 - DNA, 21 bp, Mus musculus
ttcaattctcagcaaccacat

SEQ ID NO: 215401 - DNA, 23 bp, Mus musculus
agaaagttcttcaggatggcagt

SEQ ID NO: 215402 - DNA, 22 bp, Mus musculus
tgtgttataggaagacatttgt

SEQ ID NO: 215403 - DNA, 18 bp, Mus musculus
tttatgctcattcaggtg

SEQ ID NO: 215404 - DNA, 23 bp, Mus musculus
gcatgtatgtgtgcatgtgtgtg

SEQ ID NO: 215405 - DNA, 22 bp, Mus musculus
gtatgtatgtatgtatgtgtat

SEQ ID NO: 215406 - DNA, 23 bp, Mus musculus
tgtctgtatctgtctgagtcagc

SEQ ID NO: 215407 - DNA, 23 bp, Mus musculus
atgtacatatgtatacatatgta

SEQ ID NO: 215408 - DNA, 23 bp, Mus musculus
gtaagccaagatgtttgtgctta

SEQ ID NO: 215409 - DNA, 23 bp, Mus musculus
tatatgtatatatgtacatgtac

SEQ ID NO: 215410 - DNA, 21 bp, Mus musculus
atacacatacatatacatgag

SEQ ID NO: 215411 - DNA, 23 bp, Mus musculus
tttagtgcttctgaaatgatttt

SEQ ID NO: 215412 - DNA, 19 bp, Mus musculus
tgtgtgtgtgtgtgtgtgt

SEQ ID NO: 215413 - DNA, 23 bp, Mus musculus
tgtctatgtctctctctttacgt

SEQ ID NO: 215414 - DNA, 22 bp, Mus musculus
agagcattgcatttcacaaggt

SEQ ID NO: 215415 - DNA, 21 bp, Mus musculus
atggaaggagatgctgtgctc

SEQ ID NO: 215416 - DNA, 20 bp, Mus musculus
agagagtagaaagagaccgc

SEQ ID NO: 215417 - DNA, 21 bp, Mus musculus
tgtccttcaactaaagtagta

SEQ ID NO: 215418 - DNA, 22 bp, Mus musculus
aaagcacatacacgtgcctgct

SEQ ID NO: 215419 - DNA, 21 bp, Mus musculus
acagcttgcagtgtaagtggg

SEQ ID NO: 215420 - DNA, 23 bp, Mus musculus
tccctctgtcttacttactgtca

SEQ ID NO: 215421 - DNA, 23 bp, Mus musculus
agtctctcattgtgcctgtgtct

SEQ ID NO: 215422 - DNA, 22 bp, Mus musculus
tgttttgtgaccaattatatgg

SEQ ID NO: 215423 - DNA, 22 bp, Mus musculus
tgttttgtgaccaattatatgg

SEQ ID NO: 215424 - DNA, 23 bp, Mus musculus
tgtttatgtatatgcatgtgtgt

SEQ ID NO: 215425 - DNA, 19 bp, Mus musculus
atatatgcttatacacatg

SEQ ID NO: 215426 - DNA, 23 bp, Mus musculus
ggtaactatacaagtgtgaatgg

SEQ ID NO: 215427 - DNA, 22 bp, Mus musculus
gggagaggatcatgtttggtct

SEQ ID NO: 215428 - DNA, 22 bp, Mus musculus
ttcacccaccgaatgattcctt

SEQ ID NO: 215429 - DNA, 23 bp, Mus musculus
ctctccctctgagtgtggtcaca

SEQ ID NO: 215430 - DNA, 23 bp, Mus musculus
tgtgtctctgcctgcctgactac

SEQ ID NO: 215431 - DNA, 23 bp, Mus musculus
actcacggtctactttagtgtgt

SEQ ID NO: 215432 - DNA, 23 bp, Mus musculus
agatcagagaggagagtgacgcc

SEQ ID NO: 215433 - DNA, 23 bp, Mus musculus
atgacagagtatgttaatgggag

SEQ ID NO: 215434 - DNA, 21 bp, Mus musculus
tgtgcatgtcactctgtgtgt

SEQ ID NO: 215435 - DNA, 23 bp, Mus musculus
ggtgctgtgtctgtgtgtctgat

SEQ ID NO: 215436 - DNA, 18 bp, Mus musculus
tctgaggttaagagcact

SEQ ID NO: 215437 - DNA, 23 bp, Mus musculus
ttcagcttacactttccatattg

SEQ ID NO: 215438 - DNA, 23 bp, Mus musculus
agtaagacatttgattttgtttt

SEQ ID NO: 215439 - DNA, 23 bp, Mus musculus
ctgtgtctctgtttaatttctgt

SEQ ID NO: 215440 - DNA, 23 bp, Mus musculus
gattcccagagtccatgaggcag

SEQ ID NO: 215441 - DNA, 22 bp, Mus musculus
tgttttgtgaccaattatatgg

SEQ ID NO: 215442 - DNA, 20 bp, Mus musculus
tacatcagagataaagtgga

SEQ ID NO: 215443 - DNA, 23 bp, Mus musculus
tccctgcctgtctgtctgtatgt

SEQ ID NO: 215444 - DNA, 23 bp, Mus musculus
tttgtgaccaattatatagtcaa

SEQ ID NO: 215445 - DNA, 22 bp, Mus musculus
tgcagacacagtaaggagtatg

SEQ ID NO: 215446 - DNA, 23 bp, Mus musculus
gttcaagtctcagcatccacatg

SEQ ID NO: 215447 - DNA, 23 bp, Mus musculus
gaggaagatactcagtgtgttag

SEQ ID NO: 215448 - DNA, 21 bp, Mus musculus
tagtgacctctctctttctct

SEQ ID NO: 215449 - DNA, 23 bp, Mus musculus
tctctgagtccctctcttctcat

SEQ ID NO: 215450 - DNA, 23 bp, Mus musculus
tctctgagtccctcaattctcat

SEQ ID NO: 215451 - DNA, 23 bp, Mus musculus
gctctctgagtccctcaattctc

SEQ ID NO: 215452 - DNA, 23 bp, Mus musculus
ctctctgagtccctctcttctca

SEQ ID NO: 215453 - DNA, 23 bp, Mus musculus
ctctctgagtccctctcttctca

SEQ ID NO: 215454 - DNA, 23 bp, Mus musculus
actaggtgatgctctctgagttc

SEQ ID NO: 215455 - DNA, 20 bp, Mus musculus
aagtcttgtgattctcttgt

SEQ ID NO: 215456 - DNA, 20 bp, Mus musculus
tatatctttttgtcgtttga

SEQ ID NO: 215457 - DNA, 23 bp, Mus musculus
gtgtgtgtgtgtgtgtgtgcact

SEQ ID NO: 215458 - DNA, 23 bp, Mus musculus
aaaagagaggtttgctgagagaa

SEQ ID NO: 215459 - DNA, 23 bp, Mus musculus
tatgtacatctatgtctgtctgt

SEQ ID NO: 215460 - DNA, 21 bp, Mus musculus
tgtgcctgtatgtgtgcctgt

SEQ ID NO: 215461 - DNA, 21 bp, Mus musculus
tatgtacatgtatatgtgtgt

SEQ ID NO: 215462 - DNA, 22 bp, Mus musculus
tgagaggtatctgagctggtca

SEQ ID NO: 215463 - DNA, 18 bp, Mus musculus
agcagacaggttatggag

SEQ ID NO: 215464 - DNA, 21 bp, Mus musculus
atatatgtacatgtacttatg

SEQ ID NO: 215465 - DNA, 23 bp, Mus musculus
aggacacagaagcctgagagctc

SEQ ID NO: 215466 - DNA, 22 bp, Mus musculus
aatttctctgtactgtgggtga

SEQ ID NO: 215467 - DNA, 23 bp, Mus musculus
aagtgagagtgaactttgaggtt

SEQ ID NO: 215468 - DNA, 22 bp, Mus musculus
ctcaagccacactcagtgtctc

SEQ ID NO: 215469 - DNA, 21 bp, Mus musculus
tgtatatatgtgtgtgtgtgc

SEQ ID NO: 215470 - DNA, 23 bp, Mus musculus
tgagagaacagattgagcagtag

SEQ ID NO: 215471 - DNA, 23 bp, Mus musculus
tactccagtgccaatctgaggga

SEQ ID NO: 215472 - DNA, 23 bp, Mus musculus
tgcgtgtgtgcgtgcgtgcgtgt

SEQ ID NO: 215473 - DNA, 23 bp, Mus musculus
atatgtatatatgtatgtgtgtg

SEQ ID NO: 215474 - DNA, 23 bp, Mus musculus
actcagaagtcagtgttgagcag

SEQ ID NO: 215475 - DNA, 19 bp, Mus musculus
cctgacagaagaggctgag

SEQ ID NO: 215476 - DNA, 19 bp, Mus musculus
acacagcttccttttttca

SEQ ID NO: 215477 - DNA, 18 bp, Mus musculus
agaggcaggctgatttct

SEQ ID NO: 215478 - DNA, 23 bp, Mus musculus
ccaaatctagacagacagacaga

SEQ ID NO: 215479 - DNA, 22 bp, Mus musculus
taggtgttgttcctcaatagct

SEQ ID NO: 215480 - DNA, 23 bp, Mus musculus
agagtgtacactgaacactgagc

SEQ ID NO: 215481 - DNA, 18 bp, Mus musculus
cacttgctcgttgtctca

SEQ ID NO: 215482 - DNA, 23 bp, Mus musculus
taaatatctcttctacctttcag

SEQ ID NO: 215483 - DNA, 23 bp, Mus musculus
tatgtatatgtatacacatatac

SEQ ID NO: 215484 - DNA, 23 bp, Mus musculus
tagtccatggtgatctgatagga

SEQ ID NO: 215485 - DNA, 21 bp, Mus musculus
tgttttgttaccaattatatg

SEQ ID NO: 215486 - DNA, 23 bp, Mus musculus
tatgtgtgcatgtgcatgtgtgt

SEQ ID NO: 215487 - DNA, 21 bp, Mus musculus
aatgacctgtccattggtgag

SEQ ID NO: 215488 - DNA, 19 bp, Mus musculus
atacacttattggatgtga

SEQ ID NO: 215489 - DNA, 23 bp, Mus musculus
tattacaactagtaaatgtttga

SEQ ID NO: 215490 - DNA, 23 bp, Mus musculus
gcatgttgtttagttatcagtta

SEQ ID NO: 215491 - DNA, 23 bp, Mus musculus
tagtgcatggtgatctgatagga

SEQ ID NO: 215492 - DNA, 23 bp, Mus musculus
tgttttgtgacctattatgtggt

SEQ ID NO: 215493 - DNA, 23 bp, Mus musculus
tgtgtgtgtttgtgcatgtgtgt

SEQ ID NO: 215494 - DNA, 22 bp, Mus musculus
tgttttgtgaccaattatatgg

SEQ ID NO: 215495 - DNA, 21 bp, Mus musculus
tttctctgactcattctgtac

SEQ ID NO: 215496 - DNA, 20 bp, Mus musculus
tgtgtgtgtgttttatatgt

SEQ ID NO: 215497 - DNA, 22 bp, Mus musculus
tgtctgacagtttttctttact

SEQ ID NO: 215498 - DNA, 22 bp, Mus musculus
tgttttgtgaccaattatatgg

SEQ ID NO: 215499 - DNA, 22 bp, Mus musculus
tgttttgtgaccaattatatgg

SEQ ID NO: 215500 - DNA, 23 bp, Mus musculus
ttctgagtagaaccttttactaa

SEQ ID NO: 215501 - DNA, 23 bp, Mus musculus
aatctcattatttaattttgtgt

SEQ ID NO: 215502 - DNA, 23 bp, Mus musculus
tttttcctggagtctctctctct

SEQ ID NO: 215503 - DNA, 19 bp, Mus musculus
taaggacttgtaactcttt

SEQ ID NO: 215504 - DNA, 23 bp, Mus musculus
tatgtgagcttcttttaggatta

SEQ ID NO: 215505 - DNA, 22 bp, Mus musculus
tgttttgtgaccaattatatgg

SEQ ID NO: 215506 - DNA, 23 bp, Mus musculus
tggttttcacacactttgaaggc

SEQ ID NO: 215507 - DNA, 19 bp, Mus musculus
atgaaactgaatgttgaag

SEQ ID NO: 215508 - DNA, 21 bp, Mus musculus
ttctgcattttattttctgtg

SEQ ID NO: 215509 - DNA, 22 bp, Mus musculus
tgttttgtgaccaattatatgg

SEQ ID NO: 215510 - DNA, 22 bp, Mus musculus
tgttttgtgaccaattatatgg

SEQ ID NO: 215511 - DNA, 22 bp, Mus musculus
tgttttgtgaccaattatatgg

SEQ ID NO: 215512 - DNA, 23 bp, Mus musculus
tgtgtgcatgtgtgcgtgtgtga

SEQ ID NO: 215513 - DNA, 22 bp, Mus musculus
tgttttgtgaccaattatatgg

SEQ ID NO: 215514 - DNA, 19 bp, Mus musculus
ttttgtaaggttatcttct

SEQ ID NO: 215515 - DNA, 19 bp, Mus musculus
acactgagaggccacgttg

SEQ ID NO: 215516 - DNA, 23 bp, Mus musculus
tctctgacagtagatgttctgtg

SEQ ID NO: 215517 - DNA, 22 bp, Mus musculus
tttaaatctaggaaaggccaac

SEQ ID NO: 215518 - DNA, 23 bp, Mus musculus
tgacactgtctctcagttttaac

SEQ ID NO: 215519 - DNA, 23 bp, Mus musculus
tatgtgtgtatattcttatgtgt

SEQ ID NO: 215520 - DNA, 22 bp, Mus musculus
tgttttgtgaccaattatatgg

SEQ ID NO: 215521 - DNA, 23 bp, Mus musculus
acacacacttacatatacacaaa

SEQ ID NO: 215522 - DNA, 23 bp, Mus musculus
tatgcatatatatgatatagtat

SEQ ID NO: 215523 - DNA, 22 bp, Mus musculus
tacttcatcctatttgtatgtt

SEQ ID NO: 215524 - DNA, 23 bp, Mus musculus
atgtatatgtatatgtatatgta

SEQ ID NO: 215525 - DNA, 23 bp, Mus musculus
tcatcttgcagcctatcagctgt

SEQ ID NO: 215526 - DNA, 19 bp, Mus musculus
gctgtgtactgtctctctc

SEQ ID NO: 215527 - DNA, 22 bp, Mus musculus
agagagtcatagaaatacttat

SEQ ID NO: 215528 - DNA, 23 bp, Mus musculus
tatttctgtggctgatttatttc

SEQ ID NO: 215529 - DNA, 22 bp, Mus musculus
tgttttgtgaccaattatatgg

SEQ ID NO: 215530 - DNA, 21 bp, Mus musculus
ccttgcagttgcacagtaaga

SEQ ID NO: 215531 - DNA, 23 bp, Mus musculus
tatataatgtttgcatatatgtg

SEQ ID NO: 215532 - DNA, 22 bp, Mus musculus
ttttttgttaccaattatatgg

SEQ ID NO: 215533 - DNA, 22 bp, Mus musculus
tgttttgtgaccaattatatgg

SEQ ID NO: 215534 - DNA, 21 bp, Mus musculus
tatacatacatatacatatgt

SEQ ID NO: 215535 - DNA, 22 bp, Mus musculus
tgttttgtgaccaattatatgg

SEQ ID NO: 215536 - DNA, 23 bp, Mus musculus
tcactctctgtgtaatgggtggc

SEQ ID NO: 215537 - DNA, 23 bp, Mus musculus
gtattgtgtgtccatgtgtttgc

SEQ ID NO: 215538 - DNA, 19 bp, Mus musculus
ttgtgtgtactgggtgtgt

SEQ ID NO: 215539 - DNA, 22 bp, Mus musculus
tgttttgtgaccaattatatgg

SEQ ID NO: 215540 - DNA, 23 bp, Mus musculus
atgtttgtatatgtacgtatatg

SEQ ID NO: 215541 - DNA, 19 bp, Mus musculus
ggttgggtctcaagttggg

SEQ ID NO: 215542 - DNA, 22 bp, Mus musculus
tgttttgtgaccaattatatgg

SEQ ID NO: 215543 - DNA, 23 bp, Mus musculus
tatacatagtttttgtaatgtgg

SEQ ID NO: 215544 - DNA, 22 bp, Mus musculus
tgttttgtgaccaattatatgg

SEQ ID NO: 215545 - DNA, 22 bp, Mus musculus
tgttttgtgaccaattatatgg

SEQ ID NO: 215546 - DNA, 23 bp, Mus musculus
tctgagtgcctgtgtgtgtgcgt

SEQ ID NO: 215547 - DNA, 23 bp, Mus musculus
tcagtggctctgtggctctgcct

SEQ ID NO: 215548 - DNA, 23 bp, Mus musculus
aaagcttgtggtacaattcacag

SEQ ID NO: 215549 - DNA, 20 bp, Mus musculus
atgacacaggcacttgtttc

SEQ ID NO: 215550 - DNA, 21 bp, Mus musculus
atgtatgtgtatgatatatca

SEQ ID NO: 215551 - DNA, 23 bp, Mus musculus
actgccacagtctctgagtgtat

SEQ ID NO: 215552 - DNA, 22 bp, Mus musculus
ctgtgtctctgtcagctggtag

SEQ ID NO: 215553 - DNA, 23 bp, Mus musculus
agaggacaacatgctcctgtctg

SEQ ID NO: 215554 - DNA, 23 bp, Mus musculus
tatgtgcatgtggatgtgtatgg

SEQ ID NO: 215555 - DNA, 23 bp, Mus musculus
ggctgtgcacatgtgtgagtgtg

SEQ ID NO: 215556 - DNA, 20 bp, Mus musculus
ccatggtggtctgatagaat

SEQ ID NO: 215557 - DNA, 20 bp, Mus musculus
ctgagcaagccgtagagact

SEQ ID NO: 215558 - DNA, 23 bp, Mus musculus
atatatgtatatgtatatgtatg

SEQ ID NO: 215559 - DNA, 20 bp, Mus musculus
atcaagtcagaatttgagct

SEQ ID NO: 215560 - DNA, 18 bp, Mus musculus
tatgtatatgtatatgta

SEQ ID NO: 215561 - DNA, 23 bp, Mus musculus
tatgctgcttttagatgtctgtg

SEQ ID NO: 215562 - DNA, 23 bp, Mus musculus
agagagagaacagagtgtggatt

SEQ ID NO: 215563 - DNA, 18 bp, Mus musculus
atggggatgttgggatga

SEQ ID NO: 215564 - DNA, 22 bp, Mus musculus
tcttatgtggctatctgcatgc

SEQ ID NO: 215565 - DNA, 23 bp, Mus musculus
cagaagagagaacagtctgaggc

SEQ ID NO: 215566 - DNA, 23 bp, Mus musculus
taggtatatatgtatgtatacag

SEQ ID NO: 215567 - DNA, 23 bp, Mus musculus
cactaagtctctctctctcaact

SEQ ID NO: 215568 - DNA, 23 bp, Mus musculus
gtcactctgtcacactctccatc

SEQ ID NO: 215569 - DNA, 19 bp, Mus musculus
gcaatttacttctgcatcg

SEQ ID NO: 215570 - DNA, 19 bp, Mus musculus
aatgtgaaaggaagtattt

SEQ ID NO: 215571 - DNA, 21 bp, Mus musculus
agtgctacagggtattatagt

SEQ ID NO: 215572 - DNA, 22 bp, Mus musculus
tgggactgtgtcagtggcttgt

SEQ ID NO: 215573 - DNA, 23 bp, Mus musculus
tcactctcgcagatattgatgac

SEQ ID NO: 215574 - DNA, 23 bp, Mus musculus
aaaagtgagtgcttttgatatct

SEQ ID NO: 215575 - DNA, 20 bp, Mus musculus
tttggacatgggcaggagag

SEQ ID NO: 215576 - DNA, 20 bp, Mus musculus
tgactgcagctgctgatgga

SEQ ID NO: 215577 - DNA, 18 bp, Mus musculus
agacagagaaacgcagtc

SEQ ID NO: 215578 - DNA, 22 bp, Mus musculus
ttgtctgtcttcttaccttgtt

SEQ ID NO: 215579 - DNA, 23 bp, Mus musculus
aatgagtacaagtaaatgaggtg

SEQ ID NO: 215580 - DNA, 23 bp, Mus musculus
ctctgtctctcactctgtggcat

SEQ ID NO: 215581 - DNA, 23 bp, Mus musculus
gatctagctgtctgtctgtctat

SEQ ID NO: 215582 - DNA, 20 bp, Mus musculus
gatttgcagattctggagcc

SEQ ID NO: 215583 - DNA, 23 bp, Mus musculus
tgtctgtctgtctcgctctgtgt

SEQ ID NO: 215584 - DNA, 23 bp, Mus musculus
tgcaattgacatgtatagataca

SEQ ID NO: 215585 - DNA, 23 bp, Mus musculus
atgcagaggctgaagagttgtga

SEQ ID NO: 215586 - DNA, 18 bp, Mus musculus
tcagtgccatttgttatt

SEQ ID NO: 215587 - DNA, 23 bp, Mus musculus
tgtgcctatgtgtgtgtatgtgt

SEQ ID NO: 215588 - DNA, 23 bp, Mus musculus
ctgtgtctcagagtactcaggtt

SEQ ID NO: 215589 - DNA, 23 bp, Mus musculus
aaagaaattcttgagttactctg

SEQ ID NO: 215590 - DNA, 23 bp, Mus musculus
tctgtctgtgtctgtctctgtat

SEQ ID NO: 215591 - DNA, 19 bp, Mus musculus
acacatacatgagacagag

SEQ ID NO: 215592 - DNA, 23 bp, Mus musculus
aacactcagggtctctctggaag

SEQ ID NO: 215593 - DNA, 19 bp, Mus musculus
tctgtggctctgctccagc

SEQ ID NO: 215594 - DNA, 23 bp, Mus musculus
tgcatgtatgtatgtatgtttgt

SEQ ID NO: 215595 - DNA, 22 bp, Mus musculus
gtttctgcgggctcacctccat

SEQ ID NO: 215596 - DNA, 18 bp, Mus musculus
ggagaggaagtgtggtct

SEQ ID NO: 215597 - DNA, 23 bp, Mus musculus
tgtgtctgcgtgtgcatgtgcat

SEQ ID NO: 215598 - DNA, 23 bp, Mus musculus
gctctctccctctctgtgtgcca

SEQ ID NO: 215599 - DNA, 23 bp, Mus musculus
atgtgggtctcagtctgtcacag

SEQ ID NO: 215600 - DNA, 19 bp, Mus musculus
agtggtagatggtgaaaca

SEQ ID NO: 215601 - DNA, 23 bp, Mus musculus
ctcactgtgtacagatgctgctg

SEQ ID NO: 215602 - DNA, 20 bp, Mus musculus
tatatgtgtatgtgcatgca

SEQ ID NO: 215603 - DNA, 23 bp, Mus musculus
gagagacacagaacccagtcagc

SEQ ID NO: 215604 - DNA, 23 bp, Mus musculus
tctgactgggtctgtggctctga

SEQ ID NO: 215605 - DNA, 19 bp, Mus musculus
agtccttgctctccaaggc

SEQ ID NO: 215606 - DNA, 19 bp, Mus musculus
ttttgtagttaaggctggc

SEQ ID NO: 215607 - DNA, 23 bp, Mus musculus
gagatctggacttgctgtgtaac

SEQ ID NO: 215608 - DNA, 23 bp, Mus musculus
tccaagtgctaggattacagaca

SEQ ID NO: 215609 - DNA, 19 bp, Mus musculus
gtatatatgtatgaatgca

SEQ ID NO: 215610 - DNA, 20 bp, Mus musculus
tgtatgtatgcatgaatgta

SEQ ID NO: 215611 - DNA, 23 bp, Mus musculus
tgcatgtatgaatgcatgtgtgt

SEQ ID NO: 215612 - DNA, 21 bp, Mus musculus
tattggttctcttgcatatgt

SEQ ID NO: 215613 - DNA, 23 bp, Mus musculus
tgaagtgggtattatttctccaa

SEQ ID NO: 215614 - DNA, 22 bp, Mus musculus
aggtctgtgaacatggtgaatg

SEQ ID NO: 215615 - DNA, 21 bp, Mus musculus
acacacgcacgcatacatgtg

SEQ ID NO: 215616 - DNA, 23 bp, Mus musculus
atctatccattttaacttgtaca

SEQ ID NO: 215617 - DNA, 21 bp, Mus musculus
aaacaagtggatgaagttgga

SEQ ID NO: 215618 - DNA, 23 bp, Mus musculus
gtgaatgtatatttttagctgtg

SEQ ID NO: 215619 - DNA, 22 bp, Mus musculus
tgttttgtgaccaattatatgg

SEQ ID NO: 215620 - DNA, 22 bp, Mus musculus
tgttttgtgaccaattatatgg

SEQ ID NO: 215621 - DNA, 22 bp, Mus musculus
tgttttgtgaccaattatatgg

SEQ ID NO: 215622 - DNA, 21 bp, Mus musculus
tcagactttatctctgtgtat

SEQ ID NO: 215623 - DNA, 22 bp, Mus musculus
atatgtatatattcatatgtca

SEQ ID NO: 215624 - DNA, 21 bp, Mus musculus
tgcatatatatgcatatatgt

SEQ ID NO: 215625 - DNA, 23 bp, Mus musculus
tatatatgtatatgtgtatatgt

SEQ ID NO: 215626 - DNA, 20 bp, Mus musculus
tgtatgtatgtatatatgta

SEQ ID NO: 215627 - DNA, 23 bp, Mus musculus
tatatgcatatgtgtatgtatgt

SEQ ID NO: 215628 - DNA, 23 bp, Mus musculus
tgtgtgtgtgtgtgtattcacat

SEQ ID NO: 215629 - DNA, 20 bp, Mus musculus
ttgcataagattatgtatgt

SEQ ID NO: 215630 - DNA, 19 bp, Mus musculus
gtgtcttcagtaccacacc

SEQ ID NO: 215631 - DNA, 23 bp, Mus musculus
tcgtctggtctcagtctgtcact

SEQ ID NO: 215632 - DNA, 23 bp, Mus musculus
atttgtatgtatatatgtgtgta

SEQ ID NO: 215633 - DNA, 23 bp, Mus musculus
gtacacatgtgtttttgttcatg

SEQ ID NO: 215634 - DNA, 19 bp, Mus musculus
ttgacacacactgacactc

SEQ ID NO: 215635 - DNA, 23 bp, Mus musculus
tgcatgtgtgtgtgcatgtgtat

SEQ ID NO: 215636 - DNA, 19 bp, Mus musculus
tggagcttgctctatccat

SEQ ID NO: 215637 - DNA, 23 bp, Mus musculus
catatgagttgagtctgtgcagt

SEQ ID NO: 215638 - DNA, 23 bp, Mus musculus
tggaatctcagcttgctgagctc

SEQ ID NO: 215639 - DNA, 23 bp, Mus musculus
tgtcagtctgtctgttgtctctc

SEQ ID NO: 215640 - DNA, 23 bp, Mus musculus
ctaccctcactctgatgatccca

SEQ ID NO: 215641 - DNA, 23 bp, Mus musculus
gtggctcagagtctctctggaag

SEQ ID NO: 215642 - DNA, 22 bp, Mus musculus
cagtgactagagtttctcctgt

SEQ ID NO: 215643 - DNA, 20 bp, Mus musculus
taggtgtaggtgtaggtgta

SEQ ID NO: 215644 - DNA, 21 bp, Mus musculus
acatacacacctatctatcta

SEQ ID NO: 215645 - DNA, 20 bp, Mus musculus
tgagaggctgcagtcaaggt

SEQ ID NO: 215646 - DNA, 23 bp, Mus musculus
gcaagaccatgctctcttctgac

SEQ ID NO: 215647 - DNA, 23 bp, Mus musculus
gttcatgtctgtgcatgtgcatg

SEQ ID NO: 215648 - DNA, 23 bp, Mus musculus
gctgcttcagtgagctaaagtct

SEQ ID NO: 215649 - DNA, 22 bp, Mus musculus
tactgtggcacatagagcagag

SEQ ID NO: 215650 - DNA, 20 bp, Mus musculus
ctctctctcagtgtctctgc

SEQ ID NO: 215651 - DNA, 23 bp, Mus musculus
tatgtgcacatatgatatgtatc

SEQ ID NO: 215652 - DNA, 21 bp, Mus musculus
tagatgtggatgtgaaagtat

SEQ ID NO: 215653 - DNA, 18 bp, Mus musculus
tggaagctagagtctctt

SEQ ID NO: 215654 - DNA, 23 bp, Mus musculus
atcatgaccacagactctgtcac

SEQ ID NO: 215655 - DNA, 22 bp, Mus musculus
tgttttgtgaccaattatatgg

SEQ ID NO: 215656 - DNA, 23 bp, Mus musculus
aacttgagaatcctacatacagc

SEQ ID NO: 215657 - DNA, 21 bp, Mus musculus
tccatggtggtctgataggat

SEQ ID NO: 215658 - DNA, 22 bp, Mus musculus
tgttttgtgaccaattatatgg

SEQ ID NO: 215659 - DNA, 23 bp, Mus musculus
actgtgtctctgttcagtttctg

SEQ ID NO: 215660 - DNA, 20 bp, Mus musculus
ctgtccattgatgagagtgg

SEQ ID NO: 215661 - DNA, 23 bp, Mus musculus
tgtatgtacatctatatgtgtaa

SEQ ID NO: 215662 - DNA, 23 bp, Mus musculus
gtatgtatgcatgtgtgtgtgta

SEQ ID NO: 215663 - DNA, 22 bp, Mus musculus
tgttttgtgaccaattatatgg

SEQ ID NO: 215664 - DNA, 22 bp, Mus musculus
tgttttgtgaccaattatatgg

SEQ ID NO: 215665 - DNA, 23 bp, Mus musculus
tatttagtgcatttgttgttctg

SEQ ID NO: 215666 - DNA, 22 bp, Mus musculus
ttatgtgtctggaggaatttct

SEQ ID NO: 215667 - DNA, 22 bp, Mus musculus
tgttttgtgaccaattatatgg

SEQ ID NO: 215668 - DNA, 18 bp, Mus musculus
gtatgtatgtatgtatgt

SEQ ID NO: 215669 - DNA, 23 bp, Mus musculus
tgtgtgtgtgcatgtgttgtgta

SEQ ID NO: 215670 - DNA, 23 bp, Mus musculus
gtgtgtgtttgtgtgtgcatatg

SEQ ID NO: 215671 - DNA, 22 bp, Mus musculus
tgttttgtgaccaattatatgg

SEQ ID NO: 215672 - DNA, 19 bp, Mus musculus
atcatatcagagccatatt

SEQ ID NO: 215673 - DNA, 19 bp, Mus musculus
tgtgtgtgtgtgtgtatac

SEQ ID NO: 215674 - DNA, 23 bp, Mus musculus
atgtgtgtgtgcatgtgcatgtg

SEQ ID NO: 215675 - DNA, 23 bp, Mus musculus
tgtgtatgtgcatatgtatatgt

SEQ ID NO: 215676 - DNA, 23 bp, Mus musculus
tttcagaagtgtgagtgtacatt

SEQ ID NO: 215677 - DNA, 21 bp, Mus musculus
tccatggtggtctgataggat

SEQ ID NO: 215678 - DNA, 22 bp, Mus musculus
tgttttgtgaccaattatatgg

SEQ ID NO: 215679 - DNA, 18 bp, Mus musculus
acacactcaagcatggag

SEQ ID NO: 215680 - DNA, 21 bp, Mus musculus
taaaaggcactgtgtgtgtgt

SEQ ID NO: 215681 - DNA, 19 bp, Mus musculus
tagttgtgtcatgatgttg

SEQ ID NO: 215682 - DNA, 20 bp, Mus musculus
gaatgtaataagatgatgat

SEQ ID NO: 215683 - DNA, 23 bp, Mus musculus
gagaagactgtctgctttggatg

SEQ ID NO: 215684 - DNA, 20 bp, Mus musculus
actcagaactgagagagcag

SEQ ID NO: 215685 - DNA, 23 bp, Mus musculus
tagtgcatggtgatctgatagga

SEQ ID NO: 215686 - DNA, 23 bp, Mus musculus
tgttttgtgacctattatgtggt

SEQ ID NO: 215687 - DNA, 19 bp, Mus musculus
tgtacacatgtgtgtgtgt

SEQ ID NO: 215688 - DNA, 23 bp, Mus musculus
agtctgtttctcagattcttggg

SEQ ID NO: 215689 - DNA, 18 bp, Mus musculus
tgtggaagagttcagaat

SEQ ID NO: 215690 - DNA, 23 bp, Mus musculus
cctggctggctgcctctgtgcca

SEQ ID NO: 215691 - DNA, 19 bp, Mus musculus
ttgctgtcgtgtgtactgt

SEQ ID NO: 215692 - DNA, 23 bp, Mus musculus
gttcagggtgtgcagctcaattt

SEQ ID NO: 215693 - DNA, 23 bp, Mus musculus
gctattttgagcaaactaatggc

SEQ ID NO: 215694 - DNA, 23 bp, Mus musculus
ctatgtaacttgaggctctgcac

SEQ ID NO: 215695 - DNA, 23 bp, Mus musculus
aagactgctatgtgtctctcttg

SEQ ID NO: 215696 - DNA, 19 bp, Mus musculus
tatgaatctctcactctct

SEQ ID NO: 215697 - DNA, 22 bp, Mus musculus
tgttttgtgaccaattatatgg

SEQ ID NO: 215698 - DNA, 21 bp, Mus musculus
tgtatgtatatgtacgtgtat

SEQ ID NO: 215699 - DNA, 22 bp, Mus musculus
ccttcatctgcccactgctact

SEQ ID NO: 215700 - DNA, 22 bp, Mus musculus
tcacactgtgtgattatggtga

SEQ ID NO: 215701 - DNA, 22 bp, Mus musculus
ctcacactggtgactgtggtga

SEQ ID NO: 215702 - DNA, 21 bp, Mus musculus
tcactctatctgtctgtctga

SEQ ID NO: 215703 - DNA, 23 bp, Mus musculus
tcagaagcaatctgtgtctgtct

SEQ ID NO: 215704 - DNA, 23 bp, Mus musculus
cagctcacactgtctgattgtct

SEQ ID NO: 215705 - DNA, 21 bp, Mus musculus
tgtcaatcactgttgtagtga

SEQ ID NO: 215706 - DNA, 18 bp, Mus musculus
actggagagatggctcat

SEQ ID NO: 215707 - DNA, 23 bp, Mus musculus
agtctggcagtctgtgtgcctgt

SEQ ID NO: 215708 - DNA, 21 bp, Mus musculus
agagactctcgctcactgctg

SEQ ID NO: 215709 - DNA, 23 bp, Mus musculus
aatgacaggcagcattgttgggc

SEQ ID NO: 215710 - DNA, 23 bp, Mus musculus
cagtgcctaaccatgttctctct

SEQ ID NO: 215711 - DNA, 22 bp, Mus musculus
agaggtgtctcactgtgtgtgt

SEQ ID NO: 215712 - DNA, 18 bp, Mus musculus
aaagacagcgtcactatg

SEQ ID NO: 215713 - DNA, 20 bp, Mus musculus
agtgagtagtgagtgtgccc

SEQ ID NO: 215714 - DNA, 22 bp, Mus musculus
atggacagacagacatactgct

SEQ ID NO: 215715 - DNA, 23 bp, Mus musculus
gtatgtacatatgtatgtgtgtg

SEQ ID NO: 215716 - DNA, 19 bp, Mus musculus
gtactctctgtctcagcat

SEQ ID NO: 215717 - DNA, 23 bp, Mus musculus
tgggagtagttgttgctctagaa

SEQ ID NO: 215718 - DNA, 23 bp, Mus musculus
acaggaagacctacagagtcaac

SEQ ID NO: 215719 - DNA, 20 bp, Mus musculus
agacccacaagtgttgcaca

SEQ ID NO: 215720 - DNA, 23 bp, Mus musculus
tcactgcatgggtcactcagaga

SEQ ID NO: 215721 - DNA, 21 bp, Mus musculus
tatctgcctccctgaatgcca

SEQ ID NO: 215722 - DNA, 22 bp, Mus musculus
tatatgtatgtaagcatgtgtg

SEQ ID NO: 215723 - DNA, 20 bp, Mus musculus
tgtcagatgactgagatgac

SEQ ID NO: 215724 - DNA, 22 bp, Mus musculus
gtgtgtgtgtgtgtgtgtacgt

SEQ ID NO: 215725 - DNA, 20 bp, Mus musculus
tcagtgagagcactggctct

SEQ ID NO: 215726 - DNA, 23 bp, Mus musculus
tcctgcctgtgtgactcactgtc

SEQ ID NO: 215727 - DNA, 23 bp, Mus musculus
tgtctgtctgtctgtccatgtga

SEQ ID NO: 215728 - DNA, 19 bp, Mus musculus
tttactaaggatagactgc

SEQ ID NO: 215729 - DNA, 22 bp, Mus musculus
taagagcacacttagcaattct

SEQ ID NO: 215730 - DNA, 21 bp, Mus musculus
atacacacatatatacatatg

SEQ ID NO: 215731 - DNA, 18 bp, Mus musculus
gtagtaggtcttcaggct

SEQ ID NO: 215732 - DNA, 21 bp, Mus musculus
tgagtgtatgtttgtgtgtac

SEQ ID NO: 215733 - DNA, 21 bp, Mus musculus
tgagacacaaacactctctct

SEQ ID NO: 215734 - DNA, 23 bp, Mus musculus
tgtatgtatatatgtgtatgtgt

SEQ ID NO: 215735 - DNA, 23 bp, Mus musculus
atgaagtctcagcgactcttctc

SEQ ID NO: 215736 - DNA, 19 bp, Mus musculus
tggtacatagatgttaaga

SEQ ID NO: 215737 - DNA, 23 bp, Mus musculus
tctatattgatcaccatctactg

SEQ ID NO: 215738 - DNA, 22 bp, Mus musculus
tgttttgtgaccaattatatgg

SEQ ID NO: 215739 - DNA, 23 bp, Mus musculus
tttggttctgattttgttctata

SEQ ID NO: 215740 - DNA, 22 bp, Mus musculus
taagtcattggtattgttgaga

SEQ ID NO: 215741 - DNA, 22 bp, Mus musculus
ccactgtcagcctgtctgcttg

SEQ ID NO: 215742 - DNA, 21 bp, Mus musculus
tatgcatgtatgtgtgtgtgt

SEQ ID NO: 215743 - DNA, 22 bp, Mus musculus
agagcatgaacaaaggaagtag

SEQ ID NO: 215744 - DNA, 23 bp, Mus musculus
tatggatatgtgtgtatttgata

SEQ ID NO: 215745 - DNA, 23 bp, Mus musculus
tagtgcatatatttatgtatact

SEQ ID NO: 215746 - DNA, 23 bp, Mus musculus
tggagacagcagagtgagacctc

SEQ ID NO: 215747 - DNA, 23 bp, Mus musculus
tcccactgagtgctgctccttct

SEQ ID NO: 215748 - DNA, 22 bp, Mus musculus
acaccattcctgttgttgctgg

SEQ ID NO: 215749 - DNA, 23 bp, Mus musculus
tgtgtgtgtatgtgcttgtgcat

SEQ ID NO: 215750 - DNA, 22 bp, Mus musculus
tgggttctagttggattccact

SEQ ID NO: 215751 - DNA, 23 bp, Mus musculus
atttgctaagaaaagtaatatag

SEQ ID NO: 215752 - DNA, 19 bp, Mus musculus
tcataccccaatatttctg

SEQ ID NO: 215753 - DNA, 21 bp, Mus musculus
acagtgactgaattgggaagt

SEQ ID NO: 215754 - DNA, 22 bp, Mus musculus
tgttttgtgaccaattatatgg

SEQ ID NO: 215755 - DNA, 20 bp, Mus musculus
ataaaatcaggtatacattt

SEQ ID NO: 215756 - DNA, 23 bp, Mus musculus
cactgactctgacaaactagttc

SEQ ID NO: 215757 - DNA, 23 bp, Mus musculus
tttatctcagtgcaaatgagatg

SEQ ID NO: 215758 - DNA, 19 bp, Mus musculus
attgttagaaataaattgt

SEQ ID NO: 215759 - DNA, 22 bp, Mus musculus
tttgtatgtgtctgcctatcta

SEQ ID NO: 215760 - DNA, 19 bp, Mus musculus
atgtatgttgtatacatat

SEQ ID NO: 215761 - DNA, 22 bp, Mus musculus
tatatgtgtgttgtatatatgt

SEQ ID NO: 215762 - DNA, 18 bp, Mus musculus
ttgaataagaatggccct

SEQ ID NO: 215763 - DNA, 22 bp, Mus musculus
tcactgcctctcccactggtta

SEQ ID NO: 215764 - DNA, 22 bp, Mus musculus
tactctgggatgaatttgtgta

SEQ ID NO: 215765 - DNA, 21 bp, Mus musculus
tgtgtgtgtgattctctggat

SEQ ID NO: 215766 - DNA, 23 bp, Mus musculus
atatgtatgtatatgtatgtgta

SEQ ID NO: 215767 - DNA, 23 bp, Mus musculus
gcacactgtgtgactgacagcca

SEQ ID NO: 215768 - DNA, 23 bp, Mus musculus
tagtccatcatgatctgatagga

SEQ ID NO: 215769 - DNA, 21 bp, Mus musculus
tattgtgtgttgggaagaatg

SEQ ID NO: 215770 - DNA, 22 bp, Mus musculus
atcaagaatgttgaatgctgta

SEQ ID NO: 215771 - DNA, 23 bp, Mus musculus
tatgattactgagtttgctgatg

SEQ ID NO: 215772 - DNA, 23 bp, Mus musculus
tgagtcattctctgttttctata

SEQ ID NO: 215773 - DNA, 23 bp, Mus musculus
atgtgtatgtatgtatgtgtgtg

SEQ ID NO: 215774 - DNA, 23 bp, Mus musculus
tattcatatatatacatatgtgt

SEQ ID NO: 215775 - DNA, 23 bp, Mus musculus
tatgtgtatatgaagaggttcac

SEQ ID NO: 215776 - DNA, 22 bp, Mus musculus
agaaggctgctgatgctggcat

SEQ ID NO: 215777 - DNA, 23 bp, Mus musculus
actagctgttctgtgtgtatgtc

SEQ ID NO: 215778 - DNA, 22 bp, Mus musculus
tgttttgtgaccaattatatgg

SEQ ID NO: 215779 - DNA, 19 bp, Mus musculus
atatacagaatatatacat

SEQ ID NO: 215780 - DNA, 22 bp, Mus musculus
tgttttgtgaccaattatatgg

SEQ ID NO: 215781 - DNA, 23 bp, Mus musculus
aagtccaacttcatttcatcaaa

SEQ ID NO: 215782 - DNA, 23 bp, Mus musculus
agaaaaatgaggtatttctagtg

SEQ ID NO: 215783 - DNA, 19 bp, Mus musculus
tgcacgatacaaaatcagt

SEQ ID NO: 215784 - DNA, 23 bp, Mus musculus
ctgttgatggtataatgtgttca

SEQ ID NO: 215785 - DNA, 20 bp, Mus musculus
actgctggacatgcagagtg

SEQ ID NO: 215786 - DNA, 23 bp, Mus musculus
agatatgtatatatgtataactg

SEQ ID NO: 215787 - DNA, 23 bp, Mus musculus
tagtccatgatgacctgattgga

SEQ ID NO: 215788 - DNA, 21 bp, Mus musculus
ttgttttgttaccaattgtgt

SEQ ID NO: 215789 - DNA, 22 bp, Mus musculus
tagatagatttagatttagatt

SEQ ID NO: 215790 - DNA, 22 bp, Mus musculus
tgttttgtgaccaattatatgg

SEQ ID NO: 215791 - DNA, 23 bp, Mus musculus
tttagatgcttcactgcagttca

SEQ ID NO: 215792 - DNA, 22 bp, Mus musculus
tgagctagtacgttgattataa

SEQ ID NO: 215793 - DNA, 23 bp, Mus musculus
atgtatatatgcttgtatgcaca

SEQ ID NO: 215794 - DNA, 20 bp, Mus musculus
tgtgtatatatatgtgtgtg

SEQ ID NO: 215795 - DNA, 21 bp, Mus musculus
ttatgtcagcttttcctctct

SEQ ID NO: 215796 - DNA, 23 bp, Mus musculus
atataatcaggttttgttttgaa

SEQ ID NO: 215797 - DNA, 20 bp, Mus musculus
actgtttctcagtgattaca

SEQ ID NO: 215798 - DNA, 23 bp, Mus musculus
tgtctctctctcaattatgtgtg

SEQ ID NO: 215799 - DNA, 21 bp, Mus musculus
cacccaaccatgtgttggcca

SEQ ID NO: 215800 - DNA, 23 bp, Mus musculus
tgtgtatgtgtatgtatttgggt

SEQ ID NO: 215801 - DNA, 23 bp, Mus musculus
tgtctctgtgagtctctgccagt

SEQ ID NO: 215802 - DNA, 23 bp, Mus musculus
aaaccatgagtagcaatgtcagt

SEQ ID NO: 215803 - DNA, 22 bp, Mus musculus
tagtatgtatatatcaaaatgt

SEQ ID NO: 215804 - DNA, 18 bp, Mus musculus
gatcacaaaagatgttga

SEQ ID NO: 215805 - DNA, 23 bp, Mus musculus
ctagtgcctgaggctctgttcag

SEQ ID NO: 215806 - DNA, 23 bp, Mus musculus
tgacagagagtcagtcacatcag

SEQ ID NO: 215807 - DNA, 23 bp, Mus musculus
tatgtatatgtatatgtatacgt

SEQ ID NO: 215808 - DNA, 23 bp, Mus musculus
atgagagtgcaacagctgtgtct

SEQ ID NO: 215809 - DNA, 23 bp, Mus musculus
aatgagaaatgaaattgttgtac

SEQ ID NO: 215810 - DNA, 22 bp, Mus musculus
ttctcacactctgagttccagc

SEQ ID NO: 215811 - DNA, 23 bp, Mus musculus
gggtctctctgtgtatctctcac

SEQ ID NO: 215812 - DNA, 23 bp, Mus musculus
atgaatatctaagtctatatgtt

SEQ ID NO: 215813 - DNA, 23 bp, Mus musculus
tagagaggtgtttatgtacttgt

SEQ ID NO: 215814 - DNA, 22 bp, Mus musculus
tgttttgtgaccaattatatgg

SEQ ID NO: 215815 - DNA, 22 bp, Mus musculus
tgtgtgggtatattgtgtctgt

SEQ ID NO: 215816 - DNA, 18 bp, Mus musculus
tgtgtgtgcgtatgtatg

SEQ ID NO: 215817 - DNA, 19 bp, Mus musculus
tatgtgtatatgtatatgt

SEQ ID NO: 215818 - DNA, 23 bp, Mus musculus
tatgtaagtgtatataatatgca

SEQ ID NO: 215819 - DNA, 23 bp, Mus musculus
gttaagtgtcgtattaaattgtc

SEQ ID NO: 215820 - DNA, 18 bp, Mus musculus
tgtcataaattatgcagt

SEQ ID NO: 215821 - DNA, 22 bp, Mus musculus
aatgaactacttagcatgctga

SEQ ID NO: 215822 - DNA, 23 bp, Mus musculus
agatgttttgtgtgtatgtctat

SEQ ID NO: 215823 - DNA, 23 bp, Mus musculus
atgcatgtacatgtgtatgtgtc

SEQ ID NO: 215824 - DNA, 23 bp, Mus musculus
tgtatgtatgtatgtatgtatgt

SEQ ID NO: 215825 - DNA, 23 bp, Mus musculus
tgacatctgtatttgttattgtg

SEQ ID NO: 215826 - DNA, 22 bp, Mus musculus
atgtatgtatgtgtgtgtgtat

SEQ ID NO: 215827 - DNA, 23 bp, Mus musculus
atatttgcttatgtaacagtttt

SEQ ID NO: 215828 - DNA, 22 bp, Mus musculus
gcatatgtatatgtatgtgtat

SEQ ID NO: 215829 - DNA, 23 bp, Mus musculus
tatgcatgtgcatgtgcatgtgt

SEQ ID NO: 215830 - DNA, 22 bp, Mus musculus
tgttttgtgaccaattatatgg

SEQ ID NO: 215831 - DNA, 18 bp, Mus musculus
tggtggtctgaaagaatg

SEQ ID NO: 215832 - DNA, 23 bp, Mus musculus
atatatgtatatgtgtacatgtg

SEQ ID NO: 215833 - DNA, 23 bp, Mus musculus
acactcacagtaactcattcatc

SEQ ID NO: 215834 - DNA, 23 bp, Mus musculus
tgtctgtgtgtctgtgtgtctgt

SEQ ID NO: 215835 - DNA, 23 bp, Mus musculus
actctcagactctcattacgggt

SEQ ID NO: 215836 - DNA, 20 bp, Mus musculus
taatctaagatatcacatga

SEQ ID NO: 215837 - DNA, 22 bp, Mus musculus
tgtcactctttgtcactgtgaa

SEQ ID NO: 215838 - DNA, 22 bp, Mus musculus
tgttttgtgaccaattatatgg

SEQ ID NO: 215839 - DNA, 21 bp, Mus musculus
tagacaaatgcacatattcat

SEQ ID NO: 215840 - DNA, 23 bp, Mus musculus
catcaagaaatcttttccttccc

SEQ ID NO: 215841 - DNA, 22 bp, Mus musculus
attgcatgtatatatgtatgta

SEQ ID NO: 215842 - DNA, 23 bp, Mus musculus
agtttgtgctttgtgtctctctg

SEQ ID NO: 215843 - DNA, 20 bp, Mus musculus
tatgctgaggggctggagag

SEQ ID NO: 215844 - DNA, 20 bp, Mus musculus
ggcagtcactgtggtggctg

SEQ ID NO: 215845 - DNA, 23 bp, Mus musculus
tgatttgaattgatgttgtaggt

SEQ ID NO: 215846 - DNA, 23 bp, Mus musculus
agtaacagaatacatttccagac

SEQ ID NO: 215847 - DNA, 18 bp, Mus musculus
tagcctgtacaatggaag

SEQ ID NO: 215848 - DNA, 19 bp, Mus musculus
tatgtatatatatgtgtgt

SEQ ID NO: 215849 - DNA, 22 bp, Mus musculus
tgttttgtgaccaattatatgg

SEQ ID NO: 215850 - DNA, 22 bp, Mus musculus
tggggtagaaggttgcttagaa

SEQ ID NO: 215851 - DNA, 22 bp, Mus musculus
tgacaagttgacagagtcctct

SEQ ID NO: 215852 - DNA, 23 bp, Mus musculus
cagtctgtctgtctgtctgtctg

SEQ ID NO: 215853 - DNA, 23 bp, Mus musculus
gtgtatacacatgtgtgtgtaca

SEQ ID NO: 215854 - DNA, 21 bp, Mus musculus
taaagtgttcaggctggagag

SEQ ID NO: 215855 - DNA, 23 bp, Mus musculus
cgtttgtctctctgtgtctgggt

SEQ ID NO: 215856 - DNA, 22 bp, Mus musculus
tgttttgtgaccaattatatgg

SEQ ID NO: 215857 - DNA, 23 bp, Mus musculus
gaatgtgtgtgtctgtgtttctc

SEQ ID NO: 215858 - DNA, 23 bp, Mus musculus
tgtgcatatatatattgtgtgtg

SEQ ID NO: 215859 - DNA, 22 bp, Mus musculus
atttcagattctttttgttcac

SEQ ID NO: 215860 - DNA, 23 bp, Mus musculus
tgaattgaaccgtctcttagcgt

SEQ ID NO: 215861 - DNA, 21 bp, Mus musculus
tatgcataacctgcaacttct

SEQ ID NO: 215862 - DNA, 23 bp, Mus musculus
tatgtattctatgtggagagaat

SEQ ID NO: 215863 - DNA, 23 bp, Mus musculus
tgtctgtctcagtcagctgctgg

SEQ ID NO: 215864 - DNA, 23 bp, Mus musculus
tcagtctgtctgtctgcctgtca

SEQ ID NO: 215865 - DNA, 18 bp, Mus musculus
gaggtggttctcttcttg

SEQ ID NO: 215866 - DNA, 23 bp, Mus musculus
aacacacagtgacgtatacttgt

SEQ ID NO: 215867 - DNA, 23 bp, Mus musculus
agtgtctcactctgtcttcccac

SEQ ID NO: 215868 - DNA, 23 bp, Mus musculus
gtctgtctgtgtgtctgtcggtg

SEQ ID NO: 215869 - DNA, 23 bp, Mus musculus
actatctgcatatggaaatcaga

SEQ ID NO: 215870 - DNA, 23 bp, Mus musculus
cagtaaactgtgagctgtggttg

SEQ ID NO: 215871 - DNA, 23 bp, Mus musculus
atgacatgtctctgtctgaggtg

SEQ ID NO: 215872 - DNA, 19 bp, Mus musculus
tgcatgcatgcacctgtgt

SEQ ID NO: 215873 - DNA, 23 bp, Mus musculus
gagcctcagtctgtcagtgctcg

SEQ ID NO: 215874 - DNA, 22 bp, Mus musculus
tgttttgtgaccaattatatgg

SEQ ID NO: 215875 - DNA, 19 bp, Mus musculus
tatatgtgtgtatttgatg

SEQ ID NO: 215876 - DNA, 23 bp, Mus musculus
tcagtggctctgtgcctccatct

SEQ ID NO: 215877 - DNA, 23 bp, Mus musculus
tgtgtgtatgtatgtatgtatgt

SEQ ID NO: 215878 - DNA, 23 bp, Mus musculus
tgcagctcagagtgcttcagcct

SEQ ID NO: 215879 - DNA, 20 bp, Mus musculus
tattcatatatattctgtat

SEQ ID NO: 215880 - DNA, 19 bp, Mus musculus
tgtgcatatgtatgtgtat

SEQ ID NO: 215881 - DNA, 23 bp, Mus musculus
atgtattgagatagatgcttgat

SEQ ID NO: 215882 - DNA, 18 bp, Mus musculus
tgagcacttgcaaacaag

SEQ ID NO: 215883 - DNA, 23 bp, Mus musculus
aacttcagcagcaaattgttctg

SEQ ID NO: 215884 - DNA, 23 bp, Mus musculus
ttgtactcaggtaagcattgcca

SEQ ID NO: 215885 - DNA, 23 bp, Mus musculus
aacagtttggaactggaggccat

SEQ ID NO: 215886 - DNA, 21 bp, Mus musculus
tttgtccctctgtcgctctgt

SEQ ID NO: 215887 - DNA, 22 bp, Mus musculus
tgttttgtgaccaattatatgg

SEQ ID NO: 215888 - DNA, 23 bp, Mus musculus
cgtgatgatctaataggatgcat

SEQ ID NO: 215889 - DNA, 23 bp, Mus musculus
atatatgtgtgtgtgtatatcat

SEQ ID NO: 215890 - DNA, 20 bp, Mus musculus
atgtctctgctgtatatgtg

SEQ ID NO: 215891 - DNA, 20 bp, Mus musculus
atacactatgtatatgtata

SEQ ID NO: 215892 - DNA, 23 bp, Mus musculus
tcacagtgctaagaattcagttt

SEQ ID NO: 215893 - DNA, 22 bp, Mus musculus
aacacccacaggttgtcttttg

SEQ ID NO: 215894 - DNA, 20 bp, Mus musculus
tgtgtgtgcatgtgcatgtg

SEQ ID NO: 215895 - DNA, 23 bp, Mus musculus
tctgcctctctgtcagtcaggtg

SEQ ID NO: 215896 - DNA, 23 bp, Mus musculus
tcaacactgtcactcagaatcac

SEQ ID NO: 215897 - DNA, 20 bp, Mus musculus
tttcggtcaggctttgtaca

SEQ ID NO: 215898 - DNA, 23 bp, Mus musculus
gtgtctgtcagtctgtctgcttg

SEQ ID NO: 215899 - DNA, 23 bp, Mus musculus
tgtctgtctgtccgtccgtctgt

SEQ ID NO: 215900 - DNA, 23 bp, Mus musculus
atatgtctgcatatgtatgccat

SEQ ID NO: 215901 - DNA, 23 bp, Mus musculus
tgtcatgtaattgttgtgtgcat

SEQ ID NO: 215902 - DNA, 23 bp, Mus musculus
atatgtgcatatatgtatatgtg

SEQ ID NO: 215903 - DNA, 23 bp, Mus musculus
tgtcattgggtgtggactttgag

SEQ ID NO: 215904 - DNA, 20 bp, Mus musculus
gccaggctcagtctctctgt

SEQ ID NO: 215905 - DNA, 21 bp, Mus musculus
tctgaaggaattgctatctgt

SEQ ID NO: 215906 - DNA, 22 bp, Mus musculus
atatgtatatatacatgtgtgt

SEQ ID NO: 215907 - DNA, 18 bp, Mus musculus
ctgtatatacacatacac

SEQ ID NO: 215908 - DNA, 23 bp, Mus musculus
aggaggtgagttaccaggagata

SEQ ID NO: 215909 - DNA, 22 bp, Mus musculus
gtatgcatgtatatatgtatgt

SEQ ID NO: 215910 - DNA, 23 bp, Mus musculus
cctctttgtgtctgtgtatggct

SEQ ID NO: 215911 - DNA, 22 bp, Mus musculus
ttcagtactgacttagttgtcc

SEQ ID NO: 215912 - DNA, 23 bp, Mus musculus
aagaccaacactaagttctttga

SEQ ID NO: 215913 - DNA, 23 bp, Mus musculus
tgtgtcactgagtgactgcactc

SEQ ID NO: 215914 - DNA, 23 bp, Mus musculus
tggaactggaactgcatgtgttt

SEQ ID NO: 215915 - DNA, 23 bp, Mus musculus
ctactgtccctctgtctctgcat

SEQ ID NO: 215916 - DNA, 18 bp, Mus musculus
cacactccatatgccagt

SEQ ID NO: 215917 - DNA, 23 bp, Mus musculus
tgagtggtgtgtgtgtgcacagt

SEQ ID NO: 215918 - DNA, 19 bp, Mus musculus
tgtcagtaggttagaagcc

SEQ ID NO: 215919 - DNA, 23 bp, Mus musculus
actctgtgtgtcagtggctctaa

SEQ ID NO: 215920 - DNA, 21 bp, Mus musculus
tgtgtgtgcatgtgcatgtgc

SEQ ID NO: 215921 - DNA, 23 bp, Mus musculus
ggtgacagtgatgagtgtggaca

SEQ ID NO: 215922 - DNA, 23 bp, Mus musculus
ctcagtgtcctgacagagcagat

SEQ ID NO: 215923 - DNA, 22 bp, Mus musculus
tgttttgtgaccaattatatgg

SEQ ID NO: 215924 - DNA, 23 bp, Mus musculus
gtatgtgtgcacatgggtttatg

SEQ ID NO: 215925 - DNA, 23 bp, Mus musculus
tgtgcatgagttttcatgtgtgt

SEQ ID NO: 215926 - DNA, 18 bp, Mus musculus
tgcgtgtgtgtgtgtgtg

SEQ ID NO: 215927 - DNA, 19 bp, Mus musculus
acatatatagtgtgtgtgt

SEQ ID NO: 215928 - DNA, 23 bp, Mus musculus
tgtgtgtgtccatgtgtgtgtgt

SEQ ID NO: 215929 - DNA, 19 bp, Mus musculus
atatatattgtgtatgcat

SEQ ID NO: 215930 - DNA, 23 bp, Mus musculus
agactagggtcacattcagcttt

SEQ ID NO: 215931 - DNA, 23 bp, Mus musculus
atacgtgtggttatgtatatatg

SEQ ID NO: 215932 - DNA, 18 bp, Mus musculus
tagagagaagaaagagag

SEQ ID NO: 215933 - DNA, 23 bp, Mus musculus
tggagagagaagacagactggca

SEQ ID NO: 215934 - DNA, 23 bp, Mus musculus
tacctggcagccaaagatgtgat

SEQ ID NO: 215935 - DNA, 21 bp, Mus musculus
ctgtctgtctgtgtcccatct

SEQ ID NO: 215936 - DNA, 22 bp, Mus musculus
gtctcagtgtgtgtgttcgtct

SEQ ID NO: 215937 - DNA, 18 bp, Mus musculus
acactagcatcacactgt

SEQ ID NO: 215938 - DNA, 23 bp, Mus musculus
tgtgtacatatatacatgtgtgt

SEQ ID NO: 215939 - DNA, 22 bp, Mus musculus
tctgtgcctgtctccctgcttc

SEQ ID NO: 215940 - DNA, 23 bp, Mus musculus
actgactcttcaaagctgaaatg

SEQ ID NO: 215941 - DNA, 23 bp, Mus musculus
atttgccttatgtatcagctgtg

SEQ ID NO: 215942 - DNA, 22 bp, Mus musculus
tctctggctgctttctcacctt

SEQ ID NO: 215943 - DNA, 23 bp, Mus musculus
tgaacaatgaatggactctgttt

SEQ ID NO: 215944 - DNA, 23 bp, Mus musculus
tcacgttctatgttgtatctcag

SEQ ID NO: 215945 - DNA, 23 bp, Mus musculus
tatgtctgtacatgtggatcttt

SEQ ID NO: 215946 - DNA, 23 bp, Mus musculus
aatgacagagatctgatctgcat

SEQ ID NO: 215947 - DNA, 18 bp, Mus musculus
tgcatgagtctaagttgt

SEQ ID NO: 215948 - DNA, 18 bp, Mus musculus
actggagagatggctcaa

SEQ ID NO: 215949 - DNA, 23 bp, Mus musculus
aaagtcagccagctatgttcagg

SEQ ID NO: 215950 - DNA, 21 bp, Mus musculus
tgtctcttagtctctgtccta

SEQ ID NO: 215951 - DNA, 23 bp, Mus musculus
actctcagtgcctctggaactag

SEQ ID NO: 215952 - DNA, 19 bp, Mus musculus
agcactcagtggattctgt

SEQ ID NO: 215953 - DNA, 23 bp, Mus musculus
tgtcttcatttaggaaccacagt

SEQ ID NO: 215954 - DNA, 23 bp, Mus musculus
agacagaagagaatgagatcaag

SEQ ID NO: 215955 - DNA, 18 bp, Mus musculus
ttcacccagatttctcat

SEQ ID NO: 215956 - DNA, 23 bp, Mus musculus
agtctgggctctctctcactgtc

SEQ ID NO: 215957 - DNA, 19 bp, Mus musculus
atagcacaagagtagggaa

SEQ ID NO: 215958 - DNA, 22 bp, Mus musculus
tctgcagagtgtgatagatgag

SEQ ID NO: 215959 - DNA, 23 bp, Mus musculus
atggtagaattgactctctttct

SEQ ID NO: 215960 - DNA, 19 bp, Mus musculus
taaaactgaggaaacggtt

SEQ ID NO: 215961 - DNA, 23 bp, Mus musculus
ccatgtgtgtggaagatctgtca

SEQ ID NO: 215962 - DNA, 23 bp, Mus musculus
agtccaaatccttccataactca

SEQ ID NO: 215963 - DNA, 23 bp, Mus musculus
ctgagtgagcaagcattaaggaa

SEQ ID NO: 215964 - DNA, 20 bp, Mus musculus
tgatagttactgaagaggca

SEQ ID NO: 215965 - DNA, 23 bp, Mus musculus
ctggctctgtctctgggtctcgg

SEQ ID NO: 215966 - DNA, 21 bp, Mus musculus
tggcagaggaaagttgttctc

SEQ ID NO: 215967 - DNA, 23 bp, Mus musculus
ctctgtctatgtctctgcaggac

SEQ ID NO: 215968 - DNA, 18 bp, Mus musculus
ctctgggtgaaagttggc

SEQ ID NO: 215969 - DNA, 23 bp, Mus musculus
tttctcacctacactctgtgact

SEQ ID NO: 215970 - DNA, 19 bp, Mus musculus
atatactatgcttatgtgt

SEQ ID NO: 215971 - DNA, 23 bp, Mus musculus
atgtatgtgtgtatatgtatatg

SEQ ID NO: 215972 - DNA, 23 bp, Mus musculus
tgtgtgtgtattgtatatatgta

SEQ ID NO: 215973 - DNA, 22 bp, Mus musculus
gttgtgacttctgatccatctg

SEQ ID NO: 215974 - DNA, 23 bp, Mus musculus
aagagacttggcttggagtttct

SEQ ID NO: 215975 - DNA, 22 bp, Mus musculus
taagcacatatctatcttagct

SEQ ID NO: 215976 - DNA, 23 bp, Mus musculus
tcacagaagaaactgtcctcagt

SEQ ID NO: 215977 - DNA, 19 bp, Mus musculus
aactcacagtggtaaggca

SEQ ID NO: 215978 - DNA, 21 bp, Mus musculus
agtgacaggacacagagcaca

SEQ ID NO: 215979 - DNA, 22 bp, Mus musculus
tgttttgtgaccaattatatgg

SEQ ID NO: 215980 - DNA, 22 bp, Mus musculus
agagtttggctgggtatagtag

SEQ ID NO: 215981 - DNA, 23 bp, Mus musculus
tctcagtgtctgtataacatctg

SEQ ID NO: 215982 - DNA, 21 bp, Mus musculus
ttgtatgtatgcatgtgtgtg

SEQ ID NO: 215983 - DNA, 23 bp, Mus musculus
aggatgaccgttacttttctgaa

SEQ ID NO: 215984 - DNA, 20 bp, Mus musculus
cagcgtgacttatcaagatg

SEQ ID NO: 215985 - DNA, 23 bp, Mus musculus
ctcagactgtctgtctttctggg

SEQ ID NO: 215986 - DNA, 23 bp, Mus musculus
tcagactgggagcataagaagtg

SEQ ID NO: 215987 - DNA, 23 bp, Mus musculus
ctctcagcttcctgtttgtcctt

SEQ ID NO: 215988 - DNA, 22 bp, Mus musculus
tgttttgtgaccaattatatgg

SEQ ID NO: 215989 - DNA, 23 bp, Mus musculus
tgagtctctgacagtttccttag

SEQ ID NO: 215990 - DNA, 22 bp, Mus musculus
gagggaatgcttcagtttggga

SEQ ID NO: 215991 - DNA, 23 bp, Mus musculus
agtctgtctgtctgactgtctgc

SEQ ID NO: 215992 - DNA, 23 bp, Mus musculus
cttctgagagatcctgctgtgca

SEQ ID NO: 215993 - DNA, 23 bp, Mus musculus
tctctgtctgtctgtctgtatat

SEQ ID NO: 215994 - DNA, 21 bp, Mus musculus
tcacacacacgcacacttagg

SEQ ID NO: 215995 - DNA, 23 bp, Mus musculus
tatatgtatgtatatatgtgtgt

SEQ ID NO: 215996 - DNA, 22 bp, Mus musculus
tagcagactggctgttctttat

SEQ ID NO: 215997 - DNA, 18 bp, Mus musculus
atcttggagaaagccatt

SEQ ID NO: 215998 - DNA, 23 bp, Mus musculus
aatcagagcaattatgattgcac

SEQ ID NO: 215999 - DNA, 23 bp, Mus musculus
atgtaggctgaccttgaactcat

SEQ ID NO: 216000 - DNA, 22 bp, Mus musculus
tgtgcatgtatgtatgtatgta

SEQ ID NO: 216001 - DNA, 21 bp, Mus musculus
atagagactgaacacactgag

SEQ ID NO: 216002 - DNA, 23 bp, Mus musculus
gtcactggctctgttcacttgct

SEQ ID NO: 216003 - DNA, 18 bp, Mus musculus
tggtgattctggttggag

SEQ ID NO: 216004 - DNA, 23 bp, Mus musculus
gtatgtatgtacgtgtgtgtgtg

SEQ ID NO: 216005 - DNA, 22 bp, Mus musculus
tgttttgtgaccaattatatgg

SEQ ID NO: 216006 - DNA, 22 bp, Mus musculus
taaagatcctttccaaatctgt

SEQ ID NO: 216007 - DNA, 23 bp, Mus musculus
tgaaagaacagtctctgctctca

SEQ ID NO: 216008 - DNA, 22 bp, Mus musculus
tgttttgtgaccaattatatgg

SEQ ID NO: 216009 - DNA, 22 bp, Mus musculus
tgttttgtgaccaattatatgg

SEQ ID NO: 216010 - DNA, 23 bp, Mus musculus
acacagcttcatcttcatgtagg

SEQ ID NO: 216011 - DNA, 23 bp, Mus musculus
gtgttaactgtttttgtagatgt

SEQ ID NO: 216012 - DNA, 23 bp, Mus musculus
tgaaaaagtagtgctacattgga

SEQ ID NO: 216013 - DNA, 21 bp, Mus musculus
tatgtatatgtacatgtacat

SEQ ID NO: 216014 - DNA, 23 bp, Mus musculus
ctaggatgtactggggtatgaag

SEQ ID NO: 216015 - DNA, 23 bp, Mus musculus
tgacatcattacacattctccct

SEQ ID NO: 216016 - DNA, 22 bp, Mus musculus
ttgtctgtgtttgagatgtgtg

SEQ ID NO: 216017 - DNA, 22 bp, Mus musculus
tgttttgtgaccaattatatgg

SEQ ID NO: 216018 - DNA, 23 bp, Mus musculus
tcacagatgtcattctcttccac

SEQ ID NO: 216019 - DNA, 23 bp, Mus musculus
tgtgtatatgtatatgtatatct

SEQ ID NO: 216020 - DNA, 23 bp, Mus musculus
tctgaggatatattgctcttata

SEQ ID NO: 216021 - DNA, 20 bp, Mus musculus
tctcttgatatatatgtgtg

SEQ ID NO: 216022 - DNA, 23 bp, Mus musculus
aagagacagcatctgaacagaag

SEQ ID NO: 216023 - DNA, 20 bp, Mus musculus
cttgcaccttgagatgctgt

SEQ ID NO: 216024 - DNA, 18 bp, Mus musculus
tctgcttttctttgattc

SEQ ID NO: 216025 - DNA, 19 bp, Mus musculus
atcagaagacagactgctc

SEQ ID NO: 216026 - DNA, 23 bp, Mus musculus
gtgtgtgatatctgtctgtctgt

SEQ ID NO: 216027 - DNA, 22 bp, Mus musculus
ctgttgtctctgtttcagcact

SEQ ID NO: 216028 - DNA, 22 bp, Mus musculus
agagtgaagagacacagctgaa

SEQ ID NO: 216029 - DNA, 23 bp, Mus musculus
ccaggcactcactgcctgtgtat

SEQ ID NO: 216030 - DNA, 22 bp, Mus musculus
gtgtgtgtgtacatatgtgtgt

SEQ ID NO: 216031 - DNA, 23 bp, Mus musculus
gcactgcttgtgtgtctagggtc

SEQ ID NO: 216032 - DNA, 23 bp, Mus musculus
atcctctctcaggcactgatgtg

SEQ ID NO: 216033 - DNA, 21 bp, Mus musculus
tcacatgtctctagtcacttg

SEQ ID NO: 216034 - DNA, 21 bp, Mus musculus
tcagagtggccagactgagtc

SEQ ID NO: 216035 - DNA, 22 bp, Mus musculus
ttctgagtgtccctgtctctct

SEQ ID NO: 216036 - DNA, 23 bp, Mus musculus
acacagtctgcctgccttttctg

SEQ ID NO: 216037 - DNA, 23 bp, Mus musculus
tggtgtgggtgctcagagggtct

SEQ ID NO: 216038 - DNA, 23 bp, Mus musculus
caagtcactcactgtgtgactgc

SEQ ID NO: 216039 - DNA, 23 bp, Mus musculus
ctgtgtcactgtgtgtacatggg

SEQ ID NO: 216040 - DNA, 23 bp, Mus musculus
tctcactgactcggactcttggc

SEQ ID NO: 216041 - DNA, 21 bp, Mus musculus
catgcctgtctcactgagtga

SEQ ID NO: 216042 - DNA, 22 bp, Mus musculus
tatgtatgtgcatatgtatgtg

SEQ ID NO: 216043 - DNA, 21 bp, Mus musculus
ctccttcattctcagtctgta

SEQ ID NO: 216044 - DNA, 23 bp, Mus musculus
gggtcagtctctctctctgcctg

SEQ ID NO: 216045 - DNA, 19 bp, Mus musculus
atatatgtgtatgtatatg

SEQ ID NO: 216046 - DNA, 21 bp, Mus musculus
tgtgtcccactctgagcctct

SEQ ID NO: 216047 - DNA, 23 bp, Mus musculus
ttcagatctgtctgtctctgtcc

SEQ ID NO: 216048 - DNA, 20 bp, Mus musculus
tgggtgagatatttttttct

SEQ ID NO: 216049 - DNA, 19 bp, Mus musculus
aagtgctagaattactggc

SEQ ID NO: 216050 - DNA, 23 bp, Mus musculus
ctgagtcagtcagaggacagtga

SEQ ID NO: 216051 - DNA, 23 bp, Mus musculus
tgtctctgaacagactgaggttg

SEQ ID NO: 216052 - DNA, 23 bp, Mus musculus
tctgtctccctcagaaactggaa

SEQ ID NO: 216053 - DNA, 23 bp, Mus musculus
tgaatgtgtgcatgtgcatgcat

SEQ ID NO: 216054 - DNA, 23 bp, Mus musculus
tgaatgtgtgcatgtgcatgcat

SEQ ID NO: 216055 - DNA, 23 bp, Mus musculus
gagtctgtgagtgtgtctctgtg

SEQ ID NO: 216056 - DNA, 23 bp, Mus musculus
tggctggctggctgggtctctgg

SEQ ID NO: 216057 - DNA, 18 bp, Mus musculus
aacacccttctgtctgct

SEQ ID NO: 216058 - DNA, 23 bp, Mus musculus
ttctttattcattaggggtttgg

SEQ ID NO: 216059 - DNA, 22 bp, Mus musculus
tgtaagctgaggaactgttctg

SEQ ID NO: 216060 - DNA, 23 bp, Mus musculus
tctctgacagtaaagtgtgccca

SEQ ID NO: 216061 - DNA, 22 bp, Mus musculus
gagagaattgaggctgagctct

SEQ ID NO: 216062 - DNA, 23 bp, Mus musculus
tgagtcagacaacagaatgagga

SEQ ID NO: 216063 - DNA, 22 bp, Mus musculus
ttctcagtaaggcatttgacat

SEQ ID NO: 216064 - DNA, 22 bp, Mus musculus
taagtgaacctgtaatgatgtc

SEQ ID NO: 216065 - DNA, 20 bp, Mus musculus
aaagtccattttgtgcagct

SEQ ID NO: 216066 - DNA, 20 bp, Mus musculus
cagtcatgtgatgctcctgc

SEQ ID NO: 216067 - DNA, 23 bp, Mus musculus
tgtctagggtctcactggctcac

SEQ ID NO: 216068 - DNA, 19 bp, Mus musculus
taagtgggccagtcagcgg

SEQ ID NO: 216069 - DNA, 23 bp, Mus musculus
tctcttgctctcagtgtccttgc

SEQ ID NO: 216070 - DNA, 23 bp, Mus musculus
tgcctgtctgtttgtctgtctga

SEQ ID NO: 216071 - DNA, 23 bp, Mus musculus
gaactacagacagttgtgagctg

SEQ ID NO: 216072 - DNA, 23 bp, Mus musculus
agttcagtgcctgtgttctcctg

SEQ ID NO: 216073 - DNA, 23 bp, Mus musculus
taacaatgagatggggctctgaa

SEQ ID NO: 216074 - DNA, 23 bp, Mus musculus
tgtcacactgtcacaaagccctg

SEQ ID NO: 216075 - DNA, 23 bp, Mus musculus
aagacagtaaagacagagttcag

SEQ ID NO: 216076 - DNA, 23 bp, Mus musculus
accagaagaagaagagaggctct

SEQ ID NO: 216077 - DNA, 23 bp, Mus musculus
ctgcctctgtgtctgcctctgga

SEQ ID NO: 216078 - DNA, 18 bp, Mus musculus
tgagggtgtggctcagtg

SEQ ID NO: 216079 - DNA, 23 bp, Mus musculus
tgcatgtgtgtgtatgtgtatat

SEQ ID NO: 216080 - DNA, 22 bp, Mus musculus
tatatgcatgtgtgtgtatgta

SEQ ID NO: 216081 - DNA, 20 bp, Mus musculus
tgcatgtgtgtatatatata

SEQ ID NO: 216082 - DNA, 22 bp, Mus musculus
atgcatgcatgtgtgtgtgtct

SEQ ID NO: 216083 - DNA, 22 bp, Mus musculus
agagcctgcctgtgtcctgtgc

SEQ ID NO: 216084 - DNA, 22 bp, Mus musculus
atccaccagatgtacgtgtaca

SEQ ID NO: 216085 - DNA, 23 bp, Mus musculus
acacacacacacaaagtggttgg

SEQ ID NO: 216086 - DNA, 22 bp, Mus musculus
ggactctcagtcactgccacgg

SEQ ID NO: 216087 - DNA, 18 bp, Mus musculus
atctgccgtgttcctgtg

SEQ ID NO: 216088 - DNA, 23 bp, Mus musculus
cagacagaaccgagtatgctaga

SEQ ID NO: 216089 - DNA, 23 bp, Mus musculus
tgtgacagaagactgttggctga

SEQ ID NO: 216090 - DNA, 19 bp, Mus musculus
atctgggctacaaagtcag

SEQ ID NO: 216091 - DNA, 20 bp, Mus musculus
tgactgcagaggcagaggag

SEQ ID NO: 216092 - DNA, 21 bp, Mus musculus
attgaaagaactcagtgggga

SEQ ID NO: 216093 - DNA, 22 bp, Mus musculus
tgttttgtgaccaattatatgg

SEQ ID NO: 216094 - DNA, 23 bp, Mus musculus
agtctgacagtctgacattgctc

SEQ ID NO: 216095 - DNA, 23 bp, Mus musculus
atcatcagcagaaagtcttcagt

SEQ ID NO: 216096 - DNA, 21 bp, Mus musculus
tctgtcagtcagtctagccag

SEQ ID NO: 216097 - DNA, 23 bp, Mus musculus
tgtcactgtggataacttctgaa

SEQ ID NO: 216098 - DNA, 18 bp, Mus musculus
agaagaactagtgggggc

SEQ ID NO: 216099 - DNA, 22 bp, Mus musculus
tgtgtcagtttctctgtgggtc

SEQ ID NO: 216100 - DNA, 23 bp, Mus musculus
cactcacttgctgtgtgactctg

SEQ ID NO: 216101 - DNA, 19 bp, Mus musculus
ctctctgtctgtcagcctc

SEQ ID NO: 216102 - DNA, 22 bp, Mus musculus
tggcccagatttgtcggacagc

SEQ ID NO: 216103 - DNA, 21 bp, Mus musculus
agagtggagacagtgagctga

SEQ ID NO: 216104 - DNA, 23 bp, Mus musculus
tacatttgttctctctctgctct

SEQ ID NO: 216105 - DNA, 23 bp, Mus musculus
cattctgtgtgtctgtctcccag

SEQ ID NO: 216106 - DNA, 23 bp, Mus musculus
tcagagctcacagtgtgtgtgtg

SEQ ID NO: 216107 - DNA, 23 bp, Mus musculus
tgtatgcatgtatgtatgtatgt

SEQ ID NO: 216108 - DNA, 21 bp, Mus musculus
cctgcctgcctgcctgcctgc

SEQ ID NO: 216109 - DNA, 21 bp, Mus musculus
tgacacgctgactgcctgagt

SEQ ID NO: 216110 - DNA, 23 bp, Mus musculus
agatatgtgtgtgtatgtgtata

SEQ ID NO: 216111 - DNA, 21 bp, Mus musculus
tatatctatatatctatatgt

SEQ ID NO: 216112 - DNA, 23 bp, Mus musculus
gtgttgtcaaagagcacccatgt

SEQ ID NO: 216113 - DNA, 22 bp, Mus musculus
gagactgggtatagtgagtgac

SEQ ID NO: 216114 - DNA, 18 bp, Mus musculus
ttatgtatgtatgtgtgt

SEQ ID NO: 216115 - DNA, 23 bp, Mus musculus
tgtctctcagtagaagccctgga

SEQ ID NO: 216116 - DNA, 23 bp, Mus musculus
cacttgtctctgtgtgtctttta

SEQ ID NO: 216117 - DNA, 21 bp, Mus musculus
tctgacagtgaagtgagctgc

SEQ ID NO: 216118 - DNA, 20 bp, Mus musculus
ctctgtcggtgacatgaggg

SEQ ID NO: 216119 - DNA, 23 bp, Mus musculus
tagagctctcagaagagtgtgag

SEQ ID NO: 216120 - DNA, 19 bp, Mus musculus
tgtacatgtatgtatatat

SEQ ID NO: 216121 - DNA, 23 bp, Mus musculus
ttctctgaactgtcaagtagttg

SEQ ID NO: 216122 - DNA, 22 bp, Mus musculus
ggtctctccctggctctctttt

SEQ ID NO: 216123 - DNA, 23 bp, Mus musculus
gggatgagactgagctgagagac

SEQ ID NO: 216124 - DNA, 23 bp, Mus musculus
aagagcactgactgctcttccag

SEQ ID NO: 216125 - DNA, 23 bp, Mus musculus
atttctgtgcctgtgttttctca

SEQ ID NO: 216126 - DNA, 23 bp, Mus musculus
ttctgagacagtgtttctctgtg

SEQ ID NO: 216127 - DNA, 23 bp, Mus musculus
tccctgtctatccactgcctcag

SEQ ID NO: 216128 - DNA, 22 bp, Mus musculus
atgcagagagaagagacttgtt

SEQ ID NO: 216129 - DNA, 20 bp, Mus musculus
atgaggttgatgtaagaaat

SEQ ID NO: 216130 - DNA, 23 bp, Mus musculus
tgtctgggtcagaagctacattt

SEQ ID NO: 216131 - DNA, 23 bp, Mus musculus
agggtacatgttgggcatccctg

SEQ ID NO: 216132 - DNA, 23 bp, Mus musculus
acggtcagtgaatctctctgtgg

SEQ ID NO: 216133 - DNA, 23 bp, Mus musculus
aaggagtcactgtcttcagttgt

SEQ ID NO: 216134 - DNA, 18 bp, Mus musculus
attctgaggggttggaga

SEQ ID NO: 216135 - DNA, 21 bp, Mus musculus
tgccactgtccctctgtcacc

SEQ ID NO: 216136 - DNA, 23 bp, Mus musculus
acagtctcagacacaaatgtgat

SEQ ID NO: 216137 - DNA, 20 bp, Mus musculus
tggcacgagccttcattccg

SEQ ID NO: 216138 - DNA, 21 bp, Mus musculus
acttccttgaggtgctgatga

SEQ ID NO: 216139 - DNA, 23 bp, Mus musculus
agttctaggctgtgtctctctca

SEQ ID NO: 216140 - DNA, 23 bp, Mus musculus
tctcagtggaggattggtctctc

SEQ ID NO: 216141 - DNA, 23 bp, Mus musculus
catgaaatgtgaagaagttactg

SEQ ID NO: 216142 - DNA, 23 bp, Mus musculus
acatttgtgtccttgtctttttg

SEQ ID NO: 216143 - DNA, 23 bp, Mus musculus
ctgactgctcttccagaggtcct

SEQ ID NO: 216144 - DNA, 21 bp, Mus musculus
tggctcagtggttaagagtgc

SEQ ID NO: 216145 - DNA, 23 bp, Mus musculus
cttaagactgtctctgcctgtct

SEQ ID NO: 216146 - DNA, 20 bp, Mus musculus
tctcactcagtcattcaagt

SEQ ID NO: 216147 - DNA, 23 bp, Mus musculus
cagtcagtgctgaatgtgactgt

SEQ ID NO: 216148 - DNA, 21 bp, Mus musculus
tctctgtgtggccctggctgt

SEQ ID NO: 216149 - DNA, 23 bp, Mus musculus
ctcactgtagagagtgagttcct

SEQ ID NO: 216150 - DNA, 21 bp, Mus musculus
tgcctgcctggctgtgtgact

SEQ ID NO: 216151 - DNA, 23 bp, Mus musculus
ctgtctgtctgtctgtctgtgtg

SEQ ID NO: 216152 - DNA, 22 bp, Mus musculus
ttgagtgtgtgtctctctctgc

SEQ ID NO: 216153 - DNA, 21 bp, Mus musculus
tgtgtattacataacctctga

SEQ ID NO: 216154 - DNA, 19 bp, Mus musculus
agacagaggttgaggatag

SEQ ID NO: 216155 - DNA, 23 bp, Mus musculus
agtctctgacactcagtttcctc

SEQ ID NO: 216156 - DNA, 23 bp, Mus musculus
tgcctgagtgccaggctgcctga

SEQ ID NO: 216157 - DNA, 23 bp, Mus musculus
tctggacagaatagacagtgggc

SEQ ID NO: 216158 - DNA, 23 bp, Mus musculus
aggtagtctctgtcagtacttgg

SEQ ID NO: 216159 - DNA, 23 bp, Mus musculus
gccagtgtgtgtgtgtgtgtgtg

SEQ ID NO: 216160 - DNA, 23 bp, Mus musculus
tgcctctgtgtgtgtctctgtat

SEQ ID NO: 216161 - DNA, 23 bp, Mus musculus
tatgtatgtatgtgtgtgtgttc

SEQ ID NO: 216162 - DNA, 21 bp, Mus musculus
tatgtgtgtatgtatgtatgt

SEQ ID NO: 216163 - DNA, 23 bp, Mus musculus
tatgtatgtatgtgtgtatgtgt

SEQ ID NO: 216164 - DNA, 23 bp, Mus musculus
ctgttagaagtcagagtcccgtt

SEQ ID NO: 216165 - DNA, 23 bp, Mus musculus
gcctgcctcagtctgtgagtgtg

SEQ ID NO: 216166 - DNA, 20 bp, Mus musculus
acacacactctcaggcaggc

SEQ ID NO: 216167 - DNA, 23 bp, Mus musculus
aggagtgactgactacagagggc

SEQ ID NO: 216168 - DNA, 22 bp, Mus musculus
tgtgtgtatgtgtatatgtgtg

SEQ ID NO: 216169 - DNA, 21 bp, Mus musculus
tgtgctcccttctgactctgt

SEQ ID NO: 216170 - DNA, 23 bp, Mus musculus
taagagcactgactgctcttcca

SEQ ID NO: 216171 - DNA, 21 bp, Mus musculus
tctcaggctccctgacagtta

SEQ ID NO: 216172 - DNA, 23 bp, Mus musculus
gtctctgcttttccaccagcttc

SEQ ID NO: 216173 - DNA, 22 bp, Mus musculus
tgtgtatatatgtatatatgtg

SEQ ID NO: 216174 - DNA, 23 bp, Mus musculus
tatatgtatgtatgcatgtgtat

SEQ ID NO: 216175 - DNA, 20 bp, Mus musculus
acagagcaagctcagagagg

SEQ ID NO: 216176 - DNA, 23 bp, Mus musculus
agactagactctgactctggctc

SEQ ID NO: 216177 - DNA, 19 bp, Mus musculus
gacagggaatgtgggtgtc

SEQ ID NO: 216178 - DNA, 18 bp, Mus musculus
agacgtgctcccttagtg

SEQ ID NO: 216179 - DNA, 23 bp, Mus musculus
ggagagctagtagctagtctcct

SEQ ID NO: 216180 - DNA, 21 bp, Mus musculus
aaagcactggggctggacaca

SEQ ID NO: 216181 - DNA, 22 bp, Mus musculus
tgttttgtgaccaattatatgg

SEQ ID NO: 216182 - DNA, 21 bp, Mus musculus
agcagctggtcagctggtggt

SEQ ID NO: 216183 - DNA, 19 bp, Mus musculus
tcacagaagttagtcagct

SEQ ID NO: 216184 - DNA, 23 bp, Mus musculus
tgtgtgtctttgtgtatatgtat

SEQ ID NO: 216185 - DNA, 23 bp, Mus musculus
tgtcactctgactctctagtact

SEQ ID NO: 216186 - DNA, 18 bp, Mus musculus
tacgacatgagtctggac

SEQ ID NO: 216187 - DNA, 18 bp, Mus musculus
tgggcttttctatgtagc

SEQ ID NO: 216188 - DNA, 23 bp, Mus musculus
ggactctctcagtctctctgtag

SEQ ID NO: 216189 - DNA, 21 bp, Mus musculus
tgtgtgtgcatgtgcatgttc

SEQ ID NO: 216190 - DNA, 20 bp, Mus musculus
cagatctctgtgagctcaag

SEQ ID NO: 216191 - DNA, 23 bp, Mus musculus
actacagtctgtgtgtcaatcac

SEQ ID NO: 216192 - DNA, 23 bp, Mus musculus
tggctgggagtggtgagtctggg

SEQ ID NO: 216193 - DNA, 23 bp, Mus musculus
tccctgtgggtctgtcagtctgt

SEQ ID NO: 216194 - DNA, 23 bp, Mus musculus
aagccacaacatccagctctacg

SEQ ID NO: 216195 - DNA, 22 bp, Mus musculus
tgaggtagtaggttgtatggtt

SEQ ID NO: 216196 - DNA, 23 bp, Mus musculus
tactgtctttcctgaagtggccg

SEQ ID NO: 216197 - DNA, 22 bp, Mus musculus
tgaggtagtaggttgtgtggtt

SEQ ID NO: 216198 - DNA, 21 bp, Mus musculus
aactatacaacctactgcctt

SEQ ID NO: 216199 - DNA, 23 bp, Mus musculus
tgtgtctgtatatatatatgtgt

SEQ ID NO: 216200 - DNA, 23 bp, Mus musculus
tatatctatgtatgtatatgtgt

SEQ ID NO: 216201 - DNA, 20 bp, Mus musculus
tatagttgtgtatacgtata

SEQ ID NO: 216202 - DNA, 23 bp, Mus musculus
gctgtcactgtctgtccctcagg

SEQ ID NO: 216203 - DNA, 23 bp, Mus musculus
cttctcagtctctctgcctctga

SEQ ID NO: 216204 - DNA, 23 bp, Mus musculus
tgcctgcctgggtgtgtggctct

SEQ ID NO: 216205 - DNA, 20 bp, Mus musculus
gtgcatgtttgtatatatgt

SEQ ID NO: 216206 - DNA, 23 bp, Mus musculus
agtatgtgtgcatgttcatgtgc

SEQ ID NO: 216207 - DNA, 22 bp, Mus musculus
tgaaggccagagatagatgtca

SEQ ID NO: 216208 - DNA, 21 bp, Mus musculus
ctctctcactgaatttgaagt

SEQ ID NO: 216209 - DNA, 23 bp, Mus musculus
ggtcagtctcagtttctgttagg

SEQ ID NO: 216210 - DNA, 23 bp, Mus musculus
aaactcctaactctttctgtctc

SEQ ID NO: 216211 - DNA, 18 bp, Mus musculus
gtttcagttaagtgtttg

SEQ ID NO: 216212 - DNA, 19 bp, Mus musculus
agatgtttgatgtatagta

SEQ ID NO: 216213 - DNA, 18 bp, Mus musculus
atgtgtgtgtatgtatat

SEQ ID NO: 216214 - DNA, 22 bp, Mus musculus
tgttttgtgaccaattatatgg

SEQ ID NO: 216215 - DNA, 21 bp, Mus musculus
tgtgcttccagagagaattga

SEQ ID NO: 216216 - DNA, 23 bp, Mus musculus
cctgagggtctctctcactgccc

SEQ ID NO: 216217 - DNA, 18 bp, Mus musculus
gaggacctcagtgccttg

SEQ ID NO: 216218 - DNA, 23 bp, Mus musculus
agccagcacagtgtcttttcagt

SEQ ID NO: 216219 - DNA, 23 bp, Mus musculus
cttactgactcacttactctcag

SEQ ID NO: 216220 - DNA, 23 bp, Mus musculus
tcagcttccatgtgttcctccat

SEQ ID NO: 216221 - DNA, 23 bp, Mus musculus
tcattggttccttatctgtacaa

SEQ ID NO: 216222 - DNA, 21 bp, Mus musculus
tgcagagtggctaagctgatg

SEQ ID NO: 216223 - DNA, 23 bp, Mus musculus
gtgctatatatgcagctgtgtga

SEQ ID NO: 216224 - DNA, 23 bp, Mus musculus
tgtgcttgtatgtatttatgtat

SEQ ID NO: 216225 - DNA, 20 bp, Mus musculus
agggttttcatgaacctgga

SEQ ID NO: 216226 - DNA, 21 bp, Mus musculus
cactgcattcatgaaagcagt

SEQ ID NO: 216227 - DNA, 23 bp, Mus musculus
tgcatattgctacttacacaaag

SEQ ID NO: 216228 - DNA, 23 bp, Mus musculus
ggctctggttcttttttgtacat

SEQ ID NO: 216229 - DNA, 23 bp, Mus musculus
taaagtttaccagcatagcttct

SEQ ID NO: 216230 - DNA, 23 bp, Mus musculus
agaggtggaatttttaattgtat

SEQ ID NO: 216231 - DNA, 23 bp, Mus musculus
tgtctgtctgtctgtcttactgg

SEQ ID NO: 216232 - DNA, 23 bp, Mus musculus
tgagtcacagtgacaggattgga

SEQ ID NO: 216233 - DNA, 20 bp, Mus musculus
tcagaacagagaccatgaga

SEQ ID NO: 216234 - DNA, 22 bp, Mus musculus
atctactccatctgcaggctgc

SEQ ID NO: 216235 - DNA, 23 bp, Mus musculus
ctgggtggtgattgtggatgaag

SEQ ID NO: 216236 - DNA, 18 bp, Mus musculus
tatgtatgcatatatatg

SEQ ID NO: 216237 - DNA, 19 bp, Mus musculus
tgtcacaggcagattttcc

SEQ ID NO: 216238 - DNA, 23 bp, Mus musculus
cccttgtcagtctcagtctctct

SEQ ID NO: 216239 - DNA, 22 bp, Mus musculus
agacaaggatagaagatacccc

SEQ ID NO: 216240 - DNA, 23 bp, Mus musculus
tgtggtgctacttctcattgggg

SEQ ID NO: 216241 - DNA, 23 bp, Mus musculus
tgtttctctgtcagaaatttgcc

SEQ ID NO: 216242 - DNA, 23 bp, Mus musculus
cctagataaaggaactatatcat

SEQ ID NO: 216243 - DNA, 22 bp, Mus musculus
tgtggttgtagcttttaatgct

SEQ ID NO: 216244 - DNA, 21 bp, Mus musculus
gagagaaaagagagccacctt

SEQ ID NO: 216245 - DNA, 23 bp, Mus musculus
ctctgggtcacttctctgtctct

SEQ ID NO: 216246 - DNA, 23 bp, Mus musculus
tgtggtagtaggaagcatgcatg

SEQ ID NO: 216247 - DNA, 23 bp, Mus musculus
agccctcagtgactgtcagtgtc

SEQ ID NO: 216248 - DNA, 22 bp, Mus musculus
tgttttgtgaccaattatatgg

SEQ ID NO: 216249 - DNA, 21 bp, Mus musculus
tattgcattttggccagatag

SEQ ID NO: 216250 - DNA, 23 bp, Mus musculus
gttttgtctcaggatgtgattgc

SEQ ID NO: 216251 - DNA, 23 bp, Mus musculus
aacgttcctgattttgttgttca

SEQ ID NO: 216252 - DNA, 21 bp, Mus musculus
taagtggtaggaaatgtactc

SEQ ID NO: 216253 - DNA, 23 bp, Mus musculus
acaaaacatcatgaccaagaagc

SEQ ID NO: 216254 - DNA, 23 bp, Mus musculus
agttctccaggatgtgcttccac

SEQ ID NO: 216255 - DNA, 22 bp, Mus musculus
tgttttgtgaccaattatatgg

SEQ ID NO: 216256 - DNA, 23 bp, Mus musculus
tgaaatacatgtgaatttgttct

SEQ ID NO: 216257 - DNA, 23 bp, Mus musculus
tgtatacacacacacacatacat

SEQ ID NO: 216258 - DNA, 21 bp, Mus musculus
tctgtacatccacgtgtctgt

SEQ ID NO: 216259 - DNA, 21 bp, Mus musculus
tatatgcacatatatgtatgt

SEQ ID NO: 216260 - DNA, 23 bp, Mus musculus
tgtatgcatgtatgtatgtatgt

SEQ ID NO: 216261 - DNA, 23 bp, Mus musculus
gagactgtacacactcagtgcta

SEQ ID NO: 216262 - DNA, 19 bp, Mus musculus
agacacgagtgagtatcag

SEQ ID NO: 216263 - DNA, 22 bp, Mus musculus
tgagttccattgttgatggtag

SEQ ID NO: 216264 - DNA, 23 bp, Mus musculus
gtatcaagagtgtctgcacactg

SEQ ID NO: 216265 - DNA, 20 bp, Mus musculus
cattatatacatatgtgtat

SEQ ID NO: 216266 - DNA, 23 bp, Mus musculus
tgtgcatatatatatatgtgtgt

SEQ ID NO: 216267 - DNA, 19 bp, Mus musculus
tatgatgtacacatgcttt

SEQ ID NO: 216268 - DNA, 22 bp, Mus musculus
tatgtgtgtgtgtgtatgtatg

SEQ ID NO: 216269 - DNA, 23 bp, Mus musculus
atatgtatatatgtatgtatgtg

SEQ ID NO: 216270 - DNA, 23 bp, Mus musculus
tatatgtgtgtatatgtgtatgt

SEQ ID NO: 216271 - DNA, 23 bp, Mus musculus
aaggtcacagtctgtcactgagg

SEQ ID NO: 216272 - DNA, 22 bp, Mus musculus
atgtgtatgttgttatatgagt

SEQ ID NO: 216273 - DNA, 20 bp, Mus musculus
ctcagatgtgtcagagcaca

SEQ ID NO: 216274 - DNA, 20 bp, Mus musculus
tgtcactttgcctttttagt

SEQ ID NO: 216275 - DNA, 23 bp, Mus musculus
ttagtgtctgtgctttaggtgtc

SEQ ID NO: 216276 - DNA, 23 bp, Mus musculus
gtttagaaaggtcagtctgtctg

SEQ ID NO: 216277 - DNA, 22 bp, Mus musculus
tgcaagactgaagtgggtgacc

SEQ ID NO: 216278 - DNA, 19 bp, Mus musculus
agaggtgcatcacatggcc

SEQ ID NO: 216279 - DNA, 23 bp, Mus musculus
gtatgtatgcatgtatatgtgtg

SEQ ID NO: 216280 - DNA, 23 bp, Mus musculus
gtatgtatgcatgtatatgtgtg

SEQ ID NO: 216281 - DNA, 22 bp, Mus musculus
tacatgtgtatgtatgtataca

SEQ ID NO: 216282 - DNA, 23 bp, Mus musculus
acagagaacaccaacccctcaca

SEQ ID NO: 216283 - DNA, 23 bp, Mus musculus
cacacacatctgtatctgtgagc

SEQ ID NO: 216284 - DNA, 23 bp, Mus musculus
tccacacacatctgtgtgtgagg

SEQ ID NO: 216285 - DNA, 18 bp, Mus musculus
atagttccctgtacctgt

SEQ ID NO: 216286 - DNA, 23 bp, Mus musculus
ctgtgggtctctgagttagttca

SEQ ID NO: 216287 - DNA, 23 bp, Mus musculus
agtcctagagaaatctgtatgtt

SEQ ID NO: 216288 - DNA, 23 bp, Mus musculus
tgttcgatgtggtggctctgtct

SEQ ID NO: 216289 - DNA, 23 bp, Mus musculus
tatattgatgatgatgatgatga

SEQ ID NO: 216290 - DNA, 22 bp, Mus musculus
tgttttgtgaccaattatatgg

SEQ ID NO: 216291 - DNA, 23 bp, Mus musculus
ttaggaatgcaatctaatgattt

SEQ ID NO: 216292 - DNA, 23 bp, Mus musculus
agtgtgcctgagtgcctgcctgt

SEQ ID NO: 216293 - DNA, 18 bp, Mus musculus
tgagaagcttgagagcac

SEQ ID NO: 216294 - DNA, 20 bp, Mus musculus
cacacagaaatagtattgcc

SEQ ID NO: 216295 - DNA, 23 bp, Mus musculus
agaggtagaaggaacttgagtta

SEQ ID NO: 216296 - DNA, 21 bp, Mus musculus
aggtagtttagagattaagag

SEQ ID NO: 216297 - DNA, 21 bp, Mus musculus
cacacagaagacagtgtgtag

SEQ ID NO: 216298 - DNA, 23 bp, Mus musculus
ctgtctgtctgtctgcctgcctg

SEQ ID NO: 216299 - DNA, 19 bp, Mus musculus
ttttcaggctggagagatg

SEQ ID NO: 216300 - DNA, 23 bp, Mus musculus
gaacactgactgctcttccagag

SEQ ID NO: 216301 - DNA, 23 bp, Mus musculus
cttgcctgggtccctggctggct

SEQ ID NO: 216302 - DNA, 23 bp, Mus musculus
actgcctccctctgtatggtgct

SEQ ID NO: 216303 - DNA, 20 bp, Mus musculus
ctctgagaatctcactcata

SEQ ID NO: 216304 - DNA, 19 bp, Mus musculus
tgcaataaaaacaggtcag

SEQ ID NO: 216305 - DNA, 22 bp, Mus musculus
tgtggttctaagtaggactctt

SEQ ID NO: 216306 - DNA, 23 bp, Mus musculus
atgtgtgtatatgtatatatgtg

SEQ ID NO: 216307 - DNA, 23 bp, Mus musculus
gctctgtgacactgagtctcccc

SEQ ID NO: 216308 - DNA, 18 bp, Mus musculus
ttggactgaacggtgctc

SEQ ID NO: 216309 - DNA, 23 bp, Mus musculus
gtatgtgtgtgttatgtgtatgt

SEQ ID NO: 216310 - DNA, 18 bp, Mus musculus
atatgcatgtatacatat

SEQ ID NO: 216311 - DNA, 19 bp, Mus musculus
ttggcttactcttccatac

SEQ ID NO: 216312 - DNA, 23 bp, Mus musculus
tatgcatgtgtatatgtatgtga

SEQ ID NO: 216313 - DNA, 21 bp, Mus musculus
atggatctatctatctatgta

SEQ ID NO: 216314 - DNA, 23 bp, Mus musculus
tttctagatctatctgtctgtct

SEQ ID NO: 216315 - DNA, 19 bp, Mus musculus
agtgagaagactgtgagca

SEQ ID NO: 216316 - DNA, 22 bp, Mus musculus
tgttttgtgaccaattatatgg

SEQ ID NO: 216317 - DNA, 22 bp, Mus musculus
tgttttgtgaccaattatatgg

SEQ ID NO: 216318 - DNA, 23 bp, Mus musculus
cctctctctgactgtttctttgc

SEQ ID NO: 216319 - DNA, 22 bp, Mus musculus
agactgaggacagagaggtgag

SEQ ID NO: 216320 - DNA, 23 bp, Mus musculus
tgtcagtctgtcagtgagggcca

SEQ ID NO: 216321 - DNA, 23 bp, Mus musculus
aagacaattgtctttcactggta

SEQ ID NO: 216322 - DNA, 21 bp, Mus musculus
agctccagcttgaagctctga

SEQ ID NO: 216323 - DNA, 20 bp, Mus musculus
tatggatatatatgatgtat

SEQ ID NO: 216324 - DNA, 18 bp, Mus musculus
tccaatcaaagtgtgtgt

SEQ ID NO: 216325 - DNA, 18 bp, Mus musculus
atatttctaaaggtgttt

SEQ ID NO: 216326 - DNA, 23 bp, Mus musculus
tactcagtcaggtaatgaagacc

SEQ ID NO: 216327 - DNA, 23 bp, Mus musculus
tctaggcagaggaagtactatcg

SEQ ID NO: 216328 - DNA, 22 bp, Mus musculus
aaagggccttcttggtttcagt

SEQ ID NO: 216329 - DNA, 23 bp, Mus musculus
ttcccacaagatactgtgctgtt

SEQ ID NO: 216330 - DNA, 19 bp, Mus musculus
agaggtctcagtctcactg

SEQ ID NO: 216331 - DNA, 19 bp, Mus musculus
atgtgcataatgactacgt

SEQ ID NO: 216332 - DNA, 23 bp, Mus musculus
gtgtccatgtgtgtccatctgca

SEQ ID NO: 216333 - DNA, 23 bp, Mus musculus
aaatggaactcacagccactgtg

SEQ ID NO: 216334 - DNA, 21 bp, Mus musculus
tgtctctctgactcacgcctt

SEQ ID NO: 216335 - DNA, 18 bp, Mus musculus
gcctgtgtgtgtgtctgt

SEQ ID NO: 216336 - DNA, 23 bp, Mus musculus
tgtgtgtgtatatgtatatatga

SEQ ID NO: 216337 - DNA, 23 bp, Mus musculus
atgaatgtgtgcatatgtgtgtg

SEQ ID NO: 216338 - DNA, 23 bp, Mus musculus
tatctctctctctgtctgtggaa

SEQ ID NO: 216339 - DNA, 23 bp, Mus musculus
tatttattcgtagtttagctaaa

SEQ ID NO: 216340 - DNA, 20 bp, Mus musculus
ccacttcaggagctggagag

SEQ ID NO: 216341 - DNA, 23 bp, Mus musculus
agaccactgactgctcttccaga

SEQ ID NO: 216342 - DNA, 20 bp, Mus musculus
tcgctggctctctcactccc

SEQ ID NO: 216343 - DNA, 23 bp, Mus musculus
atgtatgtgtatgtgcatgtgca

SEQ ID NO: 216344 - DNA, 21 bp, Mus musculus
tgcttgtctgtatgtgtttga

SEQ ID NO: 216345 - DNA, 23 bp, Mus musculus
gacagtcagtgtcttagttgggg

SEQ ID NO: 216346 - DNA, 22 bp, Mus musculus
atttgtggagacttaccagtat

SEQ ID NO: 216347 - DNA, 23 bp, Mus musculus
gtatatatgcatgtgtgtacatg

SEQ ID NO: 216348 - DNA, 23 bp, Mus musculus
atatacacacatatacatgtgca

SEQ ID NO: 216349 - DNA, 21 bp, Mus musculus
tctgtctctatcactctctat

SEQ ID NO: 216350 - DNA, 23 bp, Mus musculus
gactggtcaatgtatgtgtaatg

SEQ ID NO: 216351 - DNA, 23 bp, Mus musculus
agagttagacacacatgtttgct

SEQ ID NO: 216352 - DNA, 23 bp, Mus musculus
ggtgtgagttgtctatgtgttct

SEQ ID NO: 216353 - DNA, 23 bp, Mus musculus
gtgactgactctgtgacttattt

SEQ ID NO: 216354 - DNA, 23 bp, Mus musculus
atgttgagagatatcagtgagca

SEQ ID NO: 216355 - DNA, 23 bp, Mus musculus
tgccagccaccctgttagcttga

SEQ ID NO: 216356 - DNA, 23 bp, Mus musculus
tgtccgtcagtccgtcagtttgt

SEQ ID NO: 216357 - DNA, 23 bp, Mus musculus
agagaaatgagtttccagactga

SEQ ID NO: 216358 - DNA, 23 bp, Mus musculus
aatcagtctgtcacagtctgtga

SEQ ID NO: 216359 - DNA, 23 bp, Mus musculus
gagtgtctgtgtgagtgcccgaa

SEQ ID NO: 216360 - DNA, 19 bp, Mus musculus
gtgtgtgtgtgtgcagtaa

SEQ ID NO: 216361 - DNA, 23 bp, Mus musculus
gagagtgaagactgtcagtttca

SEQ ID NO: 216362 - DNA, 23 bp, Mus musculus
gtgactgagttgtgagtgtgcag

SEQ ID NO: 216363 - DNA, 22 bp, Mus musculus
tatattcaggtttacaaaggga

SEQ ID NO: 216364 - DNA, 23 bp, Mus musculus
tcgctcgctctcttgctcgctct

SEQ ID NO: 216365 - DNA, 22 bp, Mus musculus
cctctgagaagtgactgaggtc

SEQ ID NO: 216366 - DNA, 23 bp, Mus musculus
agtctgtatgtctgtcttataac

SEQ ID NO: 216367 - DNA, 23 bp, Mus musculus
atgtatgtacatatgtatgtaca

SEQ ID NO: 216368 - DNA, 23 bp, Mus musculus
atcagttgctggatgaagtctct

SEQ ID NO: 216369 - DNA, 21 bp, Mus musculus
gtctgtcaatcatgtatgtat

SEQ ID NO: 216370 - DNA, 23 bp, Mus musculus
ctgtagatccatgtgtgtgtgta

SEQ ID NO: 216371 - DNA, 21 bp, Mus musculus
tgtgtctctgtgtgtacatgt

SEQ ID NO: 216372 - DNA, 21 bp, Mus musculus
atctgagtgtgatagtgcagc

SEQ ID NO: 216373 - DNA, 23 bp, Mus musculus
tgtgtatatatacatgtgtgtac

SEQ ID NO: 216374 - DNA, 23 bp, Mus musculus
catatacacacatgtatatatgt

SEQ ID NO: 216375 - DNA, 23 bp, Mus musculus
aagactctggctctctcacccag

SEQ ID NO: 216376 - DNA, 22 bp, Mus musculus
agacagaacacagaatgcagat

SEQ ID NO: 216377 - DNA, 23 bp, Mus musculus
ctgtctgtctgtctgtctgtctg

SEQ ID NO: 216378 - DNA, 23 bp, Mus musculus
caggctccctcagtgaccctctc

SEQ ID NO: 216379 - DNA, 19 bp, Mus musculus
ctgaattactttgcttgct

SEQ ID NO: 216380 - DNA, 23 bp, Mus musculus
tgtctgtatgtctgtgtggctca

SEQ ID NO: 216381 - DNA, 23 bp, Mus musculus
ggtggagtcactctgaccgtgtc

SEQ ID NO: 216382 - DNA, 23 bp, Mus musculus
agagtctcttcctctgtgtgtct

SEQ ID NO: 216383 - DNA, 23 bp, Mus musculus
ctgtctgtgcgtgtgtgagtgtg

SEQ ID NO: 216384 - DNA, 21 bp, Mus musculus
tgacacactgacttactgtct

SEQ ID NO: 216385 - DNA, 19 bp, Mus musculus
ttgcactgttcgcggcact

SEQ ID NO: 216386 - DNA, 23 bp, Mus musculus
taactctgcttcgttcagttgct

SEQ ID NO: 216387 - DNA, 22 bp, Mus musculus
ctgtggctctcactgacccaga

SEQ ID NO: 216388 - DNA, 23 bp, Mus musculus
ctgtcactcagtgtctgcggcat

SEQ ID NO: 216389 - DNA, 22 bp, Mus musculus
ttctacatcaggggctggagag

SEQ ID NO: 216390 - DNA, 20 bp, Mus musculus
agagaggacagagagagctg

SEQ ID NO: 216391 - DNA, 21 bp, Mus musculus
agacctaaaccaccacagcca

SEQ ID NO: 216392 - DNA, 23 bp, Mus musculus
tgtctgcctgcctgcctgcctgc

SEQ ID NO: 216393 - DNA, 18 bp, Mus musculus
agtttgccctaagtgttt

SEQ ID NO: 216394 - DNA, 20 bp, Mus musculus
atgttctgggactgcaggca

SEQ ID NO: 216395 - DNA, 23 bp, Mus musculus
tgtctgtctgtctgtctaccacc

SEQ ID NO: 216396 - DNA, 23 bp, Mus musculus
tcagtgggtcagtgtgtctcttc

SEQ ID NO: 216397 - DNA, 23 bp, Mus musculus
gaaatgatgagtggaatcgattt

SEQ ID NO: 216398 - DNA, 22 bp, Mus musculus
cttaaagtggacatcactctgt

SEQ ID NO: 216399 - DNA, 22 bp, Mus musculus
tgtgtgtctgtgtatctgtctg

SEQ ID NO: 216400 - DNA, 21 bp, Mus musculus
atatatgtatatgtatacact

SEQ ID NO: 216401 - DNA, 23 bp, Mus musculus
ctgcgtgtgttcacatgctgtgg

SEQ ID NO: 216402 - DNA, 19 bp, Mus musculus
gtgagatgtgagagaggac

SEQ ID NO: 216403 - DNA, 23 bp, Mus musculus
gtgtgttgatctggaactggtgc

SEQ ID NO: 216404 - DNA, 23 bp, Mus musculus
ctgggtcactctcaggcacactg

SEQ ID NO: 216405 - DNA, 18 bp, Mus musculus
tgagatgtgagtgagctc

SEQ ID NO: 216406 - DNA, 18 bp, Mus musculus
agaggtactgagttcaat

SEQ ID NO: 216407 - DNA, 23 bp, Mus musculus
acagactgtaaagctgtgtttcc

SEQ ID NO: 216408 - DNA, 23 bp, Mus musculus
tcagagactcacagtctatagtg

SEQ ID NO: 216409 - DNA, 22 bp, Mus musculus
tgactgtgtgtgcatgtgttca

SEQ ID NO: 216410 - DNA, 19 bp, Mus musculus
agtcagttagacagacata

SEQ ID NO: 216411 - DNA, 23 bp, Mus musculus
cttactgactgactgatgactga

SEQ ID NO: 216412 - DNA, 23 bp, Mus musculus
tctgactgcctcagtccctgctt

SEQ ID NO: 216413 - DNA, 23 bp, Mus musculus
gtgtgtgtgtgcatgtgcactgg

SEQ ID NO: 216414 - DNA, 23 bp, Mus musculus
tgtgtgtgtgtgtgtgcatgtgc

SEQ ID NO: 216415 - DNA, 21 bp, Mus musculus
tgtgtctctgtgtgtctgtgt

SEQ ID NO: 216416 - DNA, 21 bp, Mus musculus
tgtatgtggtatgtgtctgtg

SEQ ID NO: 216417 - DNA, 23 bp, Mus musculus
acatagctcctgtctgacattca

SEQ ID NO: 216418 - DNA, 23 bp, Mus musculus
tcacaggagcctcagtgaggcag

SEQ ID NO: 216419 - DNA, 23 bp, Mus musculus
tgtgtatatgtatgtatatgtgt

SEQ ID NO: 216420 - DNA, 23 bp, Mus musculus
acactctccctcagacaggccca

SEQ ID NO: 216421 - DNA, 20 bp, Mus musculus
taaccatggttaccctctct

SEQ ID NO: 216422 - DNA, 23 bp, Mus musculus
ctgtctgtctgtctgtctgtcag

SEQ ID NO: 216423 - DNA, 18 bp, Mus musculus
cagaacacaaagaaagca

SEQ ID NO: 216424 - DNA, 23 bp, Mus musculus
ccagtacagactgtggacagaag

SEQ ID NO: 216425 - DNA, 23 bp, Mus musculus
tctcactgtccactgcctgtgtg

SEQ ID NO: 216426 - DNA, 23 bp, Mus musculus
gtatatctgtatgtatatatgtg

SEQ ID NO: 216427 - DNA, 23 bp, Mus musculus
ccaagtctctcactctctgtcca

SEQ ID NO: 216428 - DNA, 21 bp, Mus musculus
ggcagagaagaggttgtgctt

SEQ ID NO: 216429 - DNA, 23 bp, Mus musculus
taaggtttgtaatgatgtatgta

SEQ ID NO: 216430 - DNA, 23 bp, Mus musculus
tctctggctcactgttttagttg

SEQ ID NO: 216431 - DNA, 23 bp, Mus musculus
tatgtgtatatatatatgtgtgt

SEQ ID NO: 216432 - DNA, 23 bp, Mus musculus
atatgtgtgtatgtatatgtgtg

SEQ ID NO: 216433 - DNA, 21 bp, Mus musculus
tatgtgtatatgtatatgtgt

SEQ ID NO: 216434 - DNA, 20 bp, Mus musculus
tatgtgtgtgtgtgtatgta

SEQ ID NO: 216435 - DNA, 22 bp, Mus musculus
tatgtgtatgtatacgtatgtg

SEQ ID NO: 216436 - DNA, 18 bp, Mus musculus
tatatgtgtatgtatatg

SEQ ID NO: 216437 - DNA, 20 bp, Mus musculus
ttgtcagtctcagtctttgt

SEQ ID NO: 216438 - DNA, 18 bp, Mus musculus
acagtccatgttcaggtc

SEQ ID NO: 216439 - DNA, 23 bp, Mus musculus
gatgacagatgtgtctgagatgt

SEQ ID NO: 216440 - DNA, 23 bp, Mus musculus
cactgggtcactgtctccatccc

SEQ ID NO: 216441 - DNA, 23 bp, Mus musculus
ctgtctgtgtgtctgtgtgtctg

SEQ ID NO: 216442 - DNA, 19 bp, Mus musculus
agctccacacaacaggctt

SEQ ID NO: 216443 - DNA, 23 bp, Mus musculus
tttctgtcagatgtttgcagctg

SEQ ID NO: 216444 - DNA, 21 bp, Mus musculus
tatgcatatataatgtgaatg

SEQ ID NO: 216445 - DNA, 23 bp, Mus musculus
tgtgtatatatatatgtgtgtgt

SEQ ID NO: 216446 - DNA, 21 bp, Mus musculus
agagacaggacactcagcaca

SEQ ID NO: 216447 - DNA, 23 bp, Mus musculus
gctgaggtaggaggatgatgagt

SEQ ID NO: 216448 - DNA, 19 bp, Mus musculus
cgactgacacattcctgtt

SEQ ID NO: 216449 - DNA, 23 bp, Mus musculus
tgtcacacactcacaggtaaaaa

SEQ ID NO: 216450 - DNA, 23 bp, Mus musculus
gacagagtctctcagtggctgag

SEQ ID NO: 216451 - DNA, 21 bp, Mus musculus
acagttctgtgtctgtcagcc

SEQ ID NO: 216452 - DNA, 22 bp, Mus musculus
tttaacctaggattcctcttct

SEQ ID NO: 216453 - DNA, 23 bp, Mus musculus
agatgtgtgtatgtatatatgtg

SEQ ID NO: 216454 - DNA, 23 bp, Mus musculus
taagagcactgactgctcttcca

SEQ ID NO: 216455 - DNA, 22 bp, Mus musculus
tagtcttctggttattttctct

SEQ ID NO: 216456 - DNA, 23 bp, Mus musculus
gtgtgtctgtgagtgtctgcctc

SEQ ID NO: 216457 - DNA, 23 bp, Mus musculus
tgaactactacatgtctggcttt

SEQ ID NO: 216458 - DNA, 23 bp, Mus musculus
agcatcatctggggctggagaga

SEQ ID NO: 216459 - DNA, 23 bp, Mus musculus
cagtgtgtctcagaccctctcag

SEQ ID NO: 216460 - DNA, 23 bp, Mus musculus
tctctctctgtgtacacacacac

SEQ ID NO: 216461 - DNA, 19 bp, Mus musculus
tactgccatatcagctctt

SEQ ID NO: 216462 - DNA, 23 bp, Mus musculus
tgtatgtgcatgtgcaagtgtgt

SEQ ID NO: 216463 - DNA, 23 bp, Mus musculus
taggtagtttcatgttgttggga

SEQ ID NO: 216464 - DNA, 22 bp, Mus musculus
aaactgcctgagttacatcagt

SEQ ID NO: 216465 - DNA, 23 bp, Mus musculus
ctgtgtcactttattgggaggac

SEQ ID NO: 216466 - DNA, 23 bp, Mus musculus
ttaagagtacttgttgcagggct

SEQ ID NO: 216467 - DNA, 23 bp, Mus musculus
aggcagagaacctttgttgtgga

SEQ ID NO: 216468 - DNA, 19 bp, Mus musculus
taactcagtggtacatctt

SEQ ID NO: 216469 - DNA, 22 bp, Mus musculus
tcagtgcatcacagaactttgt

SEQ ID NO: 216470 - DNA, 21 bp, Mus musculus
tacatgtatatatatatgtgt

SEQ ID NO: 216471 - DNA, 23 bp, Mus musculus
gtgtgtgtgcgtgtgtgagagag

SEQ ID NO: 216472 - DNA, 23 bp, Mus musculus
tgtatgtatgtatatgtatgtat

SEQ ID NO: 216473 - DNA, 23 bp, Mus musculus
tgtctctgactctgtggtgcatg

SEQ ID NO: 216474 - DNA, 23 bp, Mus musculus
ctcacactgtcaccatggcttgt

SEQ ID NO: 216475 - DNA, 23 bp, Mus musculus
gtatgtatgtatgtatgtatgtg

SEQ ID NO: 216476 - DNA, 20 bp, Mus musculus
tactgactgtctctgggtcc

SEQ ID NO: 216477 - DNA, 23 bp, Mus musculus
ttacagtcagtctgtctcacctt

SEQ ID NO: 216478 - DNA, 23 bp, Mus musculus
tgattctgtcacaccctctgtcg

SEQ ID NO: 216479 - DNA, 20 bp, Mus musculus
ctcagtagtcactcagctca

SEQ ID NO: 216480 - DNA, 23 bp, Mus musculus
tcacagagctctgtctgcctctc

SEQ ID NO: 216481 - DNA, 22 bp, Mus musculus
ctcacttgtcagttgaaaactt

SEQ ID NO: 216482 - DNA, 23 bp, Mus musculus
gacaagatctcattgtgtagttc

SEQ ID NO: 216483 - DNA, 21 bp, Mus musculus
ttaaaagaatatgatttgggg

SEQ ID NO: 216484 - DNA, 20 bp, Mus musculus
aagagcactgactgctcttc

SEQ ID NO: 216485 - DNA, 23 bp, Mus musculus
tgcctatgtcagtctgtgtgtca

SEQ ID NO: 216486 - DNA, 22 bp, Mus musculus
tgtgaagtccgttctgactgtc

SEQ ID NO: 216487 - DNA, 23 bp, Mus musculus
atgtgtatatatatatgtgtgtg

SEQ ID NO: 216488 - DNA, 19 bp, Mus musculus
tatacacacacacacatat

SEQ ID NO: 216489 - DNA, 23 bp, Mus musculus
tgttcttgtcattgcatgatgta

SEQ ID NO: 216490 - DNA, 23 bp, Mus musculus
ctcactctgtttcacattttgtg

SEQ ID NO: 216491 - DNA, 21 bp, Mus musculus
ataagtgtgtgtatatatgtg

SEQ ID NO: 216492 - DNA, 18 bp, Mus musculus
agacctggtggtgtcttg

SEQ ID NO: 216493 - DNA, 22 bp, Mus musculus
tgttgaggagagcgtggagaga

SEQ ID NO: 216494 - DNA, 23 bp, Mus musculus
tccctccgaggctgtttctgata

SEQ ID NO: 216495 - DNA, 19 bp, Mus musculus
tatacatgcgtgtctgtac

SEQ ID NO: 216496 - DNA, 23 bp, Mus musculus
tgtagcacctctcactctgtcag

SEQ ID NO: 216497 - DNA, 23 bp, Mus musculus
tgtgtgaatgtgtatgcatgtgt

SEQ ID NO: 216498 - DNA, 22 bp, Mus musculus
tatgtgtatatatatatgtgtg

SEQ ID NO: 216499 - DNA, 22 bp, Mus musculus
ctgtccctcagtctctggctgg

SEQ ID NO: 216500 - DNA, 22 bp, Mus musculus
tctaccaggtcacagtcaacaa

SEQ ID NO: 216501 - DNA, 22 bp, Mus musculus
tgtacttgccccagagtgagtg

SEQ ID NO: 216502 - DNA, 23 bp, Mus musculus
ccagactcactctgaccctgacc

SEQ ID NO: 216503 - DNA, 23 bp, Mus musculus
aggagctgacagtgaaggctgtg

SEQ ID NO: 216504 - DNA, 20 bp, Mus musculus
agctgcacagcaagattctg

SEQ ID NO: 216505 - DNA, 23 bp, Mus musculus
tctgtgtgtgtatgatgtgtatg

SEQ ID NO: 216506 - DNA, 22 bp, Mus musculus
attgatgcctggtcaagaacag

SEQ ID NO: 216507 - DNA, 23 bp, Mus musculus
gcctctctctctctagatagcag

SEQ ID NO: 216508 - DNA, 23 bp, Mus musculus
ggccattcactctcagtctgtcc

SEQ ID NO: 216509 - DNA, 18 bp, Mus musculus
tgacaggagactgaggcc

SEQ ID NO: 216510 - DNA, 19 bp, Mus musculus
caggagttcacagtgaaga

SEQ ID NO: 216511 - DNA, 23 bp, Mus musculus
acactcactgtttgtttctgtta

SEQ ID NO: 216512 - DNA, 18 bp, Mus musculus
tcccaccctctgccctgt

SEQ ID NO: 216513 - DNA, 19 bp, Mus musculus
ctgagaagacactgtgctg

SEQ ID NO: 216514 - DNA, 23 bp, Mus musculus
tgcctgtctgtctgtctgtgtgc

SEQ ID NO: 216515 - DNA, 18 bp, Mus musculus
agggcagaaggtggcatt

SEQ ID NO: 216516 - DNA, 23 bp, Mus musculus
agagagatgaaagtcagcaggag

SEQ ID NO: 216517 - DNA, 23 bp, Mus musculus
atgtatgtacatatgtatgtatg

SEQ ID NO: 216518 - DNA, 22 bp, Mus musculus
atctgcatgtgtatatgtgtgt

SEQ ID NO: 216519 - DNA, 19 bp, Mus musculus
acatgcagaacaagcactt

SEQ ID NO: 216520 - DNA, 23 bp, Mus musculus
tgtacttgacatagtgagacact

SEQ ID NO: 216521 - DNA, 23 bp, Mus musculus
aagagcactgactcctcttccag

SEQ ID NO: 216522 - DNA, 19 bp, Mus musculus
agcagtctgaggtccctca

SEQ ID NO: 216523 - DNA, 23 bp, Mus musculus
taagatcacacagtgctgaaggt

SEQ ID NO: 216524 - DNA, 20 bp, Mus musculus
tgtgcatatgtatatatgta

SEQ ID NO: 216525 - DNA, 20 bp, Mus musculus
tgtatatatgtatatgtgag

SEQ ID NO: 216526 - DNA, 23 bp, Mus musculus
tgtgtatatatgtatatgtgtgt

SEQ ID NO: 216527 - DNA, 23 bp, Mus musculus
tcccagtcagcctctttgcctgc

SEQ ID NO: 216528 - DNA, 23 bp, Mus musculus
tctctctctgtccagcccacagt

SEQ ID NO: 216529 - DNA, 23 bp, Mus musculus
attgtggtagttcatactgtgtt

SEQ ID NO: 216530 - DNA, 23 bp, Mus musculus
tttgtgtatatatatgtatgtgt

SEQ ID NO: 216531 - DNA, 22 bp, Mus musculus
tctgtgtgtctgtgagtgtgcg

SEQ ID NO: 216532 - DNA, 23 bp, Mus musculus
tgcatatgcacacttactgttca

SEQ ID NO: 216533 - DNA, 23 bp, Mus musculus
ccaatcagactgtttttgttttt

SEQ ID NO: 216534 - DNA, 21 bp, Mus musculus
tctcaggctcaggagcagatg

SEQ ID NO: 216535 - DNA, 23 bp, Mus musculus
tctgtctttctgtgtctgccatt

SEQ ID NO: 216536 - DNA, 19 bp, Mus musculus
agagctacagaaaccctgt

SEQ ID NO: 216537 - DNA, 23 bp, Mus musculus
tgtatgtatgtatgtgtgtgtgt

SEQ ID NO: 216538 - DNA, 21 bp, Mus musculus
aatgggttcagattttcttgt

SEQ ID NO: 216539 - DNA, 23 bp, Mus musculus
tcactgacagcctgagtcctagc

SEQ ID NO: 216540 - DNA, 23 bp, Mus musculus
ctccctgtctcccacacttctct

SEQ ID NO: 216541 - DNA, 23 bp, Mus musculus
tttgtcacgcagctttgaagtac

SEQ ID NO: 216542 - DNA, 19 bp, Mus musculus
acagtcatcacacacaggc

SEQ ID NO: 216543 - DNA, 23 bp, Mus musculus
gaggattgtgctctgaatggact

SEQ ID NO: 216544 - DNA, 22 bp, Mus musculus
aaccagccagatggactggaga

SEQ ID NO: 216545 - DNA, 18 bp, Mus musculus
actggagagatggctcag

SEQ ID NO: 216546 - DNA, 23 bp, Mus musculus
actgtgtgactgtgtgggtccca

SEQ ID NO: 216547 - DNA, 23 bp, Mus musculus
tcagtctgggtgtgagtgggcct

SEQ ID NO: 216548 - DNA, 22 bp, Mus musculus
acaggcatgcatgtgtagtgaa

SEQ ID NO: 216549 - DNA, 23 bp, Mus musculus
agacagacagataggtgtatata

SEQ ID NO: 216550 - DNA, 23 bp, Mus musculus
tgtctctctctgtctccctatct

SEQ ID NO: 216551 - DNA, 21 bp, Mus musculus
cagtcttcagctctttggctt

SEQ ID NO: 216552 - DNA, 20 bp, Mus musculus
aagagcactgactgctcttc

SEQ ID NO: 216553 - DNA, 18 bp, Mus musculus
agagcactgactgctctt

SEQ ID NO: 216554 - DNA, 20 bp, Mus musculus
aggctagccttgaactcaga

SEQ ID NO: 216555 - DNA, 23 bp, Mus musculus
ctgtcagtcagcctgtgcctgag

SEQ ID NO: 216556 - DNA, 23 bp, Mus musculus
aagtcagggtgattatggtctct

SEQ ID NO: 216557 - DNA, 23 bp, Mus musculus
acaagggttgtttctctgtccct

SEQ ID NO: 216558 - DNA, 23 bp, Mus musculus
tgtcacacacttcagcccacagg

SEQ ID NO: 216559 - DNA, 23 bp, Mus musculus
tccctgtcacactgtatgagtga

SEQ ID NO: 216560 - DNA, 23 bp, Mus musculus
cgtgtctgtggctctgtcattgc

SEQ ID NO: 216561 - DNA, 20 bp, Mus musculus
agactctccacaggcatctg

SEQ ID NO: 216562 - DNA, 20 bp, Mus musculus
tcccactgactctctgaggc

SEQ ID NO: 216563 - DNA, 23 bp, Mus musculus
ggccagtctctctctctctctct

SEQ ID NO: 216564 - DNA, 23 bp, Mus musculus
gtgtatgtgtgtatgcgtatgtt

SEQ ID NO: 216565 - DNA, 23 bp, Mus musculus
atgtatgtatacatgtatgtatg

SEQ ID NO: 216566 - DNA, 23 bp, Mus musculus
attagttatgtgaagattcagtg

SEQ ID NO: 216567 - DNA, 22 bp, Mus musculus
agtgagtaaggagatacacaag

SEQ ID NO: 216568 - DNA, 21 bp, Mus musculus
gattgtgttgaggtttggtct

SEQ ID NO: 216569 - DNA, 19 bp, Mus musculus
cagcgtgacagtgtggcag

SEQ ID NO: 216570 - DNA, 23 bp, Mus musculus
ctgtctctgtcactccatggagt

SEQ ID NO: 216571 - DNA, 19 bp, Mus musculus
aagagtcagaatatagcac

SEQ ID NO: 216572 - DNA, 23 bp, Mus musculus
tgtctgtctgtctgtctgtctgt

SEQ ID NO: 216573 - DNA, 20 bp, Mus musculus
atctatgtgtttatctatgt

SEQ ID NO: 216574 - DNA, 23 bp, Mus musculus
atttatctatatctatctgtgtg

SEQ ID NO: 216575 - DNA, 23 bp, Mus musculus
atacactgtctgtgaaagaccac

SEQ ID NO: 216576 - DNA, 23 bp, Mus musculus
tgagcatcgtcagagcagcaact

SEQ ID NO: 216577 - DNA, 22 bp, Mus musculus
tgattcatctagtaggtatttt

SEQ ID NO: 216578 - DNA, 23 bp, Mus musculus
ctctgcgtgtgtctcagcttctt

SEQ ID NO: 216579 - DNA, 20 bp, Mus musculus
agaaagtgcttcctgttcgt

SEQ ID NO: 216580 - DNA, 23 bp, Mus musculus
tctcagagagtagtgagtgctga

SEQ ID NO: 216581 - DNA, 23 bp, Mus musculus
acacttgtctagcaactgaactc

SEQ ID NO: 216582 - DNA, 23 bp, Mus musculus
ccgagccctaactgtctctcgct

SEQ ID NO: 216583 - DNA, 19 bp, Mus musculus
actgccactcagtcacagt

SEQ ID NO: 216584 - DNA, 23 bp, Mus musculus
acttttttctttttgtagtagca

SEQ ID NO: 216585 - DNA, 20 bp, Mus musculus
cctcatctttgcaatctgtg

SEQ ID NO: 216586 - DNA, 23 bp, Mus musculus
cagctgagtctctgtgtgggtcc

SEQ ID NO: 216587 - DNA, 22 bp, Mus musculus
gtgtatatatgtgtgtgtacat

SEQ ID NO: 216588 - DNA, 23 bp, Mus musculus
tatatgtatgtatatatatgtat

SEQ ID NO: 216589 - DNA, 21 bp, Mus musculus
atgtatatatgtatatgtatg

SEQ ID NO: 216590 - DNA, 23 bp, Mus musculus
gtgtgcattcatgtgtgtgtgtg

SEQ ID NO: 216591 - DNA, 19 bp, Mus musculus
catggtggtctgataggat

SEQ ID NO: 216592 - DNA, 22 bp, Mus musculus
tgttttgtgaccaattatatgg

SEQ ID NO: 216593 - DNA, 23 bp, Mus musculus
cagactgtacacactgaccactt

SEQ ID NO: 216594 - DNA, 23 bp, Mus musculus
tatgtcagagatgataggaaggg

SEQ ID NO: 216595 - DNA, 23 bp, Mus musculus
gccactcaggttgttgatttgaa

SEQ ID NO: 216596 - DNA, 23 bp, Mus musculus
aactggttgtgatatgtttatgt

SEQ ID NO: 216597 - DNA, 19 bp, Mus musculus
tgtttgactgagattgttg

SEQ ID NO: 216598 - DNA, 22 bp, Mus musculus
gagcactttagatgctgggctg

SEQ ID NO: 216599 - DNA, 23 bp, Mus musculus
tctcagtgtctgtgtgttaactc

SEQ ID NO: 216600 - DNA, 20 bp, Mus musculus
gtggtagcaggttctttaga

SEQ ID NO: 216601 - DNA, 22 bp, Mus musculus
tcagtccccttcagctctctga

SEQ ID NO: 216602 - DNA, 21 bp, Mus musculus
acacttgtctctgtaactcct

SEQ ID NO: 216603 - DNA, 23 bp, Mus musculus
tgtgtatatatatgcatatgtga

SEQ ID NO: 216604 - DNA, 20 bp, Mus musculus
atatgttatatataattgca

SEQ ID NO: 216605 - DNA, 21 bp, Mus musculus
tgcgtatacatacatatatgt

SEQ ID NO: 216606 - DNA, 23 bp, Mus musculus
agaaccatctctctgtcacagac

SEQ ID NO: 216607 - DNA, 23 bp, Mus musculus
tgtctctgtgtgtctttcctgtt

SEQ ID NO: 216608 - DNA, 22 bp, Mus musculus
tgtgtgtatgtatatatgtgta

SEQ ID NO: 216609 - DNA, 18 bp, Mus musculus
ttctcccacttcacctga

SEQ ID NO: 216610 - DNA, 21 bp, Mus musculus
aaacttgaagctgaaatcatg

SEQ ID NO: 216611 - DNA, 21 bp, Mus musculus
atatgcatatataatatatgt

SEQ ID NO: 216612 - DNA, 21 bp, Mus musculus
tatatgtatatatatatgtgt

SEQ ID NO: 216613 - DNA, 20 bp, Mus musculus
tgtccactcctttagatttt

SEQ ID NO: 216614 - DNA, 23 bp, Mus musculus
gtgtcactcactgtcttgggtct

SEQ ID NO: 216615 - DNA, 23 bp, Mus musculus
gtctgtctgtctgtctgtccatt

SEQ ID NO: 216616 - DNA, 23 bp, Mus musculus
atatgtgtgcatatatatagtgt

SEQ ID NO: 216617 - DNA, 22 bp, Mus musculus
tgtgtatatatatatgtgtgtg

SEQ ID NO: 216618 - DNA, 20 bp, Mus musculus
cactgaagagactgagctga

SEQ ID NO: 216619 - DNA, 22 bp, Mus musculus
tgcatgtgtgtgtgtctaacat

SEQ ID NO: 216620 - DNA, 20 bp, Mus musculus
atatgtatgtatgtatgtgt

SEQ ID NO: 216621 - DNA, 19 bp, Mus musculus
agagaagagtgacagctct

SEQ ID NO: 216622 - DNA, 23 bp, Mus musculus
tgcctgtgtctctgtgtgtgagt

SEQ ID NO: 216623 - DNA, 20 bp, Mus musculus
atgtatgtgtgtatatgtgg

SEQ ID NO: 216624 - DNA, 23 bp, Mus musculus
tgtgtgtgtgtgtatgtatagat

SEQ ID NO: 216625 - DNA, 23 bp, Mus musculus
aagtcagtgaagagactacctct

SEQ ID NO: 216626 - DNA, 23 bp, Mus musculus
gtctttagtgtttatgatgttgt

SEQ ID NO: 216627 - DNA, 23 bp, Mus musculus
gaggtagcaggatgtttactgat

SEQ ID NO: 216628 - DNA, 23 bp, Mus musculus
actgaggtagagttgtgagtttg

SEQ ID NO: 216629 - DNA, 21 bp, Mus musculus
gctcgcacacacactctgagc

SEQ ID NO: 216630 - DNA, 23 bp, Mus musculus
tttctgagagatgtttgctggat

SEQ ID NO: 216631 - DNA, 23 bp, Mus musculus
ttaaagatgaaagcaattctttg

SEQ ID NO: 216632 - DNA, 21 bp, Mus musculus
tatagtctcatgtatgtatgt

SEQ ID NO: 216633 - DNA, 23 bp, Mus musculus
ttcatgttcatgtgcatgtgtta

SEQ ID NO: 216634 - DNA, 23 bp, Mus musculus
caatgtatgcatacgtacacaca

SEQ ID NO: 216635 - DNA, 23 bp, Mus musculus
acatgtatgtgtgcatgtgtttg

SEQ ID NO: 216636 - DNA, 22 bp, Mus musculus
attaacagtgttgtatatttga

SEQ ID NO: 216637 - DNA, 23 bp, Mus musculus
atacacaaacatatatgtgtgta

SEQ ID NO: 216638 - DNA, 23 bp, Mus musculus
tatatgactgatgatgttgtctc

SEQ ID NO: 216639 - DNA, 22 bp, Mus musculus
atgtcagtcaagatgagaatgg

SEQ ID NO: 216640 - DNA, 22 bp, Mus musculus
tgtgtgtatatgtatatgtgtg

SEQ ID NO: 216641 - DNA, 18 bp, Mus musculus
gtgtgtgaatacgtatgt

SEQ ID NO: 216642 - DNA, 23 bp, Mus musculus
atgtatgtgtatatgtatttaag

SEQ ID NO: 216643 - DNA, 21 bp, Mus musculus
tgccactctgactgacagcca

SEQ ID NO: 216644 - DNA, 23 bp, Mus musculus
tcactctgcctcactgactggga

SEQ ID NO: 216645 - DNA, 18 bp, Mus musculus
tgtgcatatatatataca

SEQ ID NO: 216646 - DNA, 22 bp, Mus musculus
ctgagtagatagtgagcaccct

SEQ ID NO: 216647 - DNA, 22 bp, Mus musculus
tgtttctgtgtggaacataaaa

SEQ ID NO: 216648 - DNA, 23 bp, Mus musculus
gagactgctattggttgtggttg

SEQ ID NO: 216649 - DNA, 23 bp, Mus musculus
gtcttaactctgtctctcactgg

SEQ ID NO: 216650 - DNA, 23 bp, Mus musculus
tcacatcttctaacactgccact

SEQ ID NO: 216651 - DNA, 23 bp, Mus musculus
tagacttgtgaatttctagatgg

SEQ ID NO: 216652 - DNA, 20 bp, Mus musculus
gctcctccttcacatgtggg

SEQ ID NO: 216653 - DNA, 20 bp, Mus musculus
ttgcacacagacagcacaga

SEQ ID NO: 216654 - DNA, 22 bp, Mus musculus
tgttttgtgaccaattatatgg

SEQ ID NO: 216655 - DNA, 22 bp, Mus musculus
tgttttgtgaccaattatatgg

SEQ ID NO: 216656 - DNA, 21 bp, Mus musculus
atttgtttgttttatttgcct

SEQ ID NO: 216657 - DNA, 23 bp, Mus musculus
ctcactgcctctctgtcttaaca

SEQ ID NO: 216658 - DNA, 22 bp, Mus musculus
agacacaccagacacaccagaa

SEQ ID NO: 216659 - DNA, 23 bp, Mus musculus
tacagactgttgtgagccaccac

SEQ ID NO: 216660 - DNA, 23 bp, Mus musculus
acacacacacacattcaagtgtg

SEQ ID NO: 216661 - DNA, 19 bp, Mus musculus
agtgaatatgaatatgtgt

SEQ ID NO: 216662 - DNA, 23 bp, Mus musculus
aagtgtctgtctgtctgtatgtg

SEQ ID NO: 216663 - DNA, 22 bp, Mus musculus
atctatatatgtatctgtgtgg

SEQ ID NO: 216664 - DNA, 20 bp, Mus musculus
cagagacacctggtggtggg

SEQ ID NO: 216665 - DNA, 23 bp, Mus musculus
gagtctttctctccctgggtctc

SEQ ID NO: 216666 - DNA, 18 bp, Mus musculus
tggctgtggatcaggact

SEQ ID NO: 216667 - DNA, 23 bp, Mus musculus
gttgtgagtcactgtgtgagtgc

SEQ ID NO: 216668 - DNA, 23 bp, Mus musculus
aaagagcaaccagtgctcttgac

SEQ ID NO: 216669 - DNA, 23 bp, Mus musculus
aaatgatcagagagagctctctg

SEQ ID NO: 216670 - DNA, 22 bp, Mus musculus
agctcctttctagacggctcag

SEQ ID NO: 216671 - DNA, 23 bp, Mus musculus
aagccagttgctggagctgtctg

SEQ ID NO: 216672 - DNA, 23 bp, Mus musculus
ctgtcactgtcactgggtcaaat

SEQ ID NO: 216673 - DNA, 23 bp, Mus musculus
tatatatatgcatatgtatatat

SEQ ID NO: 216674 - DNA, 23 bp, Mus musculus
tgaagcatgacagagagcacacc

SEQ ID NO: 216675 - DNA, 23 bp, Mus musculus
tgagagtgttctctgtgtctcca

SEQ ID NO: 216676 - DNA, 23 bp, Mus musculus
tatgtgtgtgtgtatatctgtgt

SEQ ID NO: 216677 - DNA, 23 bp, Mus musculus
tgcttttgtcccagaagagagtc

SEQ ID NO: 216678 - DNA, 23 bp, Mus musculus
aatgtcaggctgctttcttttgc

SEQ ID NO: 216679 - DNA, 23 bp, Mus musculus
agagatgaagcactcacataatc

SEQ ID NO: 216680 - DNA, 23 bp, Mus musculus
tactgatgtgagagaggtcattc

SEQ ID NO: 216681 - DNA, 23 bp, Mus musculus
taggtctctagagagttagctga

SEQ ID NO: 216682 - DNA, 23 bp, Mus musculus
gagatgtgtggcatacttttctg

SEQ ID NO: 216683 - DNA, 23 bp, Mus musculus
tgtctctgagcatagtcttgcac

SEQ ID NO: 216684 - DNA, 22 bp, Mus musculus
agtgggtcagaaattgtggtct

SEQ ID NO: 216685 - DNA, 21 bp, Mus musculus
tttaactgccctctgaagatg

SEQ ID NO: 216686 - DNA, 19 bp, Mus musculus
atatgtctgcctatgttta

SEQ ID NO: 216687 - DNA, 21 bp, Mus musculus
attcctaatatattggtatct

SEQ ID NO: 216688 - DNA, 23 bp, Mus musculus
tctgtctgtctgtctgtctatct

SEQ ID NO: 216689 - DNA, 23 bp, Mus musculus
tctcagtctgtcacccttttctg

SEQ ID NO: 216690 - DNA, 23 bp, Mus musculus
tatctgtctgtgtgtcatatccc

SEQ ID NO: 216691 - DNA, 22 bp, Mus musculus
tgcagaggtcagaagagtgtgt

SEQ ID NO: 216692 - DNA, 21 bp, Mus musculus
tggctccatgcttgtgtctga

SEQ ID NO: 216693 - DNA, 23 bp, Mus musculus
tcaggttctctctcagtgtgacc

SEQ ID NO: 216694 - DNA, 23 bp, Mus musculus
ctgtgtgtctctgggtgtgtcag

SEQ ID NO: 216695 - DNA, 23 bp, Mus musculus
gtatatgatgtatatgtatatgt

SEQ ID NO: 216696 - DNA, 22 bp, Mus musculus
tatgtgtatgtatatatgtgtg

SEQ ID NO: 216697 - DNA, 23 bp, Mus musculus
tctgtctgtctgtctatctgtct

SEQ ID NO: 216698 - DNA, 23 bp, Mus musculus
agcctgggtccctctgtgtcagt

SEQ ID NO: 216699 - DNA, 21 bp, Mus musculus
tctggtgtgtatcagatgtac

SEQ ID NO: 216700 - DNA, 22 bp, Mus musculus
tatagctgtatctggtatgtgt

SEQ ID NO: 216701 - DNA, 22 bp, Mus musculus
atgacaacctcatggttttcct

SEQ ID NO: 216702 - DNA, 23 bp, Mus musculus
taatggcactgcttgaaaacagg

SEQ ID NO: 216703 - DNA, 23 bp, Mus musculus
tgtcactgtctgtctgtctcata

SEQ ID NO: 216704 - DNA, 23 bp, Mus musculus
tctgtctgtctgtctgcatgtgc

SEQ ID NO: 216705 - DNA, 23 bp, Mus musculus
ctgtgtgtctgtgtgtatgttgt

SEQ ID NO: 216706 - DNA, 23 bp, Mus musculus
cctctcagtctctgtcaccttgc

SEQ ID NO: 216707 - DNA, 18 bp, Mus musculus
tcagccatgcattcgaga

SEQ ID NO: 216708 - DNA, 22 bp, Mus musculus
tttaatgctgtgtttgatttga

SEQ ID NO: 216709 - DNA, 22 bp, Mus musculus
ttattgtgtatataaacaggta

SEQ ID NO: 216710 - DNA, 22 bp, Mus musculus
actaactgctgctgctgctgct

SEQ ID NO: 216711 - DNA, 23 bp, Mus musculus
ctgtgtgtgtctctctctccctg

SEQ ID NO: 216712 - DNA, 23 bp, Mus musculus
tggctctcactgacagacttcac

SEQ ID NO: 216713 - DNA, 23 bp, Mus musculus
tctcagactcacagagacccagg

SEQ ID NO: 216714 - DNA, 23 bp, Mus musculus
tgactcggaggttaagagcactg

SEQ ID NO: 216715 - DNA, 23 bp, Mus musculus
agagtctgacactgtctgctagg

SEQ ID NO: 216716 - DNA, 19 bp, Mus musculus
gtgtgtatgcatgtgcatg

SEQ ID NO: 216717 - DNA, 23 bp, Mus musculus
tctctgtgtgtgcatgtgcatgc

SEQ ID NO: 216718 - DNA, 23 bp, Mus musculus
tgtgcatgtgtgcctccatctgt

SEQ ID NO: 216719 - DNA, 20 bp, Mus musculus
ggccctgactctgactctga

SEQ ID NO: 216720 - DNA, 23 bp, Mus musculus
acaggcccctgtctctgtctctc

SEQ ID NO: 216721 - DNA, 23 bp, Mus musculus
tctggggctcagtgtaagcctct

SEQ ID NO: 216722 - DNA, 18 bp, Mus musculus
acatgacatgcacacaca

SEQ ID NO: 216723 - DNA, 22 bp, Mus musculus
actctgagtgtgtaacatatgt

SEQ ID NO: 216724 - DNA, 23 bp, Mus musculus
agtcaggtctctcttattctctc

SEQ ID NO: 216725 - DNA, 23 bp, Mus musculus
tctgccacacactgtgcctgtga

SEQ ID NO: 216726 - DNA, 23 bp, Mus musculus
tggatcccatctcagtctgtctc

SEQ ID NO: 216727 - DNA, 20 bp, Mus musculus
tggctctggagactagctgt

SEQ ID NO: 216728 - DNA, 23 bp, Mus musculus
tcaggttcaaggatgattagcta

SEQ ID NO: 216729 - DNA, 19 bp, Mus musculus
gtgtatatgtttctgtgtg

SEQ ID NO: 216730 - DNA, 23 bp, Mus musculus
ctctgtctgcctctgtctcccga

SEQ ID NO: 216731 - DNA, 18 bp, Mus musculus
cagttgactgtgtgtttg

SEQ ID NO: 216732 - DNA, 21 bp, Mus musculus
cagtgtggctctgttcaggac

SEQ ID NO: 216733 - DNA, 20 bp, Mus musculus
cagtgcctgtcacaggtcct

SEQ ID NO: 216734 - DNA, 23 bp, Mus musculus
gtgcctggctctgtctctctggc

SEQ ID NO: 216735 - DNA, 21 bp, Mus musculus
agagacaacagacacagcagg

SEQ ID NO: 216736 - DNA, 23 bp, Mus musculus
aaagaaagtgtttatctaggcat

SEQ ID NO: 216737 - DNA, 19 bp, Mus musculus
atagcactgactgctcttc

SEQ ID NO: 216738 - DNA, 23 bp, Mus musculus
agactgaagttagtgtgcaggag

SEQ ID NO: 216739 - DNA, 23 bp, Mus musculus
cctcactcactcactccttggca

SEQ ID NO: 216740 - DNA, 23 bp, Mus musculus
tcagactgggtgactataggcca

SEQ ID NO: 216741 - DNA, 21 bp, Mus musculus
gactgacactctgtgtgtgtg

SEQ ID NO: 216742 - DNA, 23 bp, Mus musculus
atcactgtctctgtcttattcaa

SEQ ID NO: 216743 - DNA, 22 bp, Mus musculus
ctcttcttccacgactctgtct

SEQ ID NO: 216744 - DNA, 23 bp, Mus musculus
cagaggaacagcaaggagtaagg

SEQ ID NO: 216745 - DNA, 23 bp, Mus musculus
gtctgtctgtctgtctgcctgtc

SEQ ID NO: 216746 - DNA, 19 bp, Mus musculus
ttgcttttttgtttttttg

SEQ ID NO: 216747 - DNA, 23 bp, Mus musculus
gaagagacaactgtgtgtgctca

SEQ ID NO: 216748 - DNA, 23 bp, Mus musculus
ggctgtctctgtctctaatgtag

SEQ ID NO: 216749 - DNA, 23 bp, Mus musculus
atgtgtgtgtgtgcatgtgtatg

SEQ ID NO: 216750 - DNA, 23 bp, Mus musculus
atgtgtgtctgtgtgtatatgtg

SEQ ID NO: 216751 - DNA, 23 bp, Mus musculus
tatatatgtgtatatatacacgt

SEQ ID NO: 216752 - DNA, 23 bp, Mus musculus
tcactctctcacaagctggtgac

SEQ ID NO: 216753 - DNA, 23 bp, Mus musculus
gaaagatgtgtgtgtgtacatgt

SEQ ID NO: 216754 - DNA, 23 bp, Mus musculus
gtctgtctgaagactgtgagggg

SEQ ID NO: 216755 - DNA, 23 bp, Mus musculus
ctcagggtctctgtgtccctgag

SEQ ID NO: 216756 - DNA, 22 bp, Mus musculus
tgatgctactctgtctgtgagt

SEQ ID NO: 216757 - DNA, 23 bp, Mus musculus
tgtatgtgtgtgcaaatgagtgt

SEQ ID NO: 216758 - DNA, 18 bp, Mus musculus
tatgtgtgtgtgcaaatg

SEQ ID NO: 216759 - DNA, 22 bp, Mus musculus
ttcggtggcagcctgtttccca

SEQ ID NO: 216760 - DNA, 21 bp, Mus musculus
cagtagagctaaggttctctt

SEQ ID NO: 216761 - DNA, 18 bp, Mus musculus
atacatgtgggccaggga

SEQ ID NO: 216762 - DNA, 23 bp, Mus musculus
cagatgtgtctgtctctgtcagg

SEQ ID NO: 216763 - DNA, 23 bp, Mus musculus
atatgtagtatatatgtatatga

SEQ ID NO: 216764 - DNA, 18 bp, Mus musculus
tatatgtatatggtggtg

SEQ ID NO: 216765 - DNA, 23 bp, Mus musculus
gcatcacagaagagggtctggac

SEQ ID NO: 216766 - DNA, 23 bp, Mus musculus
attagtagaagaggaggtgccta

SEQ ID NO: 216767 - DNA, 22 bp, Mus musculus
ttatgcaaggtatagttagcat

SEQ ID NO: 216768 - DNA, 22 bp, Mus musculus
acagctggcactgtgtcacaca

SEQ ID NO: 216769 - DNA, 23 bp, Mus musculus
tattcactctttgttcttggtgg

SEQ ID NO: 216770 - DNA, 23 bp, Mus musculus
aatctcacctggcaagagtcttc

SEQ ID NO: 216771 - DNA, 23 bp, Mus musculus
gcctgcctgcgtgcgtgcgtgcg

SEQ ID NO: 216772 - DNA, 23 bp, Mus musculus
atgtgtgtagctcatgttccagg

SEQ ID NO: 216773 - DNA, 19 bp, Mus musculus
ctataggaccaggacagca

SEQ ID NO: 216774 - DNA, 19 bp, Mus musculus
gaagttcttgggctggaga

SEQ ID NO: 216775 - DNA, 22 bp, Mus musculus
cacacactttctctctctctga

SEQ ID NO: 216776 - DNA, 19 bp, Mus musculus
ccctcactcactcactcac

SEQ ID NO: 216777 - DNA, 22 bp, Mus musculus
ttgacctcctgtgttaacctca

SEQ ID NO: 216778 - DNA, 22 bp, Mus musculus
acacaggctgagtgagaggctg

SEQ ID NO: 216779 - DNA, 23 bp, Mus musculus
gctgtcctagaactagctctgta

SEQ ID NO: 216780 - DNA, 22 bp, Mus musculus
tcacagagaagacagagctcag

SEQ ID NO: 216781 - DNA, 20 bp, Mus musculus
tgagttcttttttcttttct

SEQ ID NO: 216782 - DNA, 21 bp, Mus musculus
agcagacacaagagagtcagc

SEQ ID NO: 216783 - DNA, 23 bp, Mus musculus
tcactgcctgactgtcacactgg

SEQ ID NO: 216784 - DNA, 23 bp, Mus musculus
gctcctagtgaggcaggcagcgt

SEQ ID NO: 216785 - DNA, 23 bp, Mus musculus
tgtgcctgcctgtctgcctgcct

SEQ ID NO: 216786 - DNA, 19 bp, Mus musculus
aatctggataaagggctgg

SEQ ID NO: 216787 - DNA, 23 bp, Mus musculus
tgtgacatgtgtgtgagctctct

SEQ ID NO: 216788 - DNA, 22 bp, Mus musculus
taaggtgtgacatgaacttggg

SEQ ID NO: 216789 - DNA, 23 bp, Mus musculus
gttatccctctgtgtgtgtgtgt

SEQ ID NO: 216790 - DNA, 20 bp, Mus musculus
gacagacagacagacagaca

SEQ ID NO: 216791 - DNA, 23 bp, Mus musculus
catttgtgtctgagactgtctgt

SEQ ID NO: 216792 - DNA, 23 bp, Mus musculus
caaccatctgtaatgggatctga

SEQ ID NO: 216793 - DNA, 22 bp, Mus musculus
acagcctcagtgtatttattta

SEQ ID NO: 216794 - DNA, 21 bp, Mus musculus
ttcactcagcaaatggtgggc

SEQ ID NO: 216795 - DNA, 18 bp, Mus musculus
tattactgccacgtgaac

SEQ ID NO: 216796 - DNA, 22 bp, Mus musculus
ttttatattcttgtaaatggat

SEQ ID NO: 216797 - DNA, 23 bp, Mus musculus
tctgtctgtctgtctgcctgttt

SEQ ID NO: 216798 - DNA, 19 bp, Mus musculus
agctaggtctgttgagttg

SEQ ID NO: 216799 - DNA, 22 bp, Mus musculus
tcactcgagtcagagtctctca

SEQ ID NO: 216800 - DNA, 22 bp, Mus musculus
atctctcactctgtgcatgacc

SEQ ID NO: 216801 - DNA, 18 bp, Mus musculus
gattacagatgtgggggg

SEQ ID NO: 216802 - DNA, 22 bp, Mus musculus
acagagaaaccttgtcttgaaa

SEQ ID NO: 216803 - DNA, 23 bp, Mus musculus
atatgtatgtgtatgtatatatg

SEQ ID NO: 216804 - DNA, 18 bp, Mus musculus
tgtcacagcacagtgtgc

SEQ ID NO: 216805 - DNA, 23 bp, Mus musculus
tgagtctgtgcaagtgcatcttc

SEQ ID NO: 216806 - DNA, 23 bp, Mus musculus
ttcactgggtcactgtcaccctg

SEQ ID NO: 216807 - DNA, 19 bp, Mus musculus
cagagtgggtgtgagcacc

SEQ ID NO: 216808 - DNA, 18 bp, Mus musculus
ttctcctccacctgcaca

SEQ ID NO: 216809 - DNA, 21 bp, Mus musculus
ctgtcactgacagccatcaag

SEQ ID NO: 216810 - DNA, 23 bp, Mus musculus
attctctgtgcctcagtttccct

SEQ ID NO: 216811 - DNA, 20 bp, Mus musculus
ctctgcctatcaccagtgag

SEQ ID NO: 216812 - DNA, 22 bp, Mus musculus
aatctgactggaagatttcagg

SEQ ID NO: 216813 - DNA, 23 bp, Mus musculus
tgcctgcctgcctgcctgcctgg

SEQ ID NO: 216814 - DNA, 23 bp, Mus musculus
cacgttacagacactctctcagg

SEQ ID NO: 216815 - DNA, 21 bp, Mus musculus
tcaccggcagataagaggcct

SEQ ID NO: 216816 - DNA, 23 bp, Mus musculus
tcgctcgctcgttcgctcagtgt

SEQ ID NO: 216817 - DNA, 19 bp, Mus musculus
ctcttcagtctctgtgagc

SEQ ID NO: 216818 - DNA, 23 bp, Mus musculus
cctctgtctctgtctctcccgct

SEQ ID NO: 216819 - DNA, 21 bp, Mus musculus
tttcatagtgataggaataga

SEQ ID NO: 216820 - DNA, 19 bp, Mus musculus
tgccagggagactgggttc

SEQ ID NO: 216821 - DNA, 20 bp, Mus musculus
atgtatgtgtgcatgaagat

SEQ ID NO: 216822 - DNA, 18 bp, Mus musculus
ggtctctctcctttgcta

SEQ ID NO: 216823 - DNA, 21 bp, Mus musculus
tctctggctctgacactggca

SEQ ID NO: 216824 - DNA, 20 bp, Mus musculus
tcagggggacaaactcaggt

SEQ ID NO: 216825 - DNA, 23 bp, Mus musculus
gagagcagagactgaggtgtagc

SEQ ID NO: 216826 - DNA, 23 bp, Mus musculus
tgtgtgcatatgtgtgtgtgtgt

SEQ ID NO: 216827 - DNA, 21 bp, Mus musculus
atgtgtatgtgcttgtacatg

SEQ ID NO: 216828 - DNA, 23 bp, Mus musculus
aagtatgtgtgcatatgcatgtg

SEQ ID NO: 216829 - DNA, 23 bp, Mus musculus
gtatatatgtctgtgtgcatatg

SEQ ID NO: 216830 - DNA, 18 bp, Mus musculus
tggctgtgaccctggtcc

SEQ ID NO: 216831 - DNA, 19 bp, Mus musculus
tgagaagctctgtgtgtca

SEQ ID NO: 216832 - DNA, 21 bp, Mus musculus
agacacacagaaattgtttac

SEQ ID NO: 216833 - DNA, 21 bp, Mus musculus
ttaagagcactgactgctctt

SEQ ID NO: 216834 - DNA, 21 bp, Mus musculus
tttgagttgtcagtgaggtca

SEQ ID NO: 216835 - DNA, 23 bp, Mus musculus
atctgtctctctctgctgctgct

SEQ ID NO: 216836 - DNA, 23 bp, Mus musculus
atgtctatagttatgtgtgtgca

SEQ ID NO: 216837 - DNA, 23 bp, Mus musculus
aagctctcagctagtgcttctgc

SEQ ID NO: 216838 - DNA, 23 bp, Mus musculus
tctctgtgtgtgtcagggtgtgt

SEQ ID NO: 216839 - DNA, 23 bp, Mus musculus
ctggtccttacagtctgcctgag

SEQ ID NO: 216840 - DNA, 23 bp, Mus musculus
gtgtgtcactcactaggttccag

SEQ ID NO: 216841 - DNA, 23 bp, Mus musculus
ggaactcactttgtagaccaggc

SEQ ID NO: 216842 - DNA, 23 bp, Mus musculus
agatctgtctgcctctgtctccc

SEQ ID NO: 216843 - DNA, 18 bp, Mus musculus
tctcagagactcaatggg

SEQ ID NO: 216844 - DNA, 22 bp, Mus musculus
aatcagcctgtggagctggtga

SEQ ID NO: 216845 - DNA, 18 bp, Mus musculus
tgagttagtctgtcactt

SEQ ID NO: 216846 - DNA, 23 bp, Mus musculus
tgtcacacaggctgacttcaacc

SEQ ID NO: 216847 - DNA, 18 bp, Mus musculus
tggcagaagtggagcacc

SEQ ID NO: 216848 - DNA, 21 bp, Mus musculus
ggaattaaaggtagagtgtgc

SEQ ID NO: 216849 - DNA, 23 bp, Mus musculus
agactcactctgtgcctgatact

SEQ ID NO: 216850 - DNA, 19 bp, Mus musculus
tcagtccgtatagcatggg

SEQ ID NO: 216851 - DNA, 18 bp, Mus musculus
tgggctaggagtgtctca

SEQ ID NO: 216852 - DNA, 20 bp, Mus musculus
gtgtagtttcggctctgtgt

SEQ ID NO: 216853 - DNA, 23 bp, Mus musculus
tgtctgtctgtctgtctgcatgg

SEQ ID NO: 216854 - DNA, 21 bp, Mus musculus
gtgagagacagagacagagca

SEQ ID NO: 216855 - DNA, 23 bp, Mus musculus
cagtggctgcctggctccttctc

SEQ ID NO: 216856 - DNA, 23 bp, Mus musculus
gatgtcccaagtgaatgagtggc

SEQ ID NO: 216857 - DNA, 23 bp, Mus musculus
tgccagtgtagtcatgtgatgct

SEQ ID NO: 216858 - DNA, 23 bp, Mus musculus
tctagggtctcactggctcactg

SEQ ID NO: 216859 - DNA, 21 bp, Mus musculus
tgcagtcatgtgatgctcctg

SEQ ID NO: 216860 - DNA, 23 bp, Mus musculus
tctcactggctcactgacagact

SEQ ID NO: 216861 - DNA, 20 bp, Mus musculus
cagtcatgtgatgctcctgc

SEQ ID NO: 216862 - DNA, 23 bp, Mus musculus
tgtctagggtctcactggctcac

SEQ ID NO: 216863 - DNA, 23 bp, Mus musculus
tgtctacctgtctgtctgtctgt

SEQ ID NO: 216864 - DNA, 23 bp, Mus musculus
accttgaggtaggtgatgactgc

SEQ ID NO: 216865 - DNA, 23 bp, Mus musculus
agtgctctctctctctcttttgg

SEQ ID NO: 216866 - DNA, 21 bp, Mus musculus
ttgtcaatatatatatttgac

SEQ ID NO: 216867 - DNA, 22 bp, Mus musculus
aatgatgtcaaatgccttactg

SEQ ID NO: 216868 - DNA, 23 bp, Mus musculus
catgtattgagatttacttgatg

SEQ ID NO: 216869 - DNA, 23 bp, Mus musculus
catctcagtctctctgctctggg

SEQ ID NO: 216870 - DNA, 23 bp, Mus musculus
ttcttgctcctgtccaagcaggt

SEQ ID NO: 216871 - DNA, 18 bp, Mus musculus
agtcaagagcggagagtc

SEQ ID NO: 216872 - DNA, 23 bp, Mus musculus
aagttacagtgatcaggcacaga

SEQ ID NO: 216873 - DNA, 23 bp, Mus musculus
acagtctcacacacccacacatg

SEQ ID NO: 216874 - DNA, 23 bp, Mus musculus
tcacagagacccacactgggtct

SEQ ID NO: 216875 - DNA, 23 bp, Mus musculus
tttagtctctcactctcacccaa

SEQ ID NO: 216876 - DNA, 21 bp, Mus musculus
acttacttgactgagagctct

SEQ ID NO: 216877 - DNA, 23 bp, Mus musculus
actggcctctctctgtcactcta

SEQ ID NO: 216878 - DNA, 23 bp, Mus musculus
cagacactctgtgaccctgtgac

SEQ ID NO: 216879 - DNA, 23 bp, Mus musculus
acagagcctgggtctctgtttgt

SEQ ID NO: 216880 - DNA, 22 bp, Mus musculus
aagctcagagagaaaggacaca

SEQ ID NO: 216881 - DNA, 23 bp, Mus musculus
tctgtggtaatggctgtggaaag

SEQ ID NO: 216882 - DNA, 18 bp, Mus musculus
aaaggttctgagttcaaa

SEQ ID NO: 216883 - DNA, 22 bp, Mus musculus
atctgtctccctatgtacacag

SEQ ID NO: 216884 - DNA, 19 bp, Mus musculus
ttttgccttgatttctatt

SEQ ID NO: 216885 - DNA, 20 bp, Mus musculus
tgtgaccactgtctgtctgt

SEQ ID NO: 216886 - DNA, 23 bp, Mus musculus
tgcattaaagagggcctggagag

SEQ ID NO: 216887 - DNA, 21 bp, Mus musculus
taagagcactgactgctctac

SEQ ID NO: 216888 - DNA, 22 bp, Mus musculus
gcctctctctgcctctgagtgc

SEQ ID NO: 216889 - DNA, 23 bp, Mus musculus
catttgtgtgcttatgtatgtat

SEQ ID NO: 216890 - DNA, 23 bp, Mus musculus
tcgaggagctcacagtctagtat

SEQ ID NO: 216891 - DNA, 23 bp, Mus musculus
actagactgaggctccttgagga

SEQ ID NO: 216892 - DNA, 22 bp, Mus musculus
attttctttgaagtctgtggca

SEQ ID NO: 216893 - DNA, 23 bp, Mus musculus
atcctctctgcctctgtcagtcg

SEQ ID NO: 216894 - DNA, 23 bp, Mus musculus
tgttgagaccttcttgtggccca

SEQ ID NO: 216895 - DNA, 23 bp, Mus musculus
aatagacattaggaaagatcagg

SEQ ID NO: 216896 - DNA, 23 bp, Mus musculus
tgtgtatatatatatgtgtgtgt

SEQ ID NO: 216897 - DNA, 23 bp, Mus musculus
tgtcactgtgtgtctgtgtgcat

SEQ ID NO: 216898 - DNA, 21 bp, Mus musculus
atacagtttgcccttcatgtg

SEQ ID NO: 216899 - DNA, 22 bp, Mus musculus
tctctgtctgttagaactgtgt

SEQ ID NO: 216900 - DNA, 23 bp, Mus musculus
tctgtcactctgtgcgtctgcat

SEQ ID NO: 216901 - DNA, 23 bp, Mus musculus
ctgggactctgtctctctcaggt

SEQ ID NO: 216902 - DNA, 19 bp, Mus musculus
tgtgtgtcacagtcacaca

SEQ ID NO: 216903 - DNA, 23 bp, Mus musculus
agtgtcaccatgacaactgaagg

SEQ ID NO: 216904 - DNA, 19 bp, Mus musculus
agactctggattggttatt

SEQ ID NO: 216905 - DNA, 23 bp, Mus musculus
cacagatgagacacagtaccaat

SEQ ID NO: 216906 - DNA, 23 bp, Mus musculus
ctgtgtgtgtgcatgtatgtata

SEQ ID NO: 216907 - DNA, 23 bp, Mus musculus
tatgtgtgtgcttgtgcatgtgg

SEQ ID NO: 216908 - DNA, 23 bp, Mus musculus
tgtatgtcttagtcaaagggggt

SEQ ID NO: 216909 - DNA, 22 bp, Mus musculus
tgttttgtgaccaattatatgg

SEQ ID NO: 216910 - DNA, 23 bp, Mus musculus
tctgatgtcacagagctgaaagt

SEQ ID NO: 216911 - DNA, 22 bp, Mus musculus
tgttttgtgaccaattatatgg

SEQ ID NO: 216912 - DNA, 22 bp, Mus musculus
tgttttgtgaccaattatatgg

SEQ ID NO: 216913 - DNA, 22 bp, Mus musculus
tgttttgtgaccaattatatgg

SEQ ID NO: 216914 - DNA, 23 bp, Mus musculus
tgtgacactgcttctgagaacat

SEQ ID NO: 216915 - DNA, 22 bp, Mus musculus
tgttttgtgaccaattatatgg

SEQ ID NO: 216916 - DNA, 22 bp, Mus musculus
cagtgtctctctgactgctgcc

SEQ ID NO: 216917 - DNA, 22 bp, Mus musculus
tagatgactgtggtactcagaa

SEQ ID NO: 216918 - DNA, 23 bp, Mus musculus
tgttcatgtctgtgtgtgtgtgt

SEQ ID NO: 216919 - DNA, 22 bp, Mus musculus
tgttttgtgaccaattatatgg

SEQ ID NO: 216920 - DNA, 23 bp, Mus musculus
tgcagcttggttttcatatgtgt

SEQ ID NO: 216921 - DNA, 23 bp, Mus musculus
atgcatgtatgcatgtatgtatg

SEQ ID NO: 216922 - DNA, 22 bp, Mus musculus
tgttttgtgaccaattatatgg

SEQ ID NO: 216923 - DNA, 23 bp, Mus musculus
aagagagaagaatgattgcacat

SEQ ID NO: 216924 - DNA, 22 bp, Mus musculus
ttagaagtttttcctagttcgt

SEQ ID NO: 216925 - DNA, 20 bp, Mus musculus
atatgtgtgtatatatatgt

SEQ ID NO: 216926 - DNA, 21 bp, Mus musculus
ttataggtagtatattcattt

SEQ ID NO: 216927 - DNA, 23 bp, Mus musculus
tatgtatatatatatatgtgtgt

SEQ ID NO: 216928 - DNA, 23 bp, Mus musculus
tcagagtagggtagactagtgtg

SEQ ID NO: 216929 - DNA, 19 bp, Mus musculus
aattgcattttgaaagtga

SEQ ID NO: 216930 - DNA, 21 bp, Mus musculus
tcagtcacagaaattcagcat

SEQ ID NO: 216931 - DNA, 23 bp, Mus musculus
tttgttcttgagataggtgaagc

SEQ ID NO: 216932 - DNA, 19 bp, Mus musculus
tgtgtctttgtatgtatta

SEQ ID NO: 216933 - DNA, 23 bp, Mus musculus
atatacattgaatatgtagatgt

SEQ ID NO: 216934 - DNA, 18 bp, Mus musculus
tgtcaagaatgcattgtg

SEQ ID NO: 216935 - DNA, 19 bp, Mus musculus
gacagaacactgagagaag

SEQ ID NO: 216936 - DNA, 19 bp, Mus musculus
acactggttggattttcta

SEQ ID NO: 216937 - DNA, 23 bp, Mus musculus
tgttgtgctacaatctatcacac

SEQ ID NO: 216938 - DNA, 23 bp, Mus musculus
tccactctctctctgagcctgag

SEQ ID NO: 216939 - DNA, 20 bp, Mus musculus
attagaaaggaatccaaatg

SEQ ID NO: 216940 - DNA, 23 bp, Mus musculus
ctcactgaagacagtgtctagat

SEQ ID NO: 216941 - DNA, 23 bp, Mus musculus
atgagcaaagaaaacattgtctt

SEQ ID NO: 216942 - DNA, 22 bp, Mus musculus
ttaaagtacttctctttggaac

SEQ ID NO: 216943 - DNA, 18 bp, Mus musculus
tggctccaatagaactct

SEQ ID NO: 216944 - DNA, 23 bp, Mus musculus
ggttgttcttcagaattgcagag

SEQ ID NO: 216945 - DNA, 23 bp, Mus musculus
tatgtatatatacatgtgtgtgt

SEQ ID NO: 216946 - DNA, 22 bp, Mus musculus
tgtaaacatccccgactggaag

SEQ ID NO: 216947 - DNA, 23 bp, Mus musculus
ctttcagtcagatgtttgctgct

SEQ ID NO: 216948 - DNA, 23 bp, Mus musculus
tgtaaacatcctacactcagctg

SEQ ID NO: 216949 - DNA, 18 bp, Mus musculus
gctcactctcaggctctg

SEQ ID NO: 216950 - DNA, 23 bp, Mus musculus
tccctgtcagtatcaaattgatc

SEQ ID NO: 216951 - DNA, 23 bp, Mus musculus
tctgcctggagtcagtgggtcag

SEQ ID NO: 216952 - DNA, 22 bp, Mus musculus
actgaactcattttgaacttct

SEQ ID NO: 216953 - DNA, 23 bp, Mus musculus
atatgtatatgtatatgtatatg

SEQ ID NO: 216954 - DNA, 23 bp, Mus musculus
gagtgaagtaacacagcaccaga

SEQ ID NO: 216955 - DNA, 23 bp, Mus musculus
tgtcagagtttggtgtttgctca

SEQ ID NO: 216956 - DNA, 23 bp, Mus musculus
tggacattcagtgtgtcactgag

SEQ ID NO: 216957 - DNA, 22 bp, Mus musculus
cttgactctagagcctctgctc

SEQ ID NO: 216958 - DNA, 23 bp, Mus musculus
tgatagcgtgctctgggtggtgt

SEQ ID NO: 216959 - DNA, 23 bp, Mus musculus
ttcttcctgtggtttcttgcaga

SEQ ID NO: 216960 - DNA, 23 bp, Mus musculus
gacagtgagtgactgtctctcta

SEQ ID NO: 216961 - DNA, 20 bp, Mus musculus
ggacagactctgtgtgtctt

SEQ ID NO: 216962 - DNA, 23 bp, Mus musculus
tttgtgtatgtgtataggcttac

SEQ ID NO: 216963 - DNA, 23 bp, Mus musculus
ttgactggagtctgtgagcacag

SEQ ID NO: 216964 - DNA, 23 bp, Mus musculus
aggtagcctcttcatggagcaga

SEQ ID NO: 216965 - DNA, 21 bp, Mus musculus
aggatcagctcatgcaagtgt

SEQ ID NO: 216966 - DNA, 23 bp, Mus musculus
ctctcagtctctcagtctctctc

SEQ ID NO: 216967 - DNA, 23 bp, Mus musculus
aactgcctctgtgacatttttcc

SEQ ID NO: 216968 - DNA, 20 bp, Mus musculus
ctgtctctgcttcacactgt

SEQ ID NO: 216969 - DNA, 23 bp, Mus musculus
tcactgaggttgctctgagcttt

SEQ ID NO: 216970 - DNA, 23 bp, Mus musculus
tgtctgaagacagctactcttac

SEQ ID NO: 216971 - DNA, 22 bp, Mus musculus
ttttaagggagtactctgtgac

SEQ ID NO: 216972 - DNA, 23 bp, Mus musculus
tttcagttacttttctgttgctg

SEQ ID NO: 216973 - DNA, 21 bp, Mus musculus
cacagaactgagtgtgaagtt

SEQ ID NO: 216974 - DNA, 20 bp, Mus musculus
taaacatacatgagagaggg

SEQ ID NO: 216975 - DNA, 23 bp, Mus musculus
aatgggtctcaagttggactggt

SEQ ID NO: 216976 - DNA, 23 bp, Mus musculus
gacactcagtagatagatagcag

SEQ ID NO: 216977 - DNA, 23 bp, Mus musculus
tgacactgcttgttgtttgtact

SEQ ID NO: 216978 - DNA, 22 bp, Mus musculus
tgttttgtgaccaattatatgg

SEQ ID NO: 216979 - DNA, 22 bp, Mus musculus
tgttttgtgaccaattatatgg

SEQ ID NO: 216980 - DNA, 23 bp, Mus musculus
tatacatgtatatgtgtatatgt

SEQ ID NO: 216981 - DNA, 23 bp, Mus musculus
tgtgtgcatatctctctctctct

SEQ ID NO: 216982 - DNA, 20 bp, Mus musculus
caggatctgtctgttgatga

SEQ ID NO: 216983 - DNA, 22 bp, Mus musculus
agtgtctctttctgtctctcct

SEQ ID NO: 216984 - DNA, 23 bp, Mus musculus
tttggacttgtgagggacagtgt

SEQ ID NO: 216985 - DNA, 18 bp, Mus musculus
gggacacactgtcacact

SEQ ID NO: 216986 - DNA, 21 bp, Mus musculus
tcccagtgtagccacattgaa

SEQ ID NO: 216987 - DNA, 21 bp, Mus musculus
ctagattgcttttggtaggat

SEQ ID NO: 216988 - DNA, 22 bp, Mus musculus
tttgtgctctgaggccattgac

SEQ ID NO: 216989 - DNA, 21 bp, Mus musculus
tcacactgctagagcagagcc

SEQ ID NO: 216990 - DNA, 23 bp, Mus musculus
aaatatgtgtgtgtatatatgtg

SEQ ID NO: 216991 - DNA, 23 bp, Mus musculus
tatgtatgtatatatacgtgtat

SEQ ID NO: 216992 - DNA, 23 bp, Mus musculus
ggtctcactgtgtggctctggct

SEQ ID NO: 216993 - DNA, 22 bp, Mus musculus
gagtgcatttgaatcgggctta

SEQ ID NO: 216994 - DNA, 23 bp, Mus musculus
tgggtcgctgtgagatttccccc

SEQ ID NO: 216995 - DNA, 22 bp, Mus musculus
gtctaactcagcaaccctttct

SEQ ID NO: 216996 - DNA, 23 bp, Mus musculus
tatgttcttcattgggttgtgag

SEQ ID NO: 216997 - DNA, 22 bp, Mus musculus
tgttttgtgaccaattatatgg

SEQ ID NO: 216998 - DNA, 23 bp, Mus musculus
aaaaagcaagactagctggagag

SEQ ID NO: 216999 - DNA, 23 bp, Mus musculus
aagagcactgactgctcttccag

SEQ ID NO: 217000 - DNA, 23 bp, Mus musculus
tctctgcctgtctccctgtcaag

SEQ ID NO: 217001 - DNA, 23 bp, Mus musculus
gtctccactttggttttctctca

SEQ ID NO: 217002 - DNA, 19 bp, Mus musculus
tggctgcctggctgcctcc

SEQ ID NO: 217003 - DNA, 23 bp, Mus musculus
tcactgactgtctcacttgtagc

SEQ ID NO: 217004 - DNA, 21 bp, Mus musculus
aggaggcctcagtgggccagt

SEQ ID NO: 217005 - DNA, 23 bp, Mus musculus
tctgccagtctcactatctgggt

SEQ ID NO: 217006 - DNA, 22 bp, Mus musculus
actcattctggttgatttctgt

SEQ ID NO: 217007 - DNA, 23 bp, Mus musculus
atgtatgtatgtatgtgtgtgtg

SEQ ID NO: 217008 - DNA, 23 bp, Mus musculus
tttcactctgttgagtcattgac

SEQ ID NO: 217009 - DNA, 23 bp, Mus musculus
tactgtagtgactgagcagacag

SEQ ID NO: 217010 - DNA, 22 bp, Mus musculus
aagcttgaaaagtattgagttt

SEQ ID NO: 217011 - DNA, 21 bp, Mus musculus
gtgactctgcatgagcatctg

SEQ ID NO: 217012 - DNA, 22 bp, Mus musculus
tgttttgtgaccaattatatgg

SEQ ID NO: 217013 - DNA, 22 bp, Mus musculus
ttatatgtgtatttctatacat

SEQ ID NO: 217014 - DNA, 23 bp, Mus musculus
tctgtctctcttactgtaaccta

SEQ ID NO: 217015 - DNA, 23 bp, Mus musculus
actctcagtctctctgtcccttt

SEQ ID NO: 217016 - DNA, 23 bp, Mus musculus
agtaatagtttatgataaagttg

SEQ ID NO: 217017 - DNA, 22 bp, Mus musculus
tgttttgtgaccaattatatgg

SEQ ID NO: 217018 - DNA, 23 bp, Mus musculus
tttactctgaggtaatgtctgtc

SEQ ID NO: 217019 - DNA, 23 bp, Mus musculus
tgtgtgtctatgggtctcttgtg

SEQ ID NO: 217020 - DNA, 22 bp, Mus musculus
aactctgtatgccattctagac

SEQ ID NO: 217021 - DNA, 20 bp, Mus musculus
agagcatgacacatgacttt

SEQ ID NO: 217022 - DNA, 23 bp, Mus musculus
gttcaaacagagaaggcatgtga

SEQ ID NO: 217023 - DNA, 20 bp, Mus musculus
agtctgttgtggggctggag

SEQ ID NO: 217024 - DNA, 22 bp, Mus musculus
gactcacgctgtatacacacac

SEQ ID NO: 217025 - DNA, 23 bp, Mus musculus
tattgtttctttttttaacagaa

SEQ ID NO: 217026 - DNA, 22 bp, Mus musculus
tttaggtcctttgtcagtctct

SEQ ID NO: 217027 - DNA, 19 bp, Mus musculus
aacagtgcctatgttctat

SEQ ID NO: 217028 - DNA, 19 bp, Mus musculus
gtatgtatgcatgtgtgtt

SEQ ID NO: 217029 - DNA, 21 bp, Mus musculus
ctgtctgtctgtctgacagtg

SEQ ID NO: 217030 - DNA, 23 bp, Mus musculus
gctgtctctcacaatctgtcact

SEQ ID NO: 217031 - DNA, 23 bp, Mus musculus
tgagcaacgtctcagactctcag

SEQ ID NO: 217032 - DNA, 23 bp, Mus musculus
ggctcactctcagtctggatatg

SEQ ID NO: 217033 - DNA, 23 bp, Mus musculus
tgtgagtatgtatgtatgtgtgt

SEQ ID NO: 217034 - DNA, 18 bp, Mus musculus
tgtatgtatgtatgtatg

SEQ ID NO: 217035 - DNA, 23 bp, Mus musculus
gtatgtacgtgcactgtgtgtat

SEQ ID NO: 217036 - DNA, 23 bp, Mus musculus
tgtgtgtctgccagtgacaggtg

SEQ ID NO: 217037 - DNA, 20 bp, Mus musculus
gtgtgtgtatgtgcatgtgt

SEQ ID NO: 217038 - DNA, 23 bp, Mus musculus
ctcagactctttctgtctgtgct

SEQ ID NO: 217039 - DNA, 22 bp, Mus musculus
tcagatgactgaagagactcag

SEQ ID NO: 217040 - DNA, 23 bp, Mus musculus
gtctacacagtgagtttcaggtc

SEQ ID NO: 217041 - DNA, 19 bp, Mus musculus
attctaggtactgactctg

SEQ ID NO: 217042 - DNA, 22 bp, Mus musculus
ctctccctgcctcactttctgc

SEQ ID NO: 217043 - DNA, 23 bp, Mus musculus
tatgtgtatgtatatatatgtgt

SEQ ID NO: 217044 - DNA, 23 bp, Mus musculus
tgactgagcagtctgtgcactgt

SEQ ID NO: 217045 - DNA, 23 bp, Mus musculus
agtctgtcgctcactaatttgtc

SEQ ID NO: 217046 - DNA, 18 bp, Mus musculus
tgctggctagtcagtgag

SEQ ID NO: 217047 - DNA, 23 bp, Mus musculus
taagagcactgactgctcttcca

SEQ ID NO: 217048 - DNA, 23 bp, Mus musculus
tgagtgtgtgtgcatgtgcatgt

SEQ ID NO: 217049 - DNA, 22 bp, Mus musculus
tatgtgagtgtgcatgagtgtg

SEQ ID NO: 217050 - DNA, 23 bp, Mus musculus
gtttatctgatgtttatgagtcg

SEQ ID NO: 217051 - DNA, 20 bp, Mus musculus
atctgcagaaataacagcca

SEQ ID NO: 217052 - DNA, 20 bp, Mus musculus
atgtgtatgcttatgtgtgt

SEQ ID NO: 217053 - DNA, 23 bp, Mus musculus
tgtaagcatgttgtatgtatgta

SEQ ID NO: 217054 - DNA, 18 bp, Mus musculus
agatgagtgggattggtg

SEQ ID NO: 217055 - DNA, 22 bp, Mus musculus
tgaatctctctgtctatgttga

SEQ ID NO: 217056 - DNA, 23 bp, Mus musculus
atgggtgggtggcactatccctc

SEQ ID NO: 217057 - DNA, 23 bp, Mus musculus
gtttgtgtgcatgtatctgtctg

SEQ ID NO: 217058 - DNA, 19 bp, Mus musculus
tgcacacacacacacacac

SEQ ID NO: 217059 - DNA, 23 bp, Mus musculus
cagcatggatgtcactgggtata

SEQ ID NO: 217060 - DNA, 23 bp, Mus musculus
tgtgtgttttgtctgcctgtctg

SEQ ID NO: 217061 - DNA, 22 bp, Mus musculus
gaagacagaagtcagagggcac

SEQ ID NO: 217062 - DNA, 22 bp, Mus musculus
tatgtatgtatgtatgtatgta

SEQ ID NO: 217063 - DNA, 22 bp, Mus musculus
tatgtatgtatgtatttatgta

SEQ ID NO: 217064 - DNA, 19 bp, Mus musculus
atatgtatatatatatatg

SEQ ID NO: 217065 - DNA, 22 bp, Mus musculus
tgaatctatttatatatgtgag

SEQ ID NO: 217066 - DNA, 18 bp, Mus musculus
atatgaatatattcatat

SEQ ID NO: 217067 - DNA, 23 bp, Mus musculus
tgaacagtctgaaatgccaactt

SEQ ID NO: 217068 - DNA, 20 bp, Mus musculus
agcagaggaatgttctgtgg

SEQ ID NO: 217069 - DNA, 23 bp, Mus musculus
tgtatatatgtatgtatatgtgt

SEQ ID NO: 217070 - DNA, 21 bp, Mus musculus
aagagagagaacagtcagagc

SEQ ID NO: 217071 - DNA, 20 bp, Mus musculus
tgtggaattatactgcatac

SEQ ID NO: 217072 - DNA, 22 bp, Mus musculus
gcttatgtgtgtgcatgcatgc

SEQ ID NO: 217073 - DNA, 22 bp, Mus musculus
aatgacagggaacagagtcaga

SEQ ID NO: 217074 - DNA, 23 bp, Mus musculus
gacagtcacagagcttagggttt

SEQ ID NO: 217075 - DNA, 23 bp, Mus musculus
tagttgtctcagtctcagaacat

SEQ ID NO: 217076 - DNA, 19 bp, Mus musculus
gagagccattctgaagact

SEQ ID NO: 217077 - DNA, 22 bp, Mus musculus
tcctaggaagagatgggaagtg

SEQ ID NO: 217078 - DNA, 22 bp, Mus musculus
ttctttcctattgaattcactg

SEQ ID NO: 217079 - DNA, 23 bp, Mus musculus
agctgagacatgaatgtcaccac

SEQ ID NO: 217080 - DNA, 23 bp, Mus musculus
agactgtctcagttactgatttc

SEQ ID NO: 217081 - DNA, 22 bp, Mus musculus
tcagctactgggtagaggctct

SEQ ID NO: 217082 - DNA, 22 bp, Mus musculus
tgactgatctctgtgtgctcat

SEQ ID NO: 217083 - DNA, 23 bp, Mus musculus
cagttgattcagaggtattctct

SEQ ID NO: 217084 - DNA, 21 bp, Mus musculus
taagctatgtaatgtgatgaa

SEQ ID NO: 217085 - DNA, 20 bp, Mus musculus
acaaggtgaattttatgtgg

SEQ ID NO: 217086 - DNA, 21 bp, Mus musculus
tgtctcactctgtgaagggcc

SEQ ID NO: 217087 - DNA, 21 bp, Mus musculus
tatgctctgttagaagtgaga

SEQ ID NO: 217088 - DNA, 19 bp, Mus musculus
tctgcctccaactcctcag

SEQ ID NO: 217089 - DNA, 21 bp, Mus musculus
tgagttattaatttctgtact

SEQ ID NO: 217090 - DNA, 23 bp, Mus musculus
acactcagttggtctgatattgt

SEQ ID NO: 217091 - DNA, 21 bp, Mus musculus
tttgcagtgatgggtgcgata

SEQ ID NO: 217092 - DNA, 22 bp, Mus musculus
ttggtccctggaaatcttttgc

SEQ ID NO: 217093 - DNA, 22 bp, Mus musculus
tgttttgtgaccaattatatgg

SEQ ID NO: 217094 - DNA, 22 bp, Mus musculus
tgttttgtgaccaattatatgg

SEQ ID NO: 217095 - DNA, 23 bp, Mus musculus
tctgtctctgtttagtttctgtt

SEQ ID NO: 217096 - DNA, 18 bp, Mus musculus
gtcagtactcctggaaga

SEQ ID NO: 217097 - DNA, 23 bp, Mus musculus
aatccatgttgatctgataggat

SEQ ID NO: 217098 - DNA, 22 bp, Mus musculus
atggatgagtattccccttact

SEQ ID NO: 217099 - DNA, 20 bp, Mus musculus
tttggtcgatatagctcttt

SEQ ID NO: 217100 - DNA, 20 bp, Mus musculus
aaatagtcatttaattcacg

SEQ ID NO: 217101 - DNA, 21 bp, Mus musculus
tgtcagaggcatgtttgatga

SEQ ID NO: 217102 - DNA, 23 bp, Mus musculus
tgacagactcagacactccatag

SEQ ID NO: 217103 - DNA, 23 bp, Mus musculus
caaacagagatcatacagtggtg

SEQ ID NO: 217104 - DNA, 22 bp, Mus musculus
tggctggctggctggctgcctg

SEQ ID NO: 217105 - DNA, 20 bp, Mus musculus
tgtatgtatgtatgtatgta

SEQ ID NO: 217106 - DNA, 22 bp, Mus musculus
agccagactccctgattgccac

SEQ ID NO: 217107 - DNA, 22 bp, Mus musculus
tgttttgtgaccaattatatgg

SEQ ID NO: 217108 - DNA, 22 bp, Mus musculus
tgttttgtgaccaattatatgg

SEQ ID NO: 217109 - DNA, 23 bp, Mus musculus
tccaagtgttttgattttctact

SEQ ID NO: 217110 - DNA, 23 bp, Mus musculus
agcttaaaggttgttaagcgaag

SEQ ID NO: 217111 - DNA, 23 bp, Mus musculus
gtgatcgggctttcagttactca

SEQ ID NO: 217112 - DNA, 22 bp, Mus musculus
tatgatatatatcatgtgtgtg

SEQ ID NO: 217113 - DNA, 18 bp, Mus musculus
taagagagtggagccatg

SEQ ID NO: 217114 - DNA, 23 bp, Mus musculus
tatgcatatatatacgtgtgtgt

SEQ ID NO: 217115 - DNA, 19 bp, Mus musculus
tgacttgtattattgatct

SEQ ID NO: 217116 - DNA, 22 bp, Mus musculus
ttatagcctctgtcactcttct

SEQ ID NO: 217117 - DNA, 19 bp, Mus musculus
tatgtatatgtatatgtat

SEQ ID NO: 217118 - DNA, 23 bp, Mus musculus
gatagatcaactattcagagcag

SEQ ID NO: 217119 - DNA, 22 bp, Mus musculus
tgaatgagaagtgaattacttc

SEQ ID NO: 217120 - DNA, 23 bp, Mus musculus
tatgcatatgtatatgtatatgt

SEQ ID NO: 217121 - DNA, 20 bp, Mus musculus
tatatgtatgtaattatgta

SEQ ID NO: 217122 - DNA, 23 bp, Mus musculus
atgtatatgtgtatcatgtacat

SEQ ID NO: 217123 - DNA, 23 bp, Mus musculus
ttatgtatatatgtatgtgtgtg

SEQ ID NO: 217124 - DNA, 22 bp, Mus musculus
tgtgtatgtatgtatatatgta

SEQ ID NO: 217125 - DNA, 23 bp, Mus musculus
attgtgtagaatgttgtttagtt

SEQ ID NO: 217126 - DNA, 23 bp, Mus musculus
tttatgttgttattgaagatcag

SEQ ID NO: 217127 - DNA, 20 bp, Mus musculus
ccatggtgatctgataggat

SEQ ID NO: 217128 - DNA, 22 bp, Mus musculus
tgttttgtgaccaattatatgg

SEQ ID NO: 217129 - DNA, 22 bp, Mus musculus
acacaggagagagtctgcacag

SEQ ID NO: 217130 - DNA, 23 bp, Mus musculus
gaacagactgtctatggttttag

SEQ ID NO: 217131 - DNA, 22 bp, Mus musculus
tgtctgcatgctcagtctgatg

SEQ ID NO: 217132 - DNA, 23 bp, Mus musculus
tgagcatctgcatttgaattggt

SEQ ID NO: 217133 - DNA, 22 bp, Mus musculus
tgttttgtgaccaattatatgg

SEQ ID NO: 217134 - DNA, 22 bp, Mus musculus
tgttttgtgaccaattatatgg

SEQ ID NO: 217135 - DNA, 22 bp, Mus musculus
tgttttgtgaccaattatatgg

SEQ ID NO: 217136 - DNA, 23 bp, Mus musculus
cttctctctgtctcagttttagc

SEQ ID NO: 217137 - DNA, 19 bp, Mus musculus
tgacaggttaaggagaacc

SEQ ID NO: 217138 - DNA, 23 bp, Mus musculus
ctgtctgtctgtctgtctgtcta

SEQ ID NO: 217139 - DNA, 21 bp, Mus musculus
tatatgtatatgtatatgtat

SEQ ID NO: 217140 - DNA, 23 bp, Mus musculus
gtccttgtcttctgattatctgc

SEQ ID NO: 217141 - DNA, 23 bp, Mus musculus
tgtgtgtgttcatgtgcatgtgt

SEQ ID NO: 217142 - DNA, 23 bp, Mus musculus
tagtccatggtgatctgatagga

SEQ ID NO: 217143 - DNA, 20 bp, Mus musculus
ttgtatctattgaggcctgt

SEQ ID NO: 217144 - DNA, 22 bp, Mus musculus
tgttttgtgaccaattatatgg

SEQ ID NO: 217145 - DNA, 23 bp, Mus musculus
aagagcactgtctgctcttccag

SEQ ID NO: 217146 - DNA, 23 bp, Mus musculus
taacagaagtttgactccagtta

SEQ ID NO: 217147 - DNA, 23 bp, Mus musculus
aacctgataggggatgaagtatc

SEQ ID NO: 217148 - DNA, 18 bp, Mus musculus
aaggacttgtaactcttt

SEQ ID NO: 217149 - DNA, 22 bp, Mus musculus
tcagtctctctctctctgtata

SEQ ID NO: 217150 - DNA, 23 bp, Mus musculus
ctgtcttgagaggtatagttgac

SEQ ID NO: 217151 - DNA, 23 bp, Mus musculus
tggatatcagagtctcagaggaa

SEQ ID NO: 217152 - DNA, 23 bp, Mus musculus
gctgtagatggataactgtgctt

SEQ ID NO: 217153 - DNA, 21 bp, Mus musculus
ttggtgcctggatgttctttt

SEQ ID NO: 217154 - DNA, 22 bp, Mus musculus
tgttttgtgaccaattatatgg

SEQ ID NO: 217155 - DNA, 23 bp, Mus musculus
gtaatcactcaagagactttgct

SEQ ID NO: 217156 - DNA, 21 bp, Mus musculus
tatattctaaatgcataggtg

SEQ ID NO: 217157 - DNA, 23 bp, Mus musculus
gtttgcatgagtgtgtgtgtgtg

SEQ ID NO: 217158 - DNA, 21 bp, Mus musculus
tattgtgatgtttttactatg

SEQ ID NO: 217159 - DNA, 22 bp, Mus musculus
tgttttgtgaccaattatatgg

SEQ ID NO: 217160 - DNA, 22 bp, Mus musculus
tgttttgtgaccaattatatgg

SEQ ID NO: 217161 - DNA, 21 bp, Mus musculus
aaatgtttatttggtttacat

SEQ ID NO: 217162 - DNA, 21 bp, Mus musculus
tttgatgactgattatatggt

SEQ ID NO: 217163 - DNA, 18 bp, Mus musculus
atctgggtggaggtgatg

SEQ ID NO: 217164 - DNA, 22 bp, Mus musculus
tagacaattcattttcttcatg

SEQ ID NO: 217165 - DNA, 23 bp, Mus musculus
tcagagtttgcagtttgcccatc

SEQ ID NO: 217166 - DNA, 21 bp, Mus musculus
aatctcagaagagactgacct

SEQ ID NO: 217167 - DNA, 22 bp, Mus musculus
tgttttgtgaccaattatatgg

SEQ ID NO: 217168 - DNA, 22 bp, Mus musculus
attttctggaagcatatgagag

SEQ ID NO: 217169 - DNA, 23 bp, Mus musculus
tctcagtcagggtttctattcct

SEQ ID NO: 217170 - DNA, 23 bp, Mus musculus
atctcagagttggttagatttgc

SEQ ID NO: 217171 - DNA, 19 bp, Mus musculus
tttctgtttttcttctctt

SEQ ID NO: 217172 - DNA, 21 bp, Mus musculus
tgcatgtatgtatgtatgtat

SEQ ID NO: 217173 - DNA, 23 bp, Mus musculus
caggctcagtgtcagtctctctt

SEQ ID NO: 217174 - DNA, 20 bp, Mus musculus
acaggagtagggcataggat

SEQ ID NO: 217175 - DNA, 23 bp, Mus musculus
ggagaggtagttgtttctccaga

SEQ ID NO: 217176 - DNA, 20 bp, Mus musculus
tttggacatcagttatatcc

SEQ ID NO: 217177 - DNA, 21 bp, Mus musculus
attctcctagttttagttgag

SEQ ID NO: 217178 - DNA, 23 bp, Mus musculus
tgtatgtatgtgtatatatgtta

SEQ ID NO: 217179 - DNA, 22 bp, Mus musculus
agagatggaaaatgtgcagttt

SEQ ID NO: 217180 - DNA, 23 bp, Mus musculus
ctttgtcagatgagagtgaggac

SEQ ID NO: 217181 - DNA, 23 bp, Mus musculus
gcattgtgtctgatgagtgagag

SEQ ID NO: 217182 - DNA, 20 bp, Mus musculus
attgaaaatctgatatgaaa

SEQ ID NO: 217183 - DNA, 23 bp, Mus musculus
tataattcagattttcttcttgt

SEQ ID NO: 217184 - DNA, 22 bp, Mus musculus
ttccagctttcaatttgagtga

SEQ ID NO: 217185 - DNA, 23 bp, Mus musculus
tgttatggtgtggctctcttgtc

SEQ ID NO: 217186 - DNA, 20 bp, Mus musculus
atttccatgattattccttt

SEQ ID NO: 217187 - DNA, 23 bp, Mus musculus
atagttcttgatttggttttcta

SEQ ID NO: 217188 - DNA, 23 bp, Mus musculus
tgaaatgctgaaagaagttgtgg

SEQ ID NO: 217189 - DNA, 23 bp, Mus musculus
acagagactagagagagggctga

SEQ ID NO: 217190 - DNA, 23 bp, Mus musculus
tgcctcagtggctctgtgactcc

SEQ ID NO: 217191 - DNA, 23 bp, Mus musculus
tgactctgactctttcagctgct

SEQ ID NO: 217192 - DNA, 18 bp, Mus musculus
gtatgagctgcaacttgt

SEQ ID NO: 217193 - DNA, 23 bp, Mus musculus
gactgggtctctgagtcttgtgc

SEQ ID NO: 217194 - DNA, 23 bp, Mus musculus
tgattctctgagattatgtaaac

SEQ ID NO: 217195 - DNA, 23 bp, Mus musculus
aaggttatacatgattcactctc

SEQ ID NO: 217196 - DNA, 23 bp, Mus musculus
atgtatgtgtgcaagtgtatgtg

SEQ ID NO: 217197 - DNA, 21 bp, Mus musculus
gctagaagcatcagatcccat

SEQ ID NO: 217198 - DNA, 23 bp, Mus musculus
ctcatgtttctactgtgtgagtg

SEQ ID NO: 217199 - DNA, 23 bp, Mus musculus
tttaccctagtataccatggata

SEQ ID NO: 217200 - DNA, 23 bp, Mus musculus
ttacaagagagtgaatgtagtag

SEQ ID NO: 217201 - DNA, 23 bp, Mus musculus
gaagtgtattgttgatgttggag

SEQ ID NO: 217202 - DNA, 23 bp, Mus musculus
tgaggagagaaatcacagtgctc

SEQ ID NO: 217203 - DNA, 20 bp, Mus musculus
acaaagtatgtatatttgta

SEQ ID NO: 217204 - DNA, 19 bp, Mus musculus
aataatgtcccaaattgat

SEQ ID NO: 217205 - DNA, 21 bp, Mus musculus
aacagtatagacataggttag

SEQ ID NO: 217206 - DNA, 22 bp, Mus musculus
gtcaacagctttccctggagtt

SEQ ID NO: 217207 - DNA, 23 bp, Mus musculus
gaccagtccttttgtgtgtgtat

SEQ ID NO: 217208 - DNA, 18 bp, Mus musculus
aggacacgagatgcatgt

SEQ ID NO: 217209 - DNA, 22 bp, Mus musculus
tgttttgtgaccaattatatgg

SEQ ID NO: 217210 - DNA, 22 bp, Mus musculus
tgttttgtgaccaattatatgg

SEQ ID NO: 217211 - DNA, 21 bp, Mus musculus
tgcatatatatatgtatgtgt

SEQ ID NO: 217212 - DNA, 23 bp, Mus musculus
tataggtacatatacatatgtgt

SEQ ID NO: 217213 - DNA, 23 bp, Mus musculus
ggccaaaacatatcatgtatcag

SEQ ID NO: 217214 - DNA, 23 bp, Mus musculus
cccacttactctctctcaaactc

SEQ ID NO: 217215 - DNA, 23 bp, Mus musculus
tctgtctgtctctctctccatcc

SEQ ID NO: 217216 - DNA, 20 bp, Mus musculus
atagatacagatatagatat

SEQ ID NO: 217217 - DNA, 23 bp, Mus musculus
cagaatgtggtattgtgttgtta

SEQ ID NO: 217218 - DNA, 20 bp, Mus musculus
tctctcttcctctcagtgtc

SEQ ID NO: 217219 - DNA, 18 bp, Mus musculus
tactggcttctgtctgag

SEQ ID NO: 217220 - DNA, 21 bp, Mus musculus
tcagttctctgccagcagatc

SEQ ID NO: 217221 - DNA, 22 bp, Mus musculus
tcctggtccagagtctctctgg

SEQ ID NO: 217222 - DNA, 23 bp, Mus musculus
tgtctctgtgtgactgagccttt

SEQ ID NO: 217223 - DNA, 23 bp, Mus musculus
tgtgtcactatgtctgtgggctt

SEQ ID NO: 217224 - DNA, 18 bp, Mus musculus
agctcttcaagctgcact

SEQ ID NO: 217225 - DNA, 19 bp, Mus musculus
gaagagagactctgtctca

SEQ ID NO: 217226 - DNA, 22 bp, Mus musculus
ctaagagtctgaacacagcagg

SEQ ID NO: 217227 - DNA, 23 bp, Mus musculus
tgtgcgtgcgtgcgtgcgtgcgt

SEQ ID NO: 217228 - DNA, 23 bp, Mus musculus
tctctgccactgagacatatctc

SEQ ID NO: 217229 - DNA, 22 bp, Mus musculus
cagattctccatctccatgtct

SEQ ID NO: 217230 - DNA, 23 bp, Mus musculus
ttctcagtgctaggttaaaggct

SEQ ID NO: 217231 - DNA, 23 bp, Mus musculus
tgcctgcctgcctgcctgcctgc

SEQ ID NO: 217232 - DNA, 23 bp, Mus musculus
atgtatgtatgtatgtatgtatg

SEQ ID NO: 217233 - DNA, 23 bp, Mus musculus
atgtctgtactgcatgtatgcag

SEQ ID NO: 217234 - DNA, 23 bp, Mus musculus
gagctgcagaactatagcagatg

SEQ ID NO: 217235 - DNA, 23 bp, Mus musculus
tgatgtcatttactagttgtctt

SEQ ID NO: 217236 - DNA, 20 bp, Mus musculus
tgaaacaccatgacctaaag

SEQ ID NO: 217237 - DNA, 21 bp, Mus musculus
tatatgcatatatatatgtgt

SEQ ID NO: 217238 - DNA, 23 bp, Mus musculus
cacagagggaggctttaatgtgt

SEQ ID NO: 217239 - DNA, 23 bp, Mus musculus
attgaatctggaactcattggtt

SEQ ID NO: 217240 - DNA, 21 bp, Mus musculus
ctacaatgtctgactttttga

SEQ ID NO: 217241 - DNA, 20 bp, Mus musculus
ttcttcctgatgttttccta

SEQ ID NO: 217242 - DNA, 23 bp, Mus musculus
tgggacactctgtaactctaatc

SEQ ID NO: 217243 - DNA, 23 bp, Mus musculus
tgtgtctgacaggcagacttctg

SEQ ID NO: 217244 - DNA, 23 bp, Mus musculus
actgtctccaagacatactgcca

SEQ ID NO: 217245 - DNA, 22 bp, Mus musculus
ttgctgagtggctttatagtgt

SEQ ID NO: 217246 - DNA, 20 bp, Mus musculus
actgactgtcactttctgct

SEQ ID NO: 217247 - DNA, 22 bp, Mus musculus
agtgagcgaacagagtgagtag

SEQ ID NO: 217248 - DNA, 23 bp, Mus musculus
tgtgtgtctgtttgtatgtctct

SEQ ID NO: 217249 - DNA, 21 bp, Mus musculus
actatgtatgtatatatgtgt

SEQ ID NO: 217250 - DNA, 23 bp, Mus musculus
atgtgtgtatatgtgtatgtgtg

SEQ ID NO: 217251 - DNA, 23 bp, Mus musculus
gaggctcactctcactctgagtc

SEQ ID NO: 217252 - DNA, 22 bp, Mus musculus
gagctagaagacagacagcaga

SEQ ID NO: 217253 - DNA, 21 bp, Mus musculus
tgttcaggggctggagagatg

SEQ ID NO: 217254 - DNA, 23 bp, Mus musculus
gtctgcctgtgtgcctgtctgtg

SEQ ID NO: 217255 - DNA, 23 bp, Mus musculus
ctctcactgtgtacctctgtctg

SEQ ID NO: 217256 - DNA, 23 bp, Mus musculus
agagctctctcccactccctgtc

SEQ ID NO: 217257 - DNA, 23 bp, Mus musculus
atgtatgtatacatgcaggtgtg

SEQ ID NO: 217258 - DNA, 20 bp, Mus musculus
aggctccagccttcatgccc

SEQ ID NO: 217259 - DNA, 23 bp, Mus musculus
cacatcagagtgatcagagagat

SEQ ID NO: 217260 - DNA, 22 bp, Mus musculus
tatttctcacttactattcagt

SEQ ID NO: 217261 - DNA, 22 bp, Mus musculus
atgagagttcagactcaggtca

SEQ ID NO: 217262 - DNA, 22 bp, Mus musculus
ttcaagaggatgtggtaccttc

SEQ ID NO: 217263 - DNA, 23 bp, Mus musculus
tacagcaactgtgattttgtaga

SEQ ID NO: 217264 - DNA, 21 bp, Mus musculus
aaatcgctgtaatgggatgct

SEQ ID NO: 217265 - DNA, 23 bp, Mus musculus
actctaactctctgactatgagg

SEQ ID NO: 217266 - DNA, 23 bp, Mus musculus
tatagcagtctctggtttttgca

SEQ ID NO: 217267 - DNA, 21 bp, Mus musculus
taagtggttgttttttctgat

SEQ ID NO: 217268 - DNA, 23 bp, Mus musculus
ctgcctctgtctctgcctcccaa

SEQ ID NO: 217269 - DNA, 19 bp, Mus musculus
attgtagacatgagacgtg

SEQ ID NO: 217270 - DNA, 21 bp, Mus musculus
tgagaacttggttttggggtg

SEQ ID NO: 217271 - DNA, 23 bp, Mus musculus
tgagactgggtctctcactgaat

SEQ ID NO: 217272 - DNA, 18 bp, Mus musculus
gtgtgtgtgtgtgtgtgt

SEQ ID NO: 217273 - DNA, 22 bp, Mus musculus
tgttttgtgaccaattatatgg

SEQ ID NO: 217274 - DNA, 22 bp, Mus musculus
tgttttgtgaccaattatatgg

SEQ ID NO: 217275 - DNA, 23 bp, Mus musculus
gaacagtagtaattttgttcatg

SEQ ID NO: 217276 - DNA, 19 bp, Mus musculus
aagcagattagcctgctgc

SEQ ID NO: 217277 - DNA, 18 bp, Mus musculus
agaaatgacagtgttcct

SEQ ID NO: 217278 - DNA, 23 bp, Mus musculus
cagtacactgttgactgtcagca

SEQ ID NO: 217279 - DNA, 21 bp, Mus musculus
ctcagtggctaagagcactgg

SEQ ID NO: 217280 - DNA, 23 bp, Mus musculus
tctgtggctcagtctcatctgtg

SEQ ID NO: 217281 - DNA, 19 bp, Mus musculus
gcactgggtagtcggactg

SEQ ID NO: 217282 - DNA, 23 bp, Mus musculus
atatatgaacaggtatatgtaat

SEQ ID NO: 217283 - DNA, 22 bp, Mus musculus
tgttttgtgaccaattatatgg

SEQ ID NO: 217284 - DNA, 23 bp, Mus musculus
tgagagcatctacttttgtattt

SEQ ID NO: 217285 - DNA, 22 bp, Mus musculus
taggagtgtaatgatattgcac

SEQ ID NO: 217286 - DNA, 21 bp, Mus musculus
atggatgaactgggcatgcga

SEQ ID NO: 217287 - DNA, 22 bp, Mus musculus
taggatgttgcttccattctga

SEQ ID NO: 217288 - DNA, 23 bp, Mus musculus
acacaggctgtgcctctctcacc

SEQ ID NO: 217289 - DNA, 19 bp, Mus musculus
atacacacacatatatatg

SEQ ID NO: 217290 - DNA, 20 bp, Mus musculus
gagagcagcacatgagttct

SEQ ID NO: 217291 - DNA, 19 bp, Mus musculus
cacacatttatttatgttt

SEQ ID NO: 217292 - DNA, 18 bp, Mus musculus
tgcccgtgcactcatgct

SEQ ID NO: 217293 - DNA, 23 bp, Mus musculus
tggcagaagacattctggtcagg

SEQ ID NO: 217294 - DNA, 23 bp, Mus musculus
tctctgtctgcctgtcagttttg

SEQ ID NO: 217295 - DNA, 23 bp, Mus musculus
gactgcacttgaaggggagctct

SEQ ID NO: 217296 - DNA, 23 bp, Mus musculus
cgctctacttgtctgtctgtctg

SEQ ID NO: 217297 - DNA, 20 bp, Mus musculus
agtgcagcttgatagttctg

SEQ ID NO: 217298 - DNA, 23 bp, Mus musculus
gacagatgatagtgagctgtgtt

SEQ ID NO: 217299 - DNA, 23 bp, Mus musculus
tgtgtgtatgtatgtatgtatgt

SEQ ID NO: 217300 - DNA, 18 bp, Mus musculus
tatatgtgtgttatacat

SEQ ID NO: 217301 - DNA, 22 bp, Mus musculus
tactcaatgctttgtcagtgcg

SEQ ID NO: 217302 - DNA, 22 bp, Mus musculus
tctctgtatctctatctctaca

SEQ ID NO: 217303 - DNA, 23 bp, Mus musculus
agtgaagagagtgtgctgtaact

SEQ ID NO: 217304 - DNA, 23 bp, Mus musculus
ctgcctcagtctctgtaagttta

SEQ ID NO: 217305 - DNA, 18 bp, Mus musculus
atgtggtatgtattcatg

SEQ ID NO: 217306 - DNA, 22 bp, Mus musculus
agaaagcaagttcaaccagaat

SEQ ID NO: 217307 - DNA, 22 bp, Mus musculus
taaatgtgtatgtatatatgtg

SEQ ID NO: 217308 - DNA, 23 bp, Mus musculus
atatttcattagttttcagggtc

SEQ ID NO: 217309 - DNA, 23 bp, Mus musculus
gtagctgtatatatgtatgcatg

SEQ ID NO: 217310 - DNA, 23 bp, Mus musculus
tgtatgcatgcatgtatgtggca

SEQ ID NO: 217311 - DNA, 23 bp, Mus musculus
gaaatgagtgcattgatgacagc

SEQ ID NO: 217312 - DNA, 23 bp, Mus musculus
tgtgtgtgagtgtgtgtgcatgt

SEQ ID NO: 217313 - DNA, 23 bp, Mus musculus
gactatatatatgtatgtatatg

SEQ ID NO: 217314 - DNA, 23 bp, Mus musculus
ttcattacatttggataggagaa

SEQ ID NO: 217315 - DNA, 23 bp, Mus musculus
tctgtctcactgtgtaatgacta

SEQ ID NO: 217316 - DNA, 19 bp, Mus musculus
attacatgattaggcatgg

SEQ ID NO: 217317 - DNA, 23 bp, Mus musculus
taagctccatgaagaaaggacca

SEQ ID NO: 217318 - DNA, 23 bp, Mus musculus
ttcatatctctccgtgcttgtta

SEQ ID NO: 217319 - DNA, 21 bp, Mus musculus
tgtggtcctccattccaactt

SEQ ID NO: 217320 - DNA, 23 bp, Mus musculus
tttgtgtccaattatatagtcaa

SEQ ID NO: 217321 - DNA, 23 bp, Mus musculus
tatacaggttgatatacatccct

SEQ ID NO: 217322 - DNA, 19 bp, Mus musculus
tttatggtatagtccaggc

SEQ ID NO: 217323 - DNA, 23 bp, Mus musculus
ctcagcttcttggttctatacaa

SEQ ID NO: 217324 - DNA, 23 bp, Mus musculus
tgtgtgtatgcagtatgtgcagt

SEQ ID NO: 217325 - DNA, 23 bp, Mus musculus
tgcctgtacattgtgagcactca

SEQ ID NO: 217326 - DNA, 22 bp, Mus musculus
acacccttggtgaactaggcaa

SEQ ID NO: 217327 - DNA, 19 bp, Mus musculus
tgtgtgtatgtatatgtat

SEQ ID NO: 217328 - DNA, 23 bp, Mus musculus
tgtgtgtgtgtgtgtctcctgca

SEQ ID NO: 217329 - DNA, 19 bp, Mus musculus
gcagatgcagctctggttg

SEQ ID NO: 217330 - DNA, 23 bp, Mus musculus
cctttgtgaatgctttcctttag

SEQ ID NO: 217331 - DNA, 22 bp, Mus musculus
aaagacctcgtgaaacagcagt

SEQ ID NO: 217332 - DNA, 20 bp, Mus musculus
agacagacaggataaggtga

SEQ ID NO: 217333 - DNA, 21 bp, Mus musculus
taagccttatgtaagcattgt

SEQ ID NO: 217334 - DNA, 20 bp, Mus musculus
tgaggggtattttgatgtca

SEQ ID NO: 217335 - DNA, 23 bp, Mus musculus
agcttctgaagtgtgggtgcaca

SEQ ID NO: 217336 - DNA, 20 bp, Mus musculus
ttagggggtgcagccattca

SEQ ID NO: 217337 - DNA, 23 bp, Mus musculus
tctgtctgtctgcctgcctgcct

SEQ ID NO: 217338 - DNA, 23 bp, Mus musculus
tctgtgactgcctccctgtatgt

SEQ ID NO: 217339 - DNA, 23 bp, Mus musculus
actagtctacagagagctgcaga

SEQ ID NO: 217340 - DNA, 22 bp, Mus musculus
gtgagaacacacacagggcaat

SEQ ID NO: 217341 - DNA, 23 bp, Mus musculus
tctctctctgactctctccttat

SEQ ID NO: 217342 - DNA, 21 bp, Mus musculus
aatgtgtatgtatgcacatgc

SEQ ID NO: 217343 - DNA, 23 bp, Mus musculus
atatgtgtgtgtgtgtgtcctca

SEQ ID NO: 217344 - DNA, 23 bp, Mus musculus
tacatgtatatatgtatatgtta

SEQ ID NO: 217345 - DNA, 20 bp, Mus musculus
atataaactcatatacttgt

SEQ ID NO: 217346 - DNA, 23 bp, Mus musculus
atatgtgcatatacaagtatatg

SEQ ID NO: 217347 - DNA, 23 bp, Mus musculus
tcattgtcagtgggtaagctgtg

SEQ ID NO: 217348 - DNA, 18 bp, Mus musculus
gttcaaggttacttagtt

SEQ ID NO: 217349 - DNA, 19 bp, Mus musculus
tgtgacaagacagtgagcc

SEQ ID NO: 217350 - DNA, 23 bp, Mus musculus
aaactcacaagctttcactgagg

SEQ ID NO: 217351 - DNA, 23 bp, Mus musculus
tactgtagtgtgatgattggtat

SEQ ID NO: 217352 - DNA, 23 bp, Mus musculus
agtggcactattcgaagctgtgg

SEQ ID NO: 217353 - DNA, 23 bp, Mus musculus
gacactcaaacttcagtccttct

SEQ ID NO: 217354 - DNA, 22 bp, Mus musculus
tgttagagctttattcatgtat

SEQ ID NO: 217355 - DNA, 20 bp, Mus musculus
tgtgtgcatgtatgtgtata

SEQ ID NO: 217356 - DNA, 20 bp, Mus musculus
atgtatgtatgcatgtatat

SEQ ID NO: 217357 - DNA, 23 bp, Mus musculus
tgtatgtatgtatgtatgtatgt

SEQ ID NO: 217358 - DNA, 23 bp, Mus musculus
tctctctgtctgtctctgttgac

SEQ ID NO: 217359 - DNA, 22 bp, Mus musculus
actgaatagtatcccattgtgt

SEQ ID NO: 217360 - DNA, 21 bp, Mus musculus
tgtactggctggttttgtgtg

SEQ ID NO: 217361 - DNA, 22 bp, Mus musculus
tgttgtctggcttgagtctgtg

SEQ ID NO: 217362 - DNA, 23 bp, Mus musculus
agcaacagcatatccagcagaat

SEQ ID NO: 217363 - DNA, 23 bp, Mus musculus
gactgtctccctctttggcagtg

SEQ ID NO: 217364 - DNA, 21 bp, Mus musculus
ttccagagtggttgtacaagc

SEQ ID NO: 217365 - DNA, 23 bp, Mus musculus
gattcagagtctctctgtgcctg

SEQ ID NO: 217366 - DNA, 20 bp, Mus musculus
aagacaggatcttcaacatc

SEQ ID NO: 217367 - DNA, 23 bp, Mus musculus
atcttgctattaatttgcctaag

SEQ ID NO: 217368 - DNA, 21 bp, Mus musculus
ataggcaagataatctattct

SEQ ID NO: 217369 - DNA, 22 bp, Mus musculus
tgttttgtgaccaattatatgg

SEQ ID NO: 217370 - DNA, 22 bp, Mus musculus
tgttttgtgaccaattatatgg

SEQ ID NO: 217371 - DNA, 23 bp, Mus musculus
ctctgacacacccagactctcag

SEQ ID NO: 217372 - DNA, 22 bp, Mus musculus
tatgtgtatggtatgcatgtgt

SEQ ID NO: 217373 - DNA, 23 bp, Mus musculus
atatgtatgtgctgtgtatgtgt

SEQ ID NO: 217374 - DNA, 23 bp, Mus musculus
tatgtgtatgtatgcatgtgtgt

SEQ ID NO: 217375 - DNA, 22 bp, Mus musculus
gtatgcatgtatgtatatatgt

SEQ ID NO: 217376 - DNA, 21 bp, Mus musculus
tgtctctgtgtgactgggctt

SEQ ID NO: 217377 - DNA, 22 bp, Mus musculus
aaactgcacccaatgtgtgtgt

SEQ ID NO: 217378 - DNA, 22 bp, Mus musculus
ataaagcaactgtaccttaaat

SEQ ID NO: 217379 - DNA, 23 bp, Mus musculus
atataccatgtatatcatatgtt

SEQ ID NO: 217380 - DNA, 23 bp, Mus musculus
atgtagtttctttggtattgtga

SEQ ID NO: 217381 - DNA, 19 bp, Mus musculus
ttcagttgagagaactctg

SEQ ID NO: 217382 - DNA, 18 bp, Mus musculus
gtatgtatgtatgtatgt

SEQ ID NO: 217383 - DNA, 19 bp, Mus musculus
agcatgttatgacatgaga

SEQ ID NO: 217384 - DNA, 23 bp, Mus musculus
acacacacacacatatgtgtgtg

SEQ ID NO: 217385 - DNA, 23 bp, Mus musculus
acatatgtgtgtatgtatatgta

SEQ ID NO: 217386 - DNA, 20 bp, Mus musculus
atgtacatatatatacttga

SEQ ID NO: 217387 - DNA, 23 bp, Mus musculus
tagtccatgatgatctgatagga

SEQ ID NO: 217388 - DNA, 21 bp, Mus musculus
tgttttgtgaccaattatgtg

SEQ ID NO: 217389 - DNA, 18 bp, Mus musculus
acagcaattatatatatg

SEQ ID NO: 217390 - DNA, 22 bp, Mus musculus
tgttttgtgaccaattatatgg

SEQ ID NO: 217391 - DNA, 23 bp, Mus musculus
aagctgcacagattgctttttga

SEQ ID NO: 217392 - DNA, 23 bp, Mus musculus
caaaagcaatcactgctagctct

SEQ ID NO: 217393 - DNA, 21 bp, Mus musculus
taagtgtatgtatatgtatgt

SEQ ID NO: 217394 - DNA, 23 bp, Mus musculus
tgtctgtctctgtcagtcttctt

SEQ ID NO: 217395 - DNA, 23 bp, Mus musculus
tatgtgaaaattatagatgtgtg

SEQ ID NO: 217396 - DNA, 21 bp, Mus musculus
aaagagagcttatgttctttt

SEQ ID NO: 217397 - DNA, 21 bp, Mus musculus
tgtgtatgtgtatatgtgtgt

SEQ ID NO: 217398 - DNA, 22 bp, Mus musculus
tataatgtatatgtatatgatg

SEQ ID NO: 217399 - DNA, 20 bp, Mus musculus
agtggtactgagttctgtaa

SEQ ID NO: 217400 - DNA, 23 bp, Mus musculus
tgtaaccctgggtaaatcatctc

SEQ ID NO: 217401 - DNA, 18 bp, Mus musculus
atgtgtgtatgtgttgta

SEQ ID NO: 217402 - DNA, 19 bp, Mus musculus
tgtgtatatatgtgtgtgt

SEQ ID NO: 217403 - DNA, 23 bp, Mus musculus
atatcatcagacataggcatagc

SEQ ID NO: 217404 - DNA, 22 bp, Mus musculus
aacagagtgcaagaatacacag

SEQ ID NO: 217405 - DNA, 22 bp, Mus musculus
tgttttgtgaccaattatatgg

SEQ ID NO: 217406 - DNA, 22 bp, Mus musculus
tgttttgtgaccaattatatgg

SEQ ID NO: 217407 - DNA, 18 bp, Mus musculus
attgaagtatacaatgga

SEQ ID NO: 217408 - DNA, 22 bp, Mus musculus
atatgaggtagaatatttatat

SEQ ID NO: 217409 - DNA, 20 bp, Mus musculus
gttacaagtagatactgctg

SEQ ID NO: 217410 - DNA, 23 bp, Mus musculus
ccgagaatcaagaagatgaggac

SEQ ID NO: 217411 - DNA, 23 bp, Mus musculus
tggttttgaattgtaaagaagaa

SEQ ID NO: 217412 - DNA, 23 bp, Mus musculus
tagtgcatggtgatctgatagga

SEQ ID NO: 217413 - DNA, 21 bp, Mus musculus
tgagacctgttttgtgaccta

SEQ ID NO: 217414 - DNA, 23 bp, Mus musculus
tgttttgtgaccaattgtatggt

SEQ ID NO: 217415 - DNA, 22 bp, Mus musculus
ggatcagagagaataaagtagg

SEQ ID NO: 217416 - DNA, 23 bp, Mus musculus
ctctctgtctctgggagagtttt

SEQ ID NO: 217417 - DNA, 23 bp, Mus musculus
ttgctactgcatgtacttatgtg

SEQ ID NO: 217418 - DNA, 23 bp, Mus musculus
tgcatgtatgtaagtatgcatat

SEQ ID NO: 217419 - DNA, 23 bp, Mus musculus
gtatgtgtgtgtatgtatatatg

SEQ ID NO: 217420 - DNA, 23 bp, Mus musculus
tgtgtatacatgtatatatgtat

SEQ ID NO: 217421 - DNA, 23 bp, Mus musculus
tatgtatgtgtatatgtatatgt

SEQ ID NO: 217422 - DNA, 22 bp, Mus musculus
tgtatagattatatgtatgtat

SEQ ID NO: 217423 - DNA, 23 bp, Mus musculus
tatgtgtatatatatatatgtac

SEQ ID NO: 217424 - DNA, 23 bp, Mus musculus
cccactggttgtataaacctgtt

SEQ ID NO: 217425 - DNA, 20 bp, Mus musculus
ttttgagcagaaactgctga

SEQ ID NO: 217426 - DNA, 18 bp, Mus musculus
gtcattcagcagtaggct

SEQ ID NO: 217427 - DNA, 22 bp, Mus musculus
tgttttgtgaccaattatatgg

SEQ ID NO: 217428 - DNA, 18 bp, Mus musculus
gtgtgtgtgtgtgtgcct

SEQ ID NO: 217429 - DNA, 23 bp, Mus musculus
taatagtgtctggtttagtgcct

SEQ ID NO: 217430 - DNA, 23 bp, Mus musculus
tctgtggatgaaaatctagtctt

SEQ ID NO: 217431 - DNA, 23 bp, Mus musculus
taatagtgtctggtttagtgcct

SEQ ID NO: 217432 - DNA, 23 bp, Mus musculus
tctgtggatgaaaatctagtctt

SEQ ID NO: 217433 - DNA, 22 bp, Mus musculus
tgtgtatatatgtatatatgtt

SEQ ID NO: 217434 - DNA, 23 bp, Mus musculus
gtgggtgggtgcctctttgctag

SEQ ID NO: 217435 - DNA, 23 bp, Mus musculus
ttcactgtccttattctctcaca

SEQ ID NO: 217436 - DNA, 23 bp, Mus musculus
caagtgatttagagaaaaagttc

SEQ ID NO: 217437 - DNA, 18 bp, Mus musculus
attcagatgtgtaagagt

SEQ ID NO: 217438 - DNA, 23 bp, Mus musculus
tatacttgctattgtttacatat

SEQ ID NO: 217439 - DNA, 20 bp, Mus musculus
tatttgtgagtgtgtgtgtg

SEQ ID NO: 217440 - DNA, 20 bp, Mus musculus
tgtgactgtgttgttgtgaa

SEQ ID NO: 217441 - DNA, 23 bp, Mus musculus
tatatctatatctatatgtgtgt

SEQ ID NO: 217442 - DNA, 22 bp, Mus musculus
tgttttgtgaccaattatatgg

SEQ ID NO: 217443 - DNA, 23 bp, Mus musculus
ttgtagaagtttctgaaaggtga

SEQ ID NO: 217444 - DNA, 23 bp, Mus musculus
tagtgcatggtgatctgatagga

SEQ ID NO: 217445 - DNA, 23 bp, Mus musculus
tagtgtgtgtgtgttcatgttca

SEQ ID NO: 217446 - DNA, 23 bp, Mus musculus
ctgtgtctctgtttagtttctgt

SEQ ID NO: 217447 - DNA, 23 bp, Mus musculus
ctgtcctttgatgagagtgaggt

SEQ ID NO: 217448 - DNA, 21 bp, Mus musculus
aggacatgaaacagcagtagt

SEQ ID NO: 217449 - DNA, 19 bp, Mus musculus
tactgtgtaaatgtcatgt

SEQ ID NO: 217450 - DNA, 22 bp, Mus musculus
aaaaagaggtattatttctgtt

SEQ ID NO: 217451 - DNA, 23 bp, Mus musculus
cctctcagagaatagccattcaa

SEQ ID NO: 217452 - DNA, 23 bp, Mus musculus
tgagttctgctatatatgttgtg

SEQ ID NO: 217453 - DNA, 23 bp, Mus musculus
tgtctgtctgtctgtctgtctat

SEQ ID NO: 217454 - DNA, 23 bp, Mus musculus
cttgagaaatctgacaaagttga

SEQ ID NO: 217455 - DNA, 20 bp, Mus musculus
ttctgcacttcctgctcact

SEQ ID NO: 217456 - DNA, 23 bp, Mus musculus
atgtatatatacatatgtgtgtg

SEQ ID NO: 217457 - DNA, 20 bp, Mus musculus
tgtatgagtggtttaggaag

SEQ ID NO: 217458 - DNA, 21 bp, Mus musculus
attagggtgatattgttcccc

SEQ ID NO: 217459 - DNA, 23 bp, Mus musculus
agagagaacagtgtgaactgttt

SEQ ID NO: 217460 - DNA, 22 bp, Mus musculus
tgttttgtgaccaattatatgg

SEQ ID NO: 217461 - DNA, 20 bp, Mus musculus
atatgtatatatgtacatat

SEQ ID NO: 217462 - DNA, 22 bp, Mus musculus
tgagtggaatgatgtgtgtgag

SEQ ID NO: 217463 - DNA, 23 bp, Mus musculus
tgaagtcagtgagcactgtctac

SEQ ID NO: 217464 - DNA, 23 bp, Mus musculus
tctaaaggagctattagaatagt

SEQ ID NO: 217465 - DNA, 23 bp, Mus musculus
tttgtcttttctatggaagctct

SEQ ID NO: 217466 - DNA, 21 bp, Mus musculus
ataatgtctgctatgggtctc

SEQ ID NO: 217467 - DNA, 22 bp, Mus musculus
tctggcgctgtgagaaatgtct

SEQ ID NO: 217468 - DNA, 18 bp, Mus musculus
atacacacacacatacat

SEQ ID NO: 217469 - DNA, 20 bp, Mus musculus
tggtatgtatacatgtgtgt

SEQ ID NO: 217470 - DNA, 23 bp, Mus musculus
aaatgtatgtgcatgtatacagc

SEQ ID NO: 217471 - DNA, 18 bp, Mus musculus
acccagtggggctggaga

SEQ ID NO: 217472 - DNA, 23 bp, Mus musculus
aagagcactgactgctcttctag

SEQ ID NO: 217473 - DNA, 23 bp, Mus musculus
tttctctgtgtatctctggctgt

SEQ ID NO: 217474 - DNA, 23 bp, Mus musculus
ccctgtgtctgtctgtcttctgt

SEQ ID NO: 217475 - DNA, 23 bp, Mus musculus
atgtgtatgtgcatgtgcatgtg

SEQ ID NO: 217476 - DNA, 23 bp, Mus musculus
tgtatgtgtgtgtgcatgtgctt

SEQ ID NO: 217477 - DNA, 23 bp, Mus musculus
agggtgcttaagatttgttagtg

SEQ ID NO: 217478 - DNA, 23 bp, Mus musculus
tgttatgcttgcttatcttggct

SEQ ID NO: 217479 - DNA, 23 bp, Mus musculus
accactcagaggattgtgttttg

SEQ ID NO: 217480 - DNA, 23 bp, Mus musculus
ttattttagatctcctagcgctc

SEQ ID NO: 217481 - DNA, 21 bp, Mus musculus
agcaatctacttcatttggtg

SEQ ID NO: 217482 - DNA, 20 bp, Mus musculus
ttttttctttaagaaagtga

SEQ ID NO: 217483 - DNA, 23 bp, Mus musculus
tgtatgtatatatgatataaatg

SEQ ID NO: 217484 - DNA, 23 bp, Mus musculus
cagagtcaagagacacaagccaa

SEQ ID NO: 217485 - DNA, 23 bp, Mus musculus
gtgtctgtctcagtgtctgcctc

SEQ ID NO: 217486 - DNA, 19 bp, Mus musculus
aaagcactgactgctcttc

SEQ ID NO: 217487 - DNA, 23 bp, Mus musculus
tctgcttctgtctgtctgtctgc

SEQ ID NO: 217488 - DNA, 23 bp, Mus musculus
cctgcctgcctgcctgcttgcct

SEQ ID NO: 217489 - DNA, 23 bp, Mus musculus
acaagagagagataaagtgacac

SEQ ID NO: 217490 - DNA, 23 bp, Mus musculus
gtatgtcgctgtctgtctgtctg

SEQ ID NO: 217491 - DNA, 23 bp, Mus musculus
gtgtgtgtgtctgtcactgtccc

SEQ ID NO: 217492 - DNA, 23 bp, Mus musculus
gagtctgtgactctgacttgttt

SEQ ID NO: 217493 - DNA, 23 bp, Mus musculus
gtatgcatgcatgtatgtatgta

SEQ ID NO: 217494 - DNA, 19 bp, Mus musculus
acacagagaaaccctgtct

SEQ ID NO: 217495 - DNA, 23 bp, Mus musculus
gtctctctctgtctgtgtatctg

SEQ ID NO: 217496 - DNA, 22 bp, Mus musculus
tgttttgtgaccaattatatgg

SEQ ID NO: 217497 - DNA, 21 bp, Mus musculus
ttcagtgggaagtcagtagga

SEQ ID NO: 217498 - DNA, 23 bp, Mus musculus
agggtcactgtttctcattgagg

SEQ ID NO: 217499 - DNA, 22 bp, Mus musculus
tctgtctttctcatttgcctaa

SEQ ID NO: 217500 - DNA, 18 bp, Mus musculus
atgttgcttaatttttga

SEQ ID NO: 217501 - DNA, 22 bp, Mus musculus
aagctaattctggaagtagttg

SEQ ID NO: 217502 - DNA, 22 bp, Mus musculus
tgtgtctctgtgtatctctgtg

SEQ ID NO: 217503 - DNA, 20 bp, Mus musculus
atatatgtacatatacatgt

SEQ ID NO: 217504 - DNA, 23 bp, Mus musculus
acatgtggctgtagagatggctc

SEQ ID NO: 217505 - DNA, 21 bp, Mus musculus
tgtgtgtatatatatgtgtgt

SEQ ID NO: 217506 - DNA, 22 bp, Mus musculus
atatatgtgtgtatatatatgt

SEQ ID NO: 217507 - DNA, 23 bp, Mus musculus
ctctctctctctatatctgtgtg

SEQ ID NO: 217508 - DNA, 18 bp, Mus musculus
tatgtatacatgtgtgtg

SEQ ID NO: 217509 - DNA, 18 bp, Mus musculus
agtaagaaacaacttggg

SEQ ID NO: 217510 - DNA, 23 bp, Mus musculus
ttctgatactccttcagtgactc

SEQ ID NO: 217511 - DNA, 23 bp, Mus musculus
tatggcactggtataattgagtc

SEQ ID NO: 217512 - DNA, 23 bp, Mus musculus
tctgtctgtctgtctgtctgtct

SEQ ID NO: 217513 - DNA, 23 bp, Mus musculus
gtgtgtgagtgttcatgagtgtg

SEQ ID NO: 217514 - DNA, 23 bp, Mus musculus
tggagtagtaggttgtaatcttg

SEQ ID NO: 217515 - DNA, 23 bp, Mus musculus
cagacttcagggtgtgtaatctt

SEQ ID NO: 217516 - DNA, 22 bp, Mus musculus
ccactctgaagaaagacagctc

SEQ ID NO: 217517 - DNA, 21 bp, Mus musculus
aagagttttgttgtagattat

SEQ ID NO: 217518 - DNA, 22 bp, Mus musculus
tctgagagttgagtgtgaggcc

SEQ ID NO: 217519 - DNA, 23 bp, Mus musculus
ctcagaggtctggatgcagactc

SEQ ID NO: 217520 - DNA, 18 bp, Mus musculus
acagtagtcacagggcac

SEQ ID NO: 217521 - DNA, 23 bp, Mus musculus
aagatggttaattgttctgaaag

SEQ ID NO: 217522 - DNA, 21 bp, Mus musculus
taagacagttacccatttctg

SEQ ID NO: 217523 - DNA, 23 bp, Mus musculus
tgtctgtctgtctgtttctggtg

SEQ ID NO: 217524 - DNA, 23 bp, Mus musculus
atctctctggctgtacatagtga

SEQ ID NO: 217525 - DNA, 23 bp, Mus musculus
atcttctgtgcctcaggaagagg

SEQ ID NO: 217526 - DNA, 23 bp, Mus musculus
tgatttcttttcttgatgtcagt

SEQ ID NO: 217527 - DNA, 23 bp, Mus musculus
agtgtgactctgactgttcagtg

SEQ ID NO: 217528 - DNA, 23 bp, Mus musculus
tggctgtgtggctgtgtggctgt

SEQ ID NO: 217529 - DNA, 23 bp, Mus musculus
gtcagtgtgtgtctctctctcag

SEQ ID NO: 217530 - DNA, 23 bp, Mus musculus
tgtctgcctgcgtgcctgcctgt

SEQ ID NO: 217531 - DNA, 21 bp, Mus musculus
tcatgttgattctgtctgtca

SEQ ID NO: 217532 - DNA, 22 bp, Mus musculus
agacagggacgaaaaagggtct

SEQ ID NO: 217533 - DNA, 22 bp, Mus musculus
tgtgcttttgttttaatttctt

SEQ ID NO: 217534 - DNA, 22 bp, Mus musculus
tgttttgtgaccaattatatgg

SEQ ID NO: 217535 - DNA, 23 bp, Mus musculus
ttctaaatcaggttactctgggc

SEQ ID NO: 217536 - DNA, 23 bp, Mus musculus
gactctgtgcctctgtctctcct

SEQ ID NO: 217537 - DNA, 23 bp, Mus musculus
tggttacagaggctagaagaggg

SEQ ID NO: 217538 - DNA, 22 bp, Mus musculus
tgttttgtgaccaattatatgg

SEQ ID NO: 217539 - DNA, 22 bp, Mus musculus
tgttttgtgaccaattatatgg

SEQ ID NO: 217540 - DNA, 23 bp, Mus musculus
tgcctctgactgcctctgcttct

SEQ ID NO: 217541 - DNA, 21 bp, Mus musculus
tatgtgtatatgtatgtatgt

SEQ ID NO: 217542 - DNA, 23 bp, Mus musculus
tatagtatatatgtatatatgta

SEQ ID NO: 217543 - DNA, 21 bp, Mus musculus
tcatgaacaaggttgtttagt

SEQ ID NO: 217544 - DNA, 21 bp, Mus musculus
tctcttcttctgtaactgttg

SEQ ID NO: 217545 - DNA, 23 bp, Mus musculus
atatgtatgtgtgtgtgtatgtg

SEQ ID NO: 217546 - DNA, 23 bp, Mus musculus
ttttacaacttggttgtttagtt

SEQ ID NO: 217547 - DNA, 18 bp, Mus musculus
tctgtaaagcctacctca

SEQ ID NO: 217548 - DNA, 22 bp, Mus musculus
atcatactgccagtgaagccag

SEQ ID NO: 217549 - DNA, 23 bp, Mus musculus
acaggtttctgttgtagatgtgt

SEQ ID NO: 217550 - DNA, 21 bp, Mus musculus
aacatcaggggctggagagat

SEQ ID NO: 217551 - DNA, 20 bp, Mus musculus
tgagttcaaatcccagtcat

SEQ ID NO: 217552 - DNA, 20 bp, Mus musculus
tcacagaactgagtgacttg

SEQ ID NO: 217553 - DNA, 20 bp, Mus musculus
atgtgtgtgtgtgtatatac

SEQ ID NO: 217554 - DNA, 22 bp, Mus musculus
agggcatgctgctatcttgttg

SEQ ID NO: 217555 - DNA, 23 bp, Mus musculus
cactcagtctgagcactccatga

SEQ ID NO: 217556 - DNA, 23 bp, Mus musculus
agagtgatgagagacagcacagg

SEQ ID NO: 217557 - DNA, 23 bp, Mus musculus
ctgtgtggggttgatgagcacct

SEQ ID NO: 217558 - DNA, 23 bp, Mus musculus
ggtctgtctccctgtctctgtct

SEQ ID NO: 217559 - DNA, 23 bp, Mus musculus
gaaaatgctggtttactgtttca

SEQ ID NO: 217560 - DNA, 22 bp, Mus musculus
ttgcttcttggtcatgatgttt

SEQ ID NO: 217561 - DNA, 23 bp, Mus musculus
taagacagccaggtttgatgatg

SEQ ID NO: 217562 - DNA, 23 bp, Mus musculus
gagtgaggcttagatatctatgt

SEQ ID NO: 217563 - DNA, 23 bp, Mus musculus
cactccctgtgagtctgtggggg

SEQ ID NO: 217564 - DNA, 23 bp, Mus musculus
atgtgaatgttttgtctgtgtgt

SEQ ID NO: 217565 - DNA, 20 bp, Mus musculus
ctcaccacttgtcattgttg

SEQ ID NO: 217566 - DNA, 23 bp, Mus musculus
tgtgtctgtcactgtcagcttca

SEQ ID NO: 217567 - DNA, 22 bp, Mus musculus
aatctgtatatgaatttatgtg

SEQ ID NO: 217568 - DNA, 21 bp, Mus musculus
cacagtgtcaaagatgaatgt

SEQ ID NO: 217569 - DNA, 23 bp, Mus musculus
gacaagatggatgtcactggctc

SEQ ID NO: 217570 - DNA, 23 bp, Mus musculus
acacactcacacactgtggtggc

SEQ ID NO: 217571 - DNA, 18 bp, Mus musculus
tggctgggtgtgtgtgtg

SEQ ID NO: 217572 - DNA, 23 bp, Mus musculus
gtgcacaagtgtatatatgtata

SEQ ID NO: 217573 - DNA, 23 bp, Mus musculus
gcatgtatatgtgcatgtgcatg

SEQ ID NO: 217574 - DNA, 19 bp, Mus musculus
tatgttttatatatatgga

SEQ ID NO: 217575 - DNA, 23 bp, Mus musculus
tgtgtgtgtgtgtgtctgtatat

SEQ ID NO: 217576 - DNA, 23 bp, Mus musculus
tgtgtgtgtgtgtgcatgtacat

SEQ ID NO: 217577 - DNA, 21 bp, Mus musculus
atatgtgcaggtacacatgcc

SEQ ID NO: 217578 - DNA, 23 bp, Mus musculus
tcactctgtgtcttagttttgag

SEQ ID NO: 217579 - DNA, 23 bp, Mus musculus
cctgcctgcctgcctgcctgcct

SEQ ID NO: 217580 - DNA, 23 bp, Mus musculus
aaatagagccaggtaaagtctgt

SEQ ID NO: 217581 - DNA, 20 bp, Mus musculus
atttgtgaatttgtatatga

SEQ ID NO: 217582 - DNA, 22 bp, Mus musculus
acactatttacaaagagctatg

SEQ ID NO: 217583 - DNA, 18 bp, Mus musculus
agaggtcaaccttgactg

SEQ ID NO: 217584 - DNA, 23 bp, Mus musculus
atccacagactttttgttttcgg

SEQ ID NO: 217585 - DNA, 23 bp, Mus musculus
ttagaacacttaatgcatgtata

SEQ ID NO: 217586 - DNA, 20 bp, Mus musculus
tatgtgctcacggtgtttat

SEQ ID NO: 217587 - DNA, 23 bp, Mus musculus
ttcagacactgtaagtagcctga

SEQ ID NO: 217588 - DNA, 23 bp, Mus musculus
tatcaccatgtggagcagaatga

SEQ ID NO: 217589 - DNA, 23 bp, Mus musculus
tatttatgtgtgttcactggggt

SEQ ID NO: 217590 - DNA, 18 bp, Mus musculus
atgtgtgtgtgtttgtgc

SEQ ID NO: 217591 - DNA, 22 bp, Mus musculus
ttagacagtgaacagtgagttc

SEQ ID NO: 217592 - DNA, 23 bp, Mus musculus
tgaagacttttcatgaagttcaa

SEQ ID NO: 217593 - DNA, 23 bp, Mus musculus
tcagcacttcctagagatgtgta

SEQ ID NO: 217594 - DNA, 23 bp, Mus musculus
acatctgagaacacagacagcac

SEQ ID NO: 217595 - DNA, 20 bp, Mus musculus
tgtgtacatatgtatgtatg

SEQ ID NO: 217596 - DNA, 21 bp, Mus musculus
tcactccctctcatacttgcc

SEQ ID NO: 217597 - DNA, 23 bp, Mus musculus
cacatggtgtgtgtgtgtgtgtg

SEQ ID NO: 217598 - DNA, 23 bp, Mus musculus
gttcacactggctgttctttgca

SEQ ID NO: 217599 - DNA, 20 bp, Mus musculus
aacagagggaaaaatgatgt

SEQ ID NO: 217600 - DNA, 21 bp, Mus musculus
tatctctgctcaccaaggagt

SEQ ID NO: 217601 - DNA, 21 bp, Mus musculus
cctgtgacacaaaggttctag

SEQ ID NO: 217602 - DNA, 23 bp, Mus musculus
acatgtatgtatgtatatgtgta

SEQ ID NO: 217603 - DNA, 21 bp, Mus musculus
atatatgcatatgcatgcata

SEQ ID NO: 217604 - DNA, 23 bp, Mus musculus
tctgactgagggattatgctgtg

SEQ ID NO: 217605 - DNA, 23 bp, Mus musculus
gagattgctcagactccgatctg

SEQ ID NO: 217606 - DNA, 23 bp, Mus musculus
tgtcagaagacagacagttgcac

SEQ ID NO: 217607 - DNA, 23 bp, Mus musculus
atatatacacatgtatatatgat

SEQ ID NO: 217608 - DNA, 20 bp, Mus musculus
atatgtttggttgtatcctg

SEQ ID NO: 217609 - DNA, 22 bp, Mus musculus
ctgtctgtctgtctgtctaggt

SEQ ID NO: 217610 - DNA, 22 bp, Mus musculus
agaagtcagcctgtctctgcct

SEQ ID NO: 217611 - DNA, 23 bp, Mus musculus
gtctcggtctgtatgtgattcta

SEQ ID NO: 217612 - DNA, 23 bp, Mus musculus
aatcaccaaaacaagctggagac

SEQ ID NO: 217613 - DNA, 23 bp, Mus musculus
gttgctcactctgtgtctctcac

SEQ ID NO: 217614 - DNA, 23 bp, Mus musculus
tctctgtttctctcagtatcctg

SEQ ID NO: 217615 - DNA, 23 bp, Mus musculus
tctgctagtgtgtgtgtctgtct

SEQ ID NO: 217616 - DNA, 23 bp, Mus musculus
tctatcactgaagggagtcagga

SEQ ID NO: 217617 - DNA, 21 bp, Mus musculus
tgcctgcctgcctgcctgcct

SEQ ID NO: 217618 - DNA, 23 bp, Mus musculus
gtctcactcccagactcacagct

SEQ ID NO: 217619 - DNA, 23 bp, Mus musculus
gcagtgagagctgagagagctga

SEQ ID NO: 217620 - DNA, 23 bp, Mus musculus
agctaatgagattgatgtacttg

SEQ ID NO: 217621 - DNA, 18 bp, Mus musculus
tgcagtgtcttctaagct

SEQ ID NO: 217622 - DNA, 20 bp, Mus musculus
ctgacccactgtccctgcct

SEQ ID NO: 217623 - DNA, 18 bp, Mus musculus
ggggggctgactgggcct

SEQ ID NO: 217624 - DNA, 23 bp, Mus musculus
cactctctctgcctgtgtctctc

SEQ ID NO: 217625 - DNA, 23 bp, Mus musculus
ttatggatgaagaaaggcaagtg

SEQ ID NO: 217626 - DNA, 21 bp, Mus musculus
atgtgagaacagaaagggcag

SEQ ID NO: 217627 - DNA, 21 bp, Mus musculus
atgactggtggagatttgaac

SEQ ID NO: 217628 - DNA, 23 bp, Mus musculus
acagcaagcactctcacccactg

SEQ ID NO: 217629 - DNA, 23 bp, Mus musculus
tgcatgtgtgtgcgtgtctgagt

SEQ ID NO: 217630 - DNA, 23 bp, Mus musculus
tgtatgtatgcaagtgtgtgtgt

SEQ ID NO: 217631 - DNA, 21 bp, Mus musculus
atgtcattttcatatgtatgt

SEQ ID NO: 217632 - DNA, 22 bp, Mus musculus
agttgtgaatctcactgtctca

SEQ ID NO: 217633 - DNA, 20 bp, Mus musculus
agcttgttgtgccatctgtt

SEQ ID NO: 217634 - DNA, 22 bp, Mus musculus
tcaggtagttgatagaagagac

SEQ ID NO: 217635 - DNA, 21 bp, Mus musculus
tctgtatatatatgtgtgtgt

SEQ ID NO: 217636 - DNA, 21 bp, Mus musculus
ggggtgtctctgggggtctct

SEQ ID NO: 217637 - DNA, 22 bp, Mus musculus
tccatggtggtctgataggatg

SEQ ID NO: 217638 - DNA, 23 bp, Mus musculus
ctcacaggctgtctcacagctgc

SEQ ID NO: 217639 - DNA, 21 bp, Mus musculus
taaaggactgtgctcgggctg

SEQ ID NO: 217640 - DNA, 22 bp, Mus musculus
tctgtgtaggatgtgagctcta

SEQ ID NO: 217641 - DNA, 23 bp, Mus musculus
tgcatgtgagtgtgtgcacacgg

SEQ ID NO: 217642 - DNA, 23 bp, Mus musculus
ttaacaagatgtttgagttactc

SEQ ID NO: 217643 - DNA, 23 bp, Mus musculus
ttttcagaaagtaactgtaggtg

SEQ ID NO: 217644 - DNA, 23 bp, Mus musculus
tgcacacaggcaagtgtgactct

SEQ ID NO: 217645 - DNA, 23 bp, Mus musculus
ccctctgtgtgtgtgtgtgtctg

SEQ ID NO: 217646 - DNA, 23 bp, Mus musculus
atcacttctgtgagtgtcacctg

SEQ ID NO: 217647 - DNA, 22 bp, Mus musculus
tctcacagaggattgtgtgaag

SEQ ID NO: 217648 - DNA, 23 bp, Mus musculus
ccagtcacactcagtctgtttgc

SEQ ID NO: 217649 - DNA, 19 bp, Mus musculus
tcaccttgagctagagaga

SEQ ID NO: 217650 - DNA, 23 bp, Mus musculus
tcacttgagtattactagtagta

SEQ ID NO: 217651 - DNA, 20 bp, Mus musculus
taactgaaagaaatggttct

SEQ ID NO: 217652 - DNA, 23 bp, Mus musculus
gaagagcactgactgctcttcca

SEQ ID NO: 217653 - DNA, 23 bp, Mus musculus
tccctctgtgtcttttctgtgtg

SEQ ID NO: 217654 - DNA, 23 bp, Mus musculus
tgccatagtcaaggcatatggtt

SEQ ID NO: 217655 - DNA, 23 bp, Mus musculus
tgacttgcacacattaattactg

SEQ ID NO: 217656 - DNA, 23 bp, Mus musculus
tgttttgcacttgaaggagggta

SEQ ID NO: 217657 - DNA, 19 bp, Mus musculus
tgtgaggagacagagaaca

SEQ ID NO: 217658 - DNA, 23 bp, Mus musculus
tggctctctcatcctctgtcact

SEQ ID NO: 217659 - DNA, 23 bp, Mus musculus
cacagactatttctcactcttat

SEQ ID NO: 217660 - DNA, 23 bp, Mus musculus
caaactctgtctctgtaactcct

SEQ ID NO: 217661 - DNA, 20 bp, Mus musculus
caaattctgtatgtgtgcac

SEQ ID NO: 217662 - DNA, 22 bp, Mus musculus
tgtgtgcatgtgtatgtgcaca

SEQ ID NO: 217663 - DNA, 22 bp, Mus musculus
tgtgtgccagtgtgtgtgcaca

SEQ ID NO: 217664 - DNA, 23 bp, Mus musculus
tgtatgtgcatgtacatgtgtgt

SEQ ID NO: 217665 - DNA, 23 bp, Mus musculus
gtgtgtgcatgtgtatatgtgtg

SEQ ID NO: 217666 - DNA, 18 bp, Mus musculus
ccctgtcagcagttccct

SEQ ID NO: 217667 - DNA, 21 bp, Mus musculus
ctctcttcagtctctctgatc

SEQ ID NO: 217668 - DNA, 23 bp, Mus musculus
atgtgtgtgtgtatgtatatatg

SEQ ID NO: 217669 - DNA, 20 bp, Mus musculus
tatgcatgtatatatgtatg

SEQ ID NO: 217670 - DNA, 19 bp, Mus musculus
agtcatcttgcaacactct

SEQ ID NO: 217671 - DNA, 21 bp, Mus musculus
atttgaagtggtgcagctgtg

SEQ ID NO: 217672 - DNA, 23 bp, Mus musculus
tctgtgtttgtctctctcattca

SEQ ID NO: 217673 - DNA, 22 bp, Mus musculus
tgttttgtgaccaattatatgg

SEQ ID NO: 217674 - DNA, 23 bp, Mus musculus
tactctgtctgtctctggctcag

SEQ ID NO: 217675 - DNA, 18 bp, Mus musculus
actcagagtctttgagat

SEQ ID NO: 217676 - DNA, 23 bp, Mus musculus
tcacaagatggtacctctccctc

SEQ ID NO: 217677 - DNA, 21 bp, Mus musculus
tcctagtcttgttgcttactg

SEQ ID NO: 217678 - DNA, 23 bp, Mus musculus
gtgtctcacagtctcattagtca

SEQ ID NO: 217679 - DNA, 23 bp, Mus musculus
tatctgttcctatggctgtcttt

SEQ ID NO: 217680 - DNA, 23 bp, Mus musculus
atatatgcacatttagaaaaaag

SEQ ID NO: 217681 - DNA, 23 bp, Mus musculus
aagtgtatctatttttttgtgtg

SEQ ID NO: 217682 - DNA, 23 bp, Mus musculus
ctctgtgtgtctgtctgcctatc

SEQ ID NO: 217683 - DNA, 22 bp, Mus musculus
agtcagaggagagagtgctgtt

SEQ ID NO: 217684 - DNA, 23 bp, Mus musculus
tctgtctgtctgtctgtctgtct

SEQ ID NO: 217685 - DNA, 19 bp, Mus musculus
ctgtaaggcttttttcttt

SEQ ID NO: 217686 - DNA, 20 bp, Mus musculus
aaagcagaaagaggattgct

SEQ ID NO: 217687 - DNA, 21 bp, Mus musculus
aaacaaggtgttgctgtgtag

SEQ ID NO: 217688 - DNA, 23 bp, Mus musculus
cttctgagaactggttcatctat

SEQ ID NO: 217689 - DNA, 22 bp, Mus musculus
atactctctccttgtgttgact

SEQ ID NO: 217690 - DNA, 19 bp, Mus musculus
agcaactacatggtggctt

SEQ ID NO: 217691 - DNA, 22 bp, Mus musculus
actgaaagttctctctctctct

SEQ ID NO: 217692 - DNA, 22 bp, Mus musculus
tgggtccctccgtcagtggctg

SEQ ID NO: 217693 - DNA, 22 bp, Mus musculus
tgttttgtgaccaattatatgg

SEQ ID NO: 217694 - DNA, 23 bp, Mus musculus
atgtatgtatatatgtatgtgtg

SEQ ID NO: 217695 - DNA, 21 bp, Mus musculus
catatgtatgtatatatgtat

SEQ ID NO: 217696 - DNA, 23 bp, Mus musculus
cagagactcaagactgtctgcag

SEQ ID NO: 217697 - DNA, 18 bp, Mus musculus
ttgcacagtgcccaaggt

SEQ ID NO: 217698 - DNA, 18 bp, Mus musculus
tgtgcatatggatgctaa

SEQ ID NO: 217699 - DNA, 23 bp, Mus musculus
tgtaagtatgtatgtatgtaagc

SEQ ID NO: 217700 - DNA, 21 bp, Mus musculus
atacacacatatataattgtc

SEQ ID NO: 217701 - DNA, 22 bp, Mus musculus
tgttttgtgaccaattatatgg

SEQ ID NO: 217702 - DNA, 23 bp, Mus musculus
ctgtgtctctgtttagtttctgt

SEQ ID NO: 217703 - DNA, 23 bp, Mus musculus
aggatctgtccattgatgagagt

SEQ ID NO: 217704 - DNA, 23 bp, Mus musculus
atgtgtgtatatatatgtgtgtg

SEQ ID NO: 217705 - DNA, 22 bp, Mus musculus
aagactgtcaggagacaaggtc

SEQ ID NO: 217706 - DNA, 20 bp, Mus musculus
attctggctagactccacct

SEQ ID NO: 217707 - DNA, 19 bp, Mus musculus
agcagagctcctggagtag

SEQ ID NO: 217708 - DNA, 23 bp, Mus musculus
tgggtgactgtgtgtgtcagtgt

SEQ ID NO: 217709 - DNA, 23 bp, Mus musculus
ctcagacactgcatgtggatgtc

SEQ ID NO: 217710 - DNA, 18 bp, Mus musculus
cactggcattttgtggtg

SEQ ID NO: 217711 - DNA, 23 bp, Mus musculus
gtctctatctctgtaaaataggg

SEQ ID NO: 217712 - DNA, 22 bp, Mus musculus
gcctcagctcttggtgctggag

SEQ ID NO: 217713 - DNA, 22 bp, Mus musculus
tcactaacaacaggttgtgctg

SEQ ID NO: 217714 - DNA, 23 bp, Mus musculus
tccctgtctgtctgtctgtctgt

SEQ ID NO: 217715 - DNA, 23 bp, Mus musculus
ctgtgttgagtctgtctgtcagt

SEQ ID NO: 217716 - DNA, 23 bp, Mus musculus
tgattagagtagttactcagcag

SEQ ID NO: 217717 - DNA, 23 bp, Mus musculus
tgtgacagtctggttacctgctt

SEQ ID NO: 217718 - DNA, 23 bp, Mus musculus
cactgactgctcttccagaggtc

SEQ ID NO: 217719 - DNA, 22 bp, Mus musculus
tggctcagtggttaagagtgcc

SEQ ID NO: 217720 - DNA, 18 bp, Mus musculus
atgtcagcatgtctgtcc

SEQ ID NO: 217721 - DNA, 22 bp, Mus musculus
agcctggctccctctgtggttg

SEQ ID NO: 217722 - DNA, 23 bp, Mus musculus
tctgtgagcatgactgcactggg

SEQ ID NO: 217723 - DNA, 18 bp, Mus musculus
cacagggtctctccctct

SEQ ID NO: 217724 - DNA, 18 bp, Mus musculus
attgaactctaggggctg

SEQ ID NO: 217725 - DNA, 23 bp, Mus musculus
agtgacagtgtctgcctctctct

SEQ ID NO: 217726 - DNA, 23 bp, Mus musculus
tgtgtgcctgcctggctgcgtgt

SEQ ID NO: 217727 - DNA, 23 bp, Mus musculus
tgtctgtctgtctgtgtatgttg

SEQ ID NO: 217728 - DNA, 23 bp, Mus musculus
acaggcacaggataacttttttt

SEQ ID NO: 217729 - DNA, 22 bp, Mus musculus
tggtgatgatgttacctgtatt

SEQ ID NO: 217730 - DNA, 22 bp, Mus musculus
aaaactggttcatttttgttaa

SEQ ID NO: 217731 - DNA, 22 bp, Mus musculus
tgttttgtgaccaattatatgg

SEQ ID NO: 217732 - DNA, 22 bp, Mus musculus
tgttttgtgaccaattatatgg

SEQ ID NO: 217733 - DNA, 22 bp, Mus musculus
tgttttgtgaccaattatatgg

SEQ ID NO: 217734 - DNA, 23 bp, Mus musculus
cactctctgtgtattgtctggct

SEQ ID NO: 217735 - DNA, 20 bp, Mus musculus
tcagagatcagagtggtcat

SEQ ID NO: 217736 - DNA, 22 bp, Mus musculus
tgttttgtgaccaattatatgg

SEQ ID NO: 217737 - DNA, 23 bp, Mus musculus
cttcagagaggaactgcataggg

SEQ ID NO: 217738 - DNA, 23 bp, Mus musculus
tgtctcccactatctgagacccc

SEQ ID NO: 217739 - DNA, 22 bp, Mus musculus
atgtgtgtatatatatgtgtat

SEQ ID NO: 217740 - DNA, 21 bp, Mus musculus
tgaagttccaagactagttgc

SEQ ID NO: 217741 - DNA, 21 bp, Mus musculus
tattaattcaagaaaactttt

SEQ ID NO: 217742 - DNA, 23 bp, Mus musculus
tctctctctctctgtgagtgcca

SEQ ID NO: 217743 - DNA, 23 bp, Mus musculus
catgtatgtatatgtatatacat

SEQ ID NO: 217744 - DNA, 20 bp, Mus musculus
tatgtatatatgtgtgtgtg

SEQ ID NO: 217745 - DNA, 19 bp, Mus musculus
accaggcttgagtgggcct

SEQ ID NO: 217746 - DNA, 23 bp, Mus musculus
gtctctgtgtcactgctgctggt

SEQ ID NO: 217747 - DNA, 23 bp, Mus musculus
ggtagtcctgggtgtccagagac

SEQ ID NO: 217748 - DNA, 23 bp, Mus musculus
atgtatgtatgtatgtatgtgtg

SEQ ID NO: 217749 - DNA, 23 bp, Mus musculus
acacagtggttctgcatgtggaa

SEQ ID NO: 217750 - DNA, 23 bp, Mus musculus
tgtgtacatctatgtatgcatac

SEQ ID NO: 217751 - DNA, 19 bp, Mus musculus
gaacacagtgagctctggg

SEQ ID NO: 217752 - DNA, 23 bp, Mus musculus
acactgtccctctcttacactgt

SEQ ID NO: 217753 - DNA, 21 bp, Mus musculus
tcgactgtcacgtttccttct

SEQ ID NO: 217754 - DNA, 20 bp, Mus musculus
aatgggtttgcatgatctct

SEQ ID NO: 217755 - DNA, 19 bp, Mus musculus
accagtgtgaggaaaggat

SEQ ID NO: 217756 - DNA, 23 bp, Mus musculus
tctctcagtctctcaattcacca

SEQ ID NO: 217757 - DNA, 23 bp, Mus musculus
aattctcagcaactacatgatgg

SEQ ID NO: 217758 - DNA, 23 bp, Mus musculus
aaatgtgtcactgtatgggctac

SEQ ID NO: 217759 - DNA, 23 bp, Mus musculus
gtgttcctgtgtggttgacttca

SEQ ID NO: 217760 - DNA, 23 bp, Mus musculus
atatatgcactacatgtacatgt

SEQ ID NO: 217761 - DNA, 23 bp, Mus musculus
agacaggctgactgactggttca

SEQ ID NO: 217762 - DNA, 23 bp, Mus musculus
aagatctgtctgcctctgtctcc

SEQ ID NO: 217763 - DNA, 23 bp, Mus musculus
cctccctctgactctctctggtc

SEQ ID NO: 217764 - DNA, 23 bp, Mus musculus
tgttcctcccacagtctgtctgt

SEQ ID NO: 217765 - DNA, 23 bp, Mus musculus
actcactcactgggtgagcaaag

SEQ ID NO: 217766 - DNA, 18 bp, Mus musculus
tctctccctgtccctcag

SEQ ID NO: 217767 - DNA, 18 bp, Mus musculus
tctgtttctatttcatta

SEQ ID NO: 217768 - DNA, 21 bp, Mus musculus
tatgtgtgtgtatatataggt

SEQ ID NO: 217769 - DNA, 22 bp, Mus musculus
agagagaagtctcagaggatac

SEQ ID NO: 217770 - DNA, 21 bp, Mus musculus
aaagtcaatcggacttctgtc

SEQ ID NO: 217771 - DNA, 23 bp, Mus musculus
tcaacctgacaggatgatgtaag

SEQ ID NO: 217772 - DNA, 23 bp, Mus musculus
acactagacagggagcagagaag

SEQ ID NO: 217773 - DNA, 23 bp, Mus musculus
tttctctcactctttatcctggt

SEQ ID NO: 217774 - DNA, 22 bp, Mus musculus
atgactatatatatgtgtgtgt

SEQ ID NO: 217775 - DNA, 23 bp, Mus musculus
gtaacacatagacttagttctgt

SEQ ID NO: 217776 - DNA, 23 bp, Mus musculus
tatcagtcacttgtaatgttcct

SEQ ID NO: 217777 - DNA, 23 bp, Mus musculus
aaggagctcacagtctattgagt

SEQ ID NO: 217778 - DNA, 19 bp, Mus musculus
atatgtatgcatgcatgca

SEQ ID NO: 217779 - DNA, 23 bp, Mus musculus
tctgtgagcgagagcaagaggtg

SEQ ID NO: 217780 - DNA, 22 bp, Mus musculus
tgctgctgctgctgctgctgat

SEQ ID NO: 217781 - DNA, 21 bp, Mus musculus
tgccaggctgcgtgtttgagc

SEQ ID NO: 217782 - DNA, 18 bp, Mus musculus
ctggagagagagagctct

SEQ ID NO: 217783 - DNA, 23 bp, Mus musculus
agggactctctctggctgactgt

SEQ ID NO: 217784 - DNA, 23 bp, Mus musculus
atatgtaagtatacataagtaca

SEQ ID NO: 217785 - DNA, 23 bp, Mus musculus
tatgtggtgcacatatacaagta

SEQ ID NO: 217786 - DNA, 22 bp, Mus musculus
gttagtaggttctcactaaggc

SEQ ID NO: 217787 - DNA, 19 bp, Mus musculus
attgtagggtaagagtgtg

SEQ ID NO: 217788 - DNA, 21 bp, Mus musculus
caggggaaatcttctcaatgc

SEQ ID NO: 217789 - DNA, 18 bp, Mus musculus
tctagacaggtggtggtt

SEQ ID NO: 217790 - DNA, 22 bp, Mus musculus
gtggctgtgtgcttccttgttt

SEQ ID NO: 217791 - DNA, 19 bp, Mus musculus
tctcccttacttttgttta

SEQ ID NO: 217792 - DNA, 22 bp, Mus musculus
tgttttgtgaccaattatatgg

SEQ ID NO: 217793 - DNA, 20 bp, Mus musculus
tacatatattttgtatatgt

SEQ ID NO: 217794 - DNA, 23 bp, Mus musculus
tgagtgtgtgcatgtgcttgtgt

SEQ ID NO: 217795 - DNA, 19 bp, Mus musculus
tgagttcaactccagcaac

SEQ ID NO: 217796 - DNA, 23 bp, Mus musculus
tcagtaactgctaactgtatgtc

SEQ ID NO: 217797 - DNA, 20 bp, Mus musculus
tatgagtacactgtagctgt

SEQ ID NO: 217798 - DNA, 23 bp, Mus musculus
aatgtctctgtgtgtgatgtgtg

SEQ ID NO: 217799 - DNA, 23 bp, Mus musculus
gtatgtatgtatgtatgtatgta

SEQ ID NO: 217800 - DNA, 19 bp, Mus musculus
atagttaagatgtatggtg

SEQ ID NO: 217801 - DNA, 21 bp, Mus musculus
tacagggacttaaagaagtgt

SEQ ID NO: 217802 - DNA, 21 bp, Mus musculus
ctcagtgatctcagagtgcac

SEQ ID NO: 217803 - DNA, 22 bp, Mus musculus
tgttttgtgaccaattatatgg

SEQ ID NO: 217804 - DNA, 22 bp, Mus musculus
tgtacatatatatacatgcata

SEQ ID NO: 217805 - DNA, 23 bp, Mus musculus
atatatgatatgtatgtatgtgt

SEQ ID NO: 217806 - DNA, 21 bp, Mus musculus
aggatgtgcagtgtgtctgta

SEQ ID NO: 217807 - DNA, 23 bp, Mus musculus
acaaatctggaaggtctttggat

SEQ ID NO: 217808 - DNA, 19 bp, Mus musculus
attctactgcaggtcctgg

SEQ ID NO: 217809 - DNA, 23 bp, Mus musculus
tggctcacagtctctccttctgc

SEQ ID NO: 217810 - DNA, 19 bp, Mus musculus
tgtctcccagtctctgtct

SEQ ID NO: 217811 - DNA, 21 bp, Mus musculus
agcttttagaaagagatgact

SEQ ID NO: 217812 - DNA, 19 bp, Mus musculus
acaggaagaccctgtctca

SEQ ID NO: 217813 - DNA, 18 bp, Mus musculus
atatgcacatgcatatgt

SEQ ID NO: 217814 - DNA, 22 bp, Mus musculus
cagttcagacaagagacagaac

SEQ ID NO: 217815 - DNA, 23 bp, Mus musculus
gtgtgtgtgtgtgtgcatgtgca

SEQ ID NO: 217816 - DNA, 22 bp, Mus musculus
tgttttgtgaccaattatatgg

SEQ ID NO: 217817 - DNA, 23 bp, Mus musculus
cagtggctctctctgtcttggtg

SEQ ID NO: 217818 - DNA, 23 bp, Mus musculus
ttgtgtatgtgtatatgtatatg

SEQ ID NO: 217819 - DNA, 23 bp, Mus musculus
tttctgagcagacagtggagagt

SEQ ID NO: 217820 - DNA, 21 bp, Mus musculus
tggaggtagtgagagttaacc

SEQ ID NO: 217821 - DNA, 21 bp, Mus musculus
cactccagtagtgacctgtat

SEQ ID NO: 217822 - DNA, 23 bp, Mus musculus
tgaaaacaaaagtagtttggaga

SEQ ID NO: 217823 - DNA, 19 bp, Mus musculus
tgaatacaggagctggcat

SEQ ID NO: 217824 - DNA, 21 bp, Mus musculus
agtgtgcctgcctctctgagt

SEQ ID NO: 217825 - DNA, 21 bp, Mus musculus
tatgcgtgtgttatatgtgac

SEQ ID NO: 217826 - DNA, 23 bp, Mus musculus
tcagtctagatagagagctgttc

SEQ ID NO: 217827 - DNA, 18 bp, Mus musculus
ggctcattctgtcactct

SEQ ID NO: 217828 - DNA, 23 bp, Mus musculus
tgtgtgtgtgcatgtatatatgt

SEQ ID NO: 217829 - DNA, 23 bp, Mus musculus
tatgtgtgtgtatatgtatgtat

SEQ ID NO: 217830 - DNA, 23 bp, Mus musculus
agaatgtgtatacacacacactc

SEQ ID NO: 217831 - DNA, 20 bp, Mus musculus
aggatgaatgaatgaatgaa

SEQ ID NO: 217832 - DNA, 23 bp, Mus musculus
tccctgtgtcactctttctgcct

SEQ ID NO: 217833 - DNA, 23 bp, Mus musculus
tgtctgtttctctcagggtcctt

SEQ ID NO: 217834 - DNA, 23 bp, Mus musculus
ctggctcctggttctgcaggctg

SEQ ID NO: 217835 - DNA, 21 bp, Mus musculus
aagtcagtagattgagaggcc

SEQ ID NO: 217836 - DNA, 22 bp, Mus musculus
acactgggtggagactgagcac

SEQ ID NO: 217837 - DNA, 22 bp, Mus musculus
aacactgactgctcttccagag

SEQ ID NO: 217838 - DNA, 19 bp, Mus musculus
tctctgcctctctgagtca

SEQ ID NO: 217839 - DNA, 23 bp, Mus musculus
atatgtgtatgtatatgtgtatg

SEQ ID NO: 217840 - DNA, 21 bp, Mus musculus
tctcactctgacccgctgtaa

SEQ ID NO: 217841 - DNA, 21 bp, Mus musculus
atgagctatctgtctctctcc

SEQ ID NO: 217842 - DNA, 23 bp, Mus musculus
agatggttcagtggtttggagca

SEQ ID NO: 217843 - DNA, 23 bp, Mus musculus
acagctactggattctctctgtg

SEQ ID NO: 217844 - DNA, 19 bp, Mus musculus
tgtgtacatgtgcatatgg

SEQ ID NO: 217845 - DNA, 23 bp, Mus musculus
tatatgtatatatatatgtgtgt

SEQ ID NO: 217846 - DNA, 19 bp, Mus musculus
atctgtatgtatgtatata

SEQ ID NO: 217847 - DNA, 22 bp, Mus musculus
atgtatatgtaggtgtatatgt

SEQ ID NO: 217848 - DNA, 23 bp, Mus musculus
tatatgtgtatatgtacatgtgc

SEQ ID NO: 217849 - DNA, 22 bp, Mus musculus
aatgtacatttctatatatggg

SEQ ID NO: 217850 - DNA, 23 bp, Mus musculus
tatatgtgtatatgtatacatgt

SEQ ID NO: 217851 - DNA, 23 bp, Mus musculus
tatgtgtatgcatatgtatatgt

SEQ ID NO: 217852 - DNA, 22 bp, Mus musculus
gtgtcatctgtgttgttaggat

SEQ ID NO: 217853 - DNA, 23 bp, Mus musculus
taggaggtcaacttggtctacag

SEQ ID NO: 217854 - DNA, 23 bp, Mus musculus
tcccagtgatctgtctacctctt

SEQ ID NO: 217855 - DNA, 23 bp, Mus musculus
gttaacagtagagtgttaccact

SEQ ID NO: 217856 - DNA, 23 bp, Mus musculus
tgtgtgtgtctgtctctgtgtgt

SEQ ID NO: 217857 - DNA, 22 bp, Mus musculus
tatgtatgtttgcatatgtgtg

SEQ ID NO: 217858 - DNA, 23 bp, Mus musculus
tgtgagtgttaccttaggggctg

SEQ ID NO: 217859 - DNA, 23 bp, Mus musculus
tctctgttgagtctgaggactgc

SEQ ID NO: 217860 - DNA, 23 bp, Mus musculus
ttcagttttttatcttttgagag

SEQ ID NO: 217861 - DNA, 23 bp, Mus musculus
cttgaagcagcgttggtgtgaca

SEQ ID NO: 217862 - DNA, 23 bp, Mus musculus
acagatctctgcacattgctgtt

SEQ ID NO: 217863 - DNA, 23 bp, Mus musculus
actgaagggagtgtgcattgctg

SEQ ID NO: 217864 - DNA, 23 bp, Mus musculus
gccactgactctgagtgagactg

SEQ ID NO: 217865 - DNA, 23 bp, Mus musculus
gatggctctgcctctgtctgtgt

SEQ ID NO: 217866 - DNA, 21 bp, Mus musculus
aactcacgctctaagtacttg

SEQ ID NO: 217867 - DNA, 23 bp, Mus musculus
gagttcacacagtaaaggcttga

SEQ ID NO: 217868 - DNA, 22 bp, Mus musculus
tatgtgtatatatatgtgtgtg

SEQ ID NO: 217869 - DNA, 19 bp, Mus musculus
acacactcagtttatttgc

SEQ ID NO: 217870 - DNA, 22 bp, Mus musculus
atagcattgatgtctgctgagt

SEQ ID NO: 217871 - DNA, 18 bp, Mus musculus
acactgtatccttgcagt

SEQ ID NO: 217872 - DNA, 23 bp, Mus musculus
catgcattgttgtctgtctgtct

SEQ ID NO: 217873 - DNA, 23 bp, Mus musculus
tctgcctctcaaatgctggaatt

SEQ ID NO: 217874 - DNA, 22 bp, Mus musculus
tttatcgtagtggtgggtgggt

SEQ ID NO: 217875 - DNA, 23 bp, Mus musculus
aacacagcttgcatgtgaaggtc

SEQ ID NO: 217876 - DNA, 21 bp, Mus musculus
taatagcactgactgctcttc

SEQ ID NO: 217877 - DNA, 23 bp, Mus musculus
cagcacctccttctgaaggtcct

SEQ ID NO: 217878 - DNA, 23 bp, Mus musculus
agccagagtaatgaaaatctcaa

SEQ ID NO: 217879 - DNA, 18 bp, Mus musculus
tcagagggtttggtctgt

SEQ ID NO: 217880 - DNA, 23 bp, Mus musculus
tctggtgctgtctaccactctct

SEQ ID NO: 217881 - DNA, 23 bp, Mus musculus
atatgtatgtgtatatgtatatg

SEQ ID NO: 217882 - DNA, 23 bp, Mus musculus
atgtgtctatatatgtatgtgta

SEQ ID NO: 217883 - DNA, 23 bp, Mus musculus
ataattatgtatacatatgtgtg

SEQ ID NO: 217884 - DNA, 22 bp, Mus musculus
tgttttgtgaccaattatatgg

SEQ ID NO: 217885 - DNA, 23 bp, Mus musculus
taatctcttgtgtagtgtctctg

SEQ ID NO: 217886 - DNA, 23 bp, Mus musculus
acatagtagtgagtgagcagaac

SEQ ID NO: 217887 - DNA, 21 bp, Mus musculus
tcagagttaaatctaaggctt

SEQ ID NO: 217888 - DNA, 20 bp, Mus musculus
atgtatatatgtatgtgtgt

SEQ ID NO: 217889 - DNA, 19 bp, Mus musculus
tatgcatatatatgtatgt

SEQ ID NO: 217890 - DNA, 23 bp, Mus musculus
agaaagacaggcagtgtataggg

SEQ ID NO: 217891 - DNA, 23 bp, Mus musculus
tgactcagtggttaagagcactg

SEQ ID NO: 217892 - DNA, 23 bp, Mus musculus
cactctctgagtgactggggctg

SEQ ID NO: 217893 - DNA, 19 bp, Mus musculus
acaggtacactcttggagt

SEQ ID NO: 217894 - DNA, 23 bp, Mus musculus
cggtgtgtctgtgtctctcttac

SEQ ID NO: 217895 - DNA, 19 bp, Mus musculus
agaggatctacattcagtt

SEQ ID NO: 217896 - DNA, 21 bp, Mus musculus
attgtccaaggctgtattgaa

SEQ ID NO: 217897 - DNA, 21 bp, Mus musculus
tgagcctgagtgtgtgcctat

SEQ ID NO: 217898 - DNA, 20 bp, Mus musculus
acagcagattttcatgattt

SEQ ID NO: 217899 - DNA, 23 bp, Mus musculus
caagaaagagctgtcagtcctct

SEQ ID NO: 217900 - DNA, 23 bp, Mus musculus
attctgacattggtagtgtaaca

SEQ ID NO: 217901 - DNA, 19 bp, Mus musculus
ttgtaaccaagctgtagtt

SEQ ID NO: 217902 - DNA, 21 bp, Mus musculus
aattgtaaccaagctgtagtt

SEQ ID NO: 217903 - DNA, 21 bp, Mus musculus
tgtctctgattagtaacatgt

SEQ ID NO: 217904 - DNA, 21 bp, Mus musculus
tctccaagtttgtgactttct

SEQ ID NO: 217905 - DNA, 23 bp, Mus musculus
gtctgtcagtctcacttaaaccc

SEQ ID NO: 217906 - DNA, 18 bp, Mus musculus
gagagatgattctgaggt

SEQ ID NO: 217907 - DNA, 23 bp, Mus musculus
ttaagagcactgactgctcttcc

SEQ ID NO: 217908 - DNA, 23 bp, Mus musculus
cactcagtgtctatatagcaagt

SEQ ID NO: 217909 - DNA, 23 bp, Mus musculus
aaactcacagatgtgcctgagca

SEQ ID NO: 217910 - DNA, 23 bp, Mus musculus
ttgtgtgtctctgtgtgtgcttg

SEQ ID NO: 217911 - DNA, 23 bp, Mus musculus
tgtgcatgtgtgtgtctgtgtat

SEQ ID NO: 217912 - DNA, 23 bp, Mus musculus
tctctgacccaggctacaagctc

SEQ ID NO: 217913 - DNA, 23 bp, Mus musculus
aaagttgtacatgatgtcatgag

SEQ ID NO: 217914 - DNA, 23 bp, Mus musculus
gactcagtggctgtgtcagaccc

SEQ ID NO: 217915 - DNA, 22 bp, Mus musculus
gagtgcatgatttctgggtttt

SEQ ID NO: 217916 - DNA, 23 bp, Mus musculus
tatgtatgtatgtatgtatgtat

SEQ ID NO: 217917 - DNA, 21 bp, Mus musculus
tatgtgtatatgtatatgtat

SEQ ID NO: 217918 - DNA, 21 bp, Mus musculus
ttcgctttggaagatctctct

SEQ ID NO: 217919 - DNA, 22 bp, Mus musculus
tacagctaactgtttacagatg

SEQ ID NO: 217920 - DNA, 19 bp, Mus musculus
cacactatgctatctatct

SEQ ID NO: 217921 - DNA, 23 bp, Mus musculus
ttctcacagtatgtggtggttta

SEQ ID NO: 217922 - DNA, 18 bp, Mus musculus
acatattcacacacatat

SEQ ID NO: 217923 - DNA, 21 bp, Mus musculus
agtacaagagaaagctagagt

SEQ ID NO: 217924 - DNA, 23 bp, Mus musculus
agactagagctttgactcacagt

SEQ ID NO: 217925 - DNA, 23 bp, Mus musculus
agcatttctgtgtgtagtatact

SEQ ID NO: 217926 - DNA, 23 bp, Mus musculus
tcttacctattctttctgtcttt

SEQ ID NO: 217927 - DNA, 21 bp, Mus musculus
ggaatgaaaagatgtgtgtgg

SEQ ID NO: 217928 - DNA, 23 bp, Mus musculus
actgtgcctctgtctctgccatc

SEQ ID NO: 217929 - DNA, 19 bp, Mus musculus
aaagacatagtgaatgttc

SEQ ID NO: 217930 - DNA, 19 bp, Mus musculus
tatatgcatatataccttt

SEQ ID NO: 217931 - DNA, 23 bp, Mus musculus
cactgaacagagtctgtagtctg

SEQ ID NO: 217932 - DNA, 22 bp, Mus musculus
atatgtgcatatgtatatgtat

SEQ ID NO: 217933 - DNA, 20 bp, Mus musculus
ttgaaatatatacatatgtg

SEQ ID NO: 217934 - DNA, 23 bp, Mus musculus
tatgtatgtatgtatgtatgtat

SEQ ID NO: 217935 - DNA, 19 bp, Mus musculus
ttagtacaaggagatagga

SEQ ID NO: 217936 - DNA, 22 bp, Mus musculus
tgttttgtgaccaattatatgg

SEQ ID NO: 217937 - DNA, 23 bp, Mus musculus
gtatgtatgtatgtatgtatgta

SEQ ID NO: 217938 - DNA, 22 bp, Mus musculus
taatacatgtacatttggaatg

SEQ ID NO: 217939 - DNA, 23 bp, Mus musculus
tgtgtcagttcacttggaaggca

SEQ ID NO: 217940 - DNA, 23 bp, Mus musculus
ttctttgatgcacatacacacac

SEQ ID NO: 217941 - DNA, 18 bp, Mus musculus
tgaatactcaggtaaagt

SEQ ID NO: 217942 - DNA, 22 bp, Mus musculus
tgtcacctactgttacatgact

SEQ ID NO: 217943 - DNA, 23 bp, Mus musculus
tgtgaaattctatactttacaga

SEQ ID NO: 217944 - DNA, 22 bp, Mus musculus
tgtgtctgtggttgttaataga

SEQ ID NO: 217945 - DNA, 20 bp, Mus musculus
tccacaaatgttactcatgt

SEQ ID NO: 217946 - DNA, 23 bp, Mus musculus
gtgtgtgtatatatatgtgtgtg

SEQ ID NO: 217947 - DNA, 23 bp, Mus musculus
agatgggtttgtgtcactggttg

SEQ ID NO: 217948 - DNA, 19 bp, Mus musculus
ctgcactggatttcagtgt

SEQ ID NO: 217949 - DNA, 23 bp, Mus musculus
tgtgtgtatatatctctgtgtgt

SEQ ID NO: 217950 - DNA, 22 bp, Mus musculus
tgttttgtgaccaattatatgg

SEQ ID NO: 217951 - DNA, 23 bp, Mus musculus
tcttgaagggaatgttgttagga

SEQ ID NO: 217952 - DNA, 23 bp, Mus musculus
ctatctctcattatctctgtcat

SEQ ID NO: 217953 - DNA, 22 bp, Mus musculus
tgttttgtgaccaattatatgg

SEQ ID NO: 217954 - DNA, 21 bp, Mus musculus
aaagtcactgtttcatgacac

SEQ ID NO: 217955 - DNA, 22 bp, Mus musculus
tatatgcatatattatgtatta

SEQ ID NO: 217956 - DNA, 19 bp, Mus musculus
taaaagagcctgcttatta

SEQ ID NO: 217957 - DNA, 22 bp, Mus musculus
tgttttgtgaccaattatatgg

SEQ ID NO: 217958 - DNA, 23 bp, Mus musculus
aatattgtgcttgcagatgacct

SEQ ID NO: 217959 - DNA, 23 bp, Mus musculus
ttatactttcacaggtttctgtt

SEQ ID NO: 217960 - DNA, 23 bp, Mus musculus
gcatgtgtatgtgtatgtgtatg

SEQ ID NO: 217961 - DNA, 23 bp, Mus musculus
atatgtatacatgcatgtgtgtg

SEQ ID NO: 217962 - DNA, 23 bp, Mus musculus
tgtgcttgcatgtatgtgtgcac

SEQ ID NO: 217963 - DNA, 23 bp, Mus musculus
ctatctgcatgtacatctgaatg

SEQ ID NO: 217964 - DNA, 23 bp, Mus musculus
tcacactcagattatgatttggg

SEQ ID NO: 217965 - DNA, 22 bp, Mus musculus
ttataataagaggcactgaaag

SEQ ID NO: 217966 - DNA, 21 bp, Mus musculus
gtgacctttagttgttcaggg

SEQ ID NO: 217967 - DNA, 23 bp, Mus musculus
ttgttctcactctcactctctcc

SEQ ID NO: 217968 - DNA, 19 bp, Mus musculus
atatatagacgtatagatg

SEQ ID NO: 217969 - DNA, 21 bp, Mus musculus
tgaatatttgcatgtgtgtgt

SEQ ID NO: 217970 - DNA, 22 bp, Mus musculus
tgttttgtgaccaattatatgg

SEQ ID NO: 217971 - DNA, 22 bp, Mus musculus
gtgtgtgtgtgtatatatatac

SEQ ID NO: 217972 - DNA, 23 bp, Mus musculus
tgtgtgtatatatatatgtgtgt

SEQ ID NO: 217973 - DNA, 23 bp, Mus musculus
tcaagtctggaaatcatgtatta

SEQ ID NO: 217974 - DNA, 19 bp, Mus musculus
aacgaagatagacaccagg

SEQ ID NO: 217975 - DNA, 23 bp, Mus musculus
ttgattgtctctgactttctgtg

SEQ ID NO: 217976 - DNA, 21 bp, Mus musculus
tggactgtatagaactttgtt

SEQ ID NO: 217977 - DNA, 23 bp, Mus musculus
tgcctccctgagtgcctgtctct

SEQ ID NO: 217978 - DNA, 22 bp, Mus musculus
tctgtgtgcctcagttgtctgt

SEQ ID NO: 217979 - DNA, 22 bp, Mus musculus
atatccttgtgtgtatgtgtat

SEQ ID NO: 217980 - DNA, 20 bp, Mus musculus
tgaatgtgcactgtgtgtgt

SEQ ID NO: 217981 - DNA, 23 bp, Mus musculus
agagatgagcttttggccttctt

SEQ ID NO: 217982 - DNA, 18 bp, Mus musculus
cacaggcataatcttcag

SEQ ID NO: 217983 - DNA, 23 bp, Mus musculus
tctgtgtgcctttctctctgcac

SEQ ID NO: 217984 - DNA, 22 bp, Mus musculus
atacagagagaataaggtgaga

SEQ ID NO: 217985 - DNA, 21 bp, Mus musculus
agtgggcatcttgaatgcttg

SEQ ID NO: 217986 - DNA, 22 bp, Mus musculus
ttaagaccgtccactgttcctc

SEQ ID NO: 217987 - DNA, 21 bp, Mus musculus
caggcatcagtttggcatttc

SEQ ID NO: 217988 - DNA, 20 bp, Mus musculus
tgagtggggtttgcttctct

SEQ ID NO: 217989 - DNA, 22 bp, Mus musculus
tgccagtctctgtgtcactctc

SEQ ID NO: 217990 - DNA, 21 bp, Mus musculus
tggattacacaagcattggga

SEQ ID NO: 217991 - DNA, 23 bp, Mus musculus
ctgtctgtctctgtgacagtgcc

SEQ ID NO: 217992 - DNA, 23 bp, Mus musculus
attattgtagtacagcttgaggt

SEQ ID NO: 217993 - DNA, 23 bp, Mus musculus
tagtctgtggtgatctgatagga

SEQ ID NO: 217994 - DNA, 22 bp, Mus musculus
tgttttgtgaccaattatttgg

SEQ ID NO: 217995 - DNA, 22 bp, Mus musculus
tgttttgtgaccaattatatgg

SEQ ID NO: 217996 - DNA, 21 bp, Mus musculus
acaggggctggagagatggct

SEQ ID NO: 217997 - DNA, 22 bp, Mus musculus
tgttttgtgaccaattatatgg

SEQ ID NO: 217998 - DNA, 23 bp, Mus musculus
ctgtgtgagcatgtgcatgtgca

SEQ ID NO: 217999 - DNA, 18 bp, Mus musculus
tgtgtgcgtgcatgcatg

SEQ ID NO: 218000 - DNA, 20 bp, Mus musculus
aggtagatagatagatagat

SEQ ID NO: 218001 - DNA, 23 bp, Mus musculus
tggaactcactgactcactgaga

SEQ ID NO: 218002 - DNA, 23 bp, Mus musculus
ctttgaagtagcaatgatctagt

SEQ ID NO: 218003 - DNA, 22 bp, Mus musculus
tgttttgtgaccaattatatgg

SEQ ID NO: 218004 - DNA, 22 bp, Mus musculus
tgttttgtgaccaattatatgg

SEQ ID NO: 218005 - DNA, 19 bp, Mus musculus
ttactttcatatacacatg

SEQ ID NO: 218006 - DNA, 23 bp, Mus musculus
gtgtgtgtatgtgcatatgttat

SEQ ID NO: 218007 - DNA, 23 bp, Mus musculus
tgtgtatatatgcatatgtgtgt

SEQ ID NO: 218008 - DNA, 20 bp, Mus musculus
atatgtgagtttgtatatgt

SEQ ID NO: 218009 - DNA, 23 bp, Mus musculus
agtctctgtctctgtctgtctgt

SEQ ID NO: 218010 - DNA, 23 bp, Mus musculus
tttctcaattgttttgtacctta

SEQ ID NO: 218011 - DNA, 23 bp, Mus musculus
tctatatatgacatgcatataca

SEQ ID NO: 218012 - DNA, 19 bp, Mus musculus
tgtgtgtgtgtacatgtgt

SEQ ID NO: 218013 - DNA, 23 bp, Mus musculus
actctgttgatcttcctgtggag

SEQ ID NO: 218014 - DNA, 18 bp, Mus musculus
gggatgttgatgtagtag

SEQ ID NO: 218015 - DNA, 23 bp, Mus musculus
cacagctatatcatggtcttttc

SEQ ID NO: 218016 - DNA, 20 bp, Mus musculus
gggccactctctgactcaga

SEQ ID NO: 218017 - DNA, 22 bp, Mus musculus
tgttttgtgaccaattatatgg

SEQ ID NO: 218018 - DNA, 23 bp, Mus musculus
tgggtctctctctctctctcaaa

SEQ ID NO: 218019 - DNA, 19 bp, Mus musculus
gagagagagagagagagag

SEQ ID NO: 218020 - DNA, 23 bp, Mus musculus
attctcagcaaccacatgatggc

SEQ ID NO: 218021 - DNA, 21 bp, Mus musculus
tggctgactgagtgctggatg

SEQ ID NO: 218022 - DNA, 18 bp, Mus musculus
tgcactgagctgatgcag

SEQ ID NO: 218023 - DNA, 18 bp, Mus musculus
ttacttactttttgtaac

SEQ ID NO: 218024 - DNA, 20 bp, Mus musculus
tacacagaagaaactgagga

SEQ ID NO: 218025 - DNA, 22 bp, Mus musculus
tgttttgtgaccaattatatgg

SEQ ID NO: 218026 - DNA, 19 bp, Mus musculus
tctgcacgctctcactgcc

SEQ ID NO: 218027 - DNA, 23 bp, Mus musculus
actctgggtgacatcattcccta

SEQ ID NO: 218028 - DNA, 21 bp, Mus musculus
tgcttaactgttccctagggt

SEQ ID NO: 218029 - DNA, 23 bp, Mus musculus
tgactctgacaggtaaaacagtg

SEQ ID NO: 218030 - DNA, 20 bp, Mus musculus
atgtatgtatgtatgtgtat

SEQ ID NO: 218031 - DNA, 23 bp, Mus musculus
gtgtgtgcctgagactctcacac

SEQ ID NO: 218032 - DNA, 23 bp, Mus musculus
aggttgatatgtattgtagtatg

SEQ ID NO: 218033 - DNA, 21 bp, Mus musculus
attaggataatatgtggggtg

SEQ ID NO: 218034 - DNA, 21 bp, Mus musculus
tccatggtggtctgataggat

SEQ ID NO: 218035 - DNA, 22 bp, Mus musculus
atgtatgtgcatgtattgggta

SEQ ID NO: 218036 - DNA, 23 bp, Mus musculus
ttcctcactgtgacacttcaagg

SEQ ID NO: 218037 - DNA, 23 bp, Mus musculus
gtatatgtgtatatgtatatatg

SEQ ID NO: 218038 - DNA, 20 bp, Mus musculus
actcagccagactcagtccc

SEQ ID NO: 218039 - DNA, 18 bp, Mus musculus
atgtatatatatatatgt

SEQ ID NO: 218040 - DNA, 21 bp, Mus musculus
atagctgctgatagagaagaa

SEQ ID NO: 218041 - DNA, 23 bp, Mus musculus
ttgctgtctgtctgcctgtctct

SEQ ID NO: 218042 - DNA, 23 bp, Mus musculus
aatttcactcggtgactcacagg

SEQ ID NO: 218043 - DNA, 19 bp, Mus musculus
tatgtacacacacacacac

SEQ ID NO: 218044 - DNA, 23 bp, Mus musculus
acactcactctgagcctgtgttc

SEQ ID NO: 218045 - DNA, 22 bp, Mus musculus
tgttttgtgaccaattatatgg

SEQ ID NO: 218046 - DNA, 23 bp, Mus musculus
acatatatagtattctaaacatg

SEQ ID NO: 218047 - DNA, 22 bp, Mus musculus
tatgtatgtatgtatgtatgta

SEQ ID NO: 218048 - DNA, 20 bp, Mus musculus
tgtgtatgtatgatgtatgt

SEQ ID NO: 218049 - DNA, 23 bp, Mus musculus
actctttggttatgattctgtag

SEQ ID NO: 218050 - DNA, 23 bp, Mus musculus
atgccagactactgtctcagtca

SEQ ID NO: 218051 - DNA, 22 bp, Mus musculus
tgttttgtgaccaattatatgg

SEQ ID NO: 218052 - DNA, 21 bp, Mus musculus
cttctggtagatttgagtata

SEQ ID NO: 218053 - DNA, 20 bp, Mus musculus
tctcttaagtcactatgatc

SEQ ID NO: 218054 - DNA, 18 bp, Mus musculus
gaagtatctctgtctttt

SEQ ID NO: 218055 - DNA, 23 bp, Mus musculus
tgaaacttggtctccatgtggat

SEQ ID NO: 218056 - DNA, 22 bp, Mus musculus
ttatgggacagtgagtaggcac

SEQ ID NO: 218057 - DNA, 21 bp, Mus musculus
acacagaagaataagttgtga

SEQ ID NO: 218058 - DNA, 21 bp, Mus musculus
ataaagctagattagaaaaca

SEQ ID NO: 218059 - DNA, 21 bp, Mus musculus
taagtcctaggtatgggaatg

SEQ ID NO: 218060 - DNA, 23 bp, Mus musculus
tctgtgtgcctctctctgtgtgt

SEQ ID NO: 218061 - DNA, 23 bp, Mus musculus
ttcatgaacattggatttcatct

SEQ ID NO: 218062 - DNA, 22 bp, Mus musculus
ttacagcacctgattaggctca

SEQ ID NO: 218063 - DNA, 20 bp, Mus musculus
tctctgtgagtcaaagttca

SEQ ID NO: 218064 - DNA, 18 bp, Mus musculus
aagagagtacttccttgg

SEQ ID NO: 218065 - DNA, 23 bp, Mus musculus
atctctgtctgtctgactccctc

SEQ ID NO: 218066 - DNA, 23 bp, Mus musculus
gctgttctctatgctttgctttg

SEQ ID NO: 218067 - DNA, 21 bp, Mus musculus
agcttcttgatgtgtccgttt

SEQ ID NO: 218068 - DNA, 23 bp, Mus musculus
tctgtgtctcattctctctactg

SEQ ID NO: 218069 - DNA, 23 bp, Mus musculus
tatacacataatatatatgtgtg

SEQ ID NO: 218070 - DNA, 23 bp, Mus musculus
tattttctatatatgtaaaggta

SEQ ID NO: 218071 - DNA, 23 bp, Mus musculus
agatgagtaaagttcaagtagca

SEQ ID NO: 218072 - DNA, 21 bp, Mus musculus
gtctctctatgtatcactgtc

SEQ ID NO: 218073 - DNA, 19 bp, Mus musculus
taaatgtatatgaatatgt

SEQ ID NO: 218074 - DNA, 23 bp, Mus musculus
tatgtatgtctttgtgtatgtgt

SEQ ID NO: 218075 - DNA, 23 bp, Mus musculus
gaagtgcttgactattgcattgt

SEQ ID NO: 218076 - DNA, 23 bp, Mus musculus
tgactccttcactcagtgtctgc

SEQ ID NO: 218077 - DNA, 23 bp, Mus musculus
taatagtgtctggttttggtgcc

SEQ ID NO: 218078 - DNA, 23 bp, Mus musculus
tcactgaacatagagaggtcaag

SEQ ID NO: 218079 - DNA, 21 bp, Mus musculus
acagaggttttactcctgtgt

SEQ ID NO: 218080 - DNA, 20 bp, Mus musculus
ctagtctctttggtttggat

SEQ ID NO: 218081 - DNA, 22 bp, Mus musculus
tatgtatacatatatgtgtgtg

SEQ ID NO: 218082 - DNA, 23 bp, Mus musculus
actctgcatatatatacatatat

SEQ ID NO: 218083 - DNA, 23 bp, Mus musculus
tatgcatatatatgcataaatgt

SEQ ID NO: 218084 - DNA, 21 bp, Mus musculus
tcagatgtggggttagtgaag

SEQ ID NO: 218085 - DNA, 19 bp, Mus musculus
agatgtttatttcattatc

SEQ ID NO: 218086 - DNA, 23 bp, Mus musculus
aaggagcagatgatcctgtacaa

SEQ ID NO: 218087 - DNA, 22 bp, Mus musculus
aggagtctgatatagctgtctc

SEQ ID NO: 218088 - DNA, 23 bp, Mus musculus
tgagaggctctgtcagtgcctga

SEQ ID NO: 218089 - DNA, 22 bp, Mus musculus
tcacttgagattttgatcttaa

SEQ ID NO: 218090 - DNA, 23 bp, Mus musculus
tctgtctgtgtattggaatgtct

SEQ ID NO: 218091 - DNA, 21 bp, Mus musculus
tctctctgtattattctgtat

SEQ ID NO: 218092 - DNA, 23 bp, Mus musculus
acatatatactgaggaagaggat

SEQ ID NO: 218093 - DNA, 22 bp, Mus musculus
tgttttgtgaccaattatatgg

SEQ ID NO: 218094 - DNA, 23 bp, Mus musculus
tgtctatctacatgtgcatggta

SEQ ID NO: 218095 - DNA, 23 bp, Mus musculus
gagtgtgtcactgtgtgtgtcgg

SEQ ID NO: 218096 - DNA, 23 bp, Mus musculus
ctgtgagtctctgtcagtgcctg

SEQ ID NO: 218097 - DNA, 23 bp, Mus musculus
tatgtgtatgtatatgtatatat

SEQ ID NO: 218098 - DNA, 23 bp, Mus musculus
tgggtgagatgtgtatatgcaca

SEQ ID NO: 218099 - DNA, 23 bp, Mus musculus
attccctctggttatctttattt

SEQ ID NO: 218100 - DNA, 22 bp, Mus musculus
agagagaactgagagaggacaa

SEQ ID NO: 218101 - DNA, 23 bp, Mus musculus
ggttttgatgttctctaggtttg

SEQ ID NO: 218102 - DNA, 22 bp, Mus musculus
tgttttgtgaccaattatatgg

SEQ ID NO: 218103 - DNA, 23 bp, Mus musculus
tgtcagaactgagataggcaaag

SEQ ID NO: 218104 - DNA, 23 bp, Mus musculus
actgactgtttcactctgacagt

SEQ ID NO: 218105 - DNA, 23 bp, Mus musculus
atctttgttcatttaggaaagct

SEQ ID NO: 218106 - DNA, 20 bp, Mus musculus
ctttgagtcagatgttacca

SEQ ID NO: 218107 - DNA, 23 bp, Mus musculus
ttggttgtggatgagtttaccac

SEQ ID NO: 218108 - DNA, 23 bp, Mus musculus
gtcacttgtctttctctgtctga

SEQ ID NO: 218109 - DNA, 22 bp, Mus musculus
taaggtgagtggctgaaaacag

SEQ ID NO: 218110 - DNA, 22 bp, Mus musculus
tgttttgtgaccaattatatgg

SEQ ID NO: 218111 - DNA, 19 bp, Mus musculus
aagacagaaaatagatagc

SEQ ID NO: 218112 - DNA, 21 bp, Mus musculus
atgtatgtatgtatgtgtata

SEQ ID NO: 218113 - DNA, 20 bp, Mus musculus
atgcttgcttgtgttggcca

SEQ ID NO: 218114 - DNA, 22 bp, Mus musculus
tgttttgtgaccaattatatgg

SEQ ID NO: 218115 - DNA, 21 bp, Mus musculus
attacaggagtgtgtcagcac

SEQ ID NO: 218116 - DNA, 23 bp, Mus musculus
tctgaaggtggttcgtagaagaa

SEQ ID NO: 218117 - DNA, 21 bp, Mus musculus
gctttgaaatgaagaatgttt

SEQ ID NO: 218118 - DNA, 22 bp, Mus musculus
tttttattgctattgaacatgt

SEQ ID NO: 218119 - DNA, 23 bp, Mus musculus
gggtctgttctgtgtgtctgagg

SEQ ID NO: 218120 - DNA, 18 bp, Mus musculus
aaagtctcagcttgggtt

SEQ ID NO: 218121 - DNA, 23 bp, Mus musculus
acagaaaagtgagagctcaaatg

SEQ ID NO: 218122 - DNA, 23 bp, Mus musculus
ctcagtgtctgtccctcacttct

SEQ ID NO: 218123 - DNA, 22 bp, Mus musculus
tatgtgcactgtgtacatgcag

SEQ ID NO: 218124 - DNA, 18 bp, Mus musculus
tgctgacagaaattcctg

SEQ ID NO: 218125 - DNA, 22 bp, Mus musculus
tgttttgtgaccaattatatgg

SEQ ID NO: 218126 - DNA, 22 bp, Mus musculus
tgttttgtgaccaattatatgg

SEQ ID NO: 218127 - DNA, 23 bp, Mus musculus
caactgtttgtgtaagctttctg

SEQ ID NO: 218128 - DNA, 23 bp, Mus musculus
tacatgtatatgtgtatacgtgt

SEQ ID NO: 218129 - DNA, 23 bp, Mus musculus
tatagcatgataagacaatttat

SEQ ID NO: 218130 - DNA, 20 bp, Mus musculus
atatcattgaataatatggt

SEQ ID NO: 218131 - DNA, 23 bp, Mus musculus
actgtctctgtttagtttctgtt

SEQ ID NO: 218132 - DNA, 18 bp, Mus musculus
tgctgttgtaggattact

SEQ ID NO: 218133 - DNA, 23 bp, Mus musculus
cctagcttttgtagttttatttt

SEQ ID NO: 218134 - DNA, 23 bp, Mus musculus
actcagtctgtgaatgatgactg

SEQ ID NO: 218135 - DNA, 23 bp, Mus musculus
tagtccatggtgatctgatagga

SEQ ID NO: 218136 - DNA, 22 bp, Mus musculus
catgcttgttttgtgtccaaat

SEQ ID NO: 218137 - DNA, 23 bp, Mus musculus
aaacatgtatatgaagggaattt

SEQ ID NO: 218138 - DNA, 23 bp, Mus musculus
ctatgacttgtgtttttgatctt

SEQ ID NO: 218139 - DNA, 21 bp, Mus musculus
tatgtcaatatatatttttga

SEQ ID NO: 218140 - DNA, 23 bp, Mus musculus
tctatgtcaatatgtatttttga

SEQ ID NO: 218141 - DNA, 22 bp, Mus musculus
tatgtcaatatatatttttgac

SEQ ID NO: 218142 - DNA, 23 bp, Mus musculus
aggttctgaatttctaaatctga

SEQ ID NO: 218143 - DNA, 23 bp, Mus musculus
tatatgttacatatgtatatata

SEQ ID NO: 218144 - DNA, 21 bp, Mus musculus
tcactctcagagattttagca

SEQ ID NO: 218145 - DNA, 20 bp, Mus musculus
tatgtatgtatgtatgtatg

SEQ ID NO: 218146 - DNA, 21 bp, Mus musculus
atatgtgtatatgaatatgac

SEQ ID NO: 218147 - DNA, 22 bp, Mus musculus
tgttttgtgaccaattatatgg

SEQ ID NO: 218148 - DNA, 22 bp, Mus musculus
ataaggaagtatatgcaatcat

SEQ ID NO: 218149 - DNA, 23 bp, Mus musculus
tatatgaacaggcaaagtgctct

SEQ ID NO: 218150 - DNA, 21 bp, Mus musculus
agtgcttctgttgcagtttga

SEQ ID NO: 218151 - DNA, 21 bp, Mus musculus
attcttctggtattttattgt

SEQ ID NO: 218152 - DNA, 23 bp, Mus musculus
agagagacagatgtgtgtgagca

SEQ ID NO: 218153 - DNA, 22 bp, Mus musculus
tgttttgtgaccaattatatgg

SEQ ID NO: 218154 - DNA, 22 bp, Mus musculus
atgtatgtatatatatgtgtgt

SEQ ID NO: 218155 - DNA, 23 bp, Mus musculus
tgtatacacacacacatatatat

SEQ ID NO: 218156 - DNA, 22 bp, Mus musculus
tgttttgtgaccaattatatgg

SEQ ID NO: 218157 - DNA, 23 bp, Mus musculus
ttagcttgatctagtgcaggtct

SEQ ID NO: 218158 - DNA, 23 bp, Mus musculus
ataatagaaaggaaatgaacaga

SEQ ID NO: 218159 - DNA, 22 bp, Mus musculus
tgttttgtgaccaattatatgg

SEQ ID NO: 218160 - DNA, 23 bp, Mus musculus
ctgtgtctctgtttagtttctgt

SEQ ID NO: 218161 - DNA, 23 bp, Mus musculus
gtgaaccaataggaactcataga

SEQ ID NO: 218162 - DNA, 23 bp, Mus musculus
ctttgacttgtgactttgattta

SEQ ID NO: 218163 - DNA, 22 bp, Mus musculus
tgactttaaatataaaagagat

SEQ ID NO: 218164 - DNA, 21 bp, Mus musculus
tcagtcccactgtgactcggt

SEQ ID NO: 218165 - DNA, 23 bp, Mus musculus
tctgtgtgtgtctgtctgtctgt

SEQ ID NO: 218166 - DNA, 23 bp, Mus musculus
aacagcagcagacagtgagaaca

SEQ ID NO: 218167 - DNA, 23 bp, Mus musculus
tatttacatatgtaatgtattcg

SEQ ID NO: 218168 - DNA, 22 bp, Mus musculus
tgttttgtgaccaattatatgg

SEQ ID NO: 218169 - DNA, 22 bp, Mus musculus
tgttttgtgaccaattatatgg

SEQ ID NO: 218170 - DNA, 23 bp, Mus musculus
tctctatgtgtcatttacttggg

SEQ ID NO: 218171 - DNA, 23 bp, Mus musculus
actctgaaagtcactgaaccaat

SEQ ID NO: 218172 - DNA, 23 bp, Mus musculus
actgtgtctctgtttagtttctg

SEQ ID NO: 218173 - DNA, 22 bp, Mus musculus
agagagaactcagtcagcagaa

SEQ ID NO: 218174 - DNA, 21 bp, Mus musculus
acacaagcttgaggactgagt

SEQ ID NO: 218175 - DNA, 21 bp, Mus musculus
ctcagtggttaagagcactgc

SEQ ID NO: 218176 - DNA, 21 bp, Mus musculus
cctgagttcaattccagcaaa

SEQ ID NO: 218177 - DNA, 23 bp, Mus musculus
ttaagggactaaatgattggtta

SEQ ID NO: 218178 - DNA, 19 bp, Mus musculus
tattttgtttcttaaactt

SEQ ID NO: 218179 - DNA, 23 bp, Mus musculus
agtctctgtcagtgagttcactc

SEQ ID NO: 218180 - DNA, 23 bp, Mus musculus
gtacactgaatagagcaatgggg

SEQ ID NO: 218181 - DNA, 23 bp, Mus musculus
ctttcccactgtctgcattcctt

SEQ ID NO: 218182 - DNA, 19 bp, Mus musculus
ttgttctggtcattgctat

SEQ ID NO: 218183 - DNA, 23 bp, Mus musculus
tctaaagtaatgtgctaggacat

SEQ ID NO: 218184 - DNA, 23 bp, Mus musculus
atgtgtgttgtaaagaagtccta

SEQ ID NO: 218185 - DNA, 23 bp, Mus musculus
tctatagtaagttgtattgttct

SEQ ID NO: 218186 - DNA, 23 bp, Mus musculus
tagtcttactgcatgttgatgtg

SEQ ID NO: 218187 - DNA, 23 bp, Mus musculus
gttacctcactcagtatgatatt

SEQ ID NO: 218188 - DNA, 23 bp, Mus musculus
tgagttttcctcatctgcaggtg

SEQ ID NO: 218189 - DNA, 23 bp, Mus musculus
gaaacagatgtgtttaaggtaac

SEQ ID NO: 218190 - DNA, 21 bp, Mus musculus
cagactgaagactgagaggac

SEQ ID NO: 218191 - DNA, 22 bp, Mus musculus
tgttttgtgaccaattatatgg

SEQ ID NO: 218192 - DNA, 23 bp, Mus musculus
tttacactgttaaagctagcaca

SEQ ID NO: 218193 - DNA, 19 bp, Mus musculus
tgtatatgtgtatatgtgt

SEQ ID NO: 218194 - DNA, 22 bp, Mus musculus
tatgtgtatatatgtatatgtg

SEQ ID NO: 218195 - DNA, 23 bp, Mus musculus
tatgcatatatgtatgtatgtat

SEQ ID NO: 218196 - DNA, 22 bp, Mus musculus
tttcagcatgatgatagttcct

SEQ ID NO: 218197 - DNA, 22 bp, Mus musculus
gctagaccaggcagtgctctgt

SEQ ID NO: 218198 - DNA, 21 bp, Mus musculus
tcagcctgtgtatcctgcctg

SEQ ID NO: 218199 - DNA, 18 bp, Mus musculus
taagtgaaaatgtatctg

SEQ ID NO: 218200 - DNA, 22 bp, Mus musculus
agacatctacatatatacatgt

SEQ ID NO: 218201 - DNA, 23 bp, Mus musculus
atatgtatatatgtatgtgtgtg

SEQ ID NO: 218202 - DNA, 23 bp, Mus musculus
taagacagtgctgagagtgtaga

SEQ ID NO: 218203 - DNA, 22 bp, Mus musculus
atatgtaagtgtgtatgtgtac

SEQ ID NO: 218204 - DNA, 23 bp, Mus musculus
tatgtgtgtgtatatgtatgtgt

SEQ ID NO: 218205 - DNA, 23 bp, Mus musculus
gtctgtctgtctgtctgttttgt

SEQ ID NO: 218206 - DNA, 23 bp, Mus musculus
gagggagaattgtagaacagctt

SEQ ID NO: 218207 - DNA, 23 bp, Mus musculus
tgagtcctgttctgtgaccaatt

SEQ ID NO: 218208 - DNA, 22 bp, Mus musculus
tgatgaagaatgttatatgtgt

SEQ ID NO: 218209 - DNA, 22 bp, Mus musculus
tgttttgtgaccaattatatgg

SEQ ID NO: 218210 - DNA, 23 bp, Mus musculus
taacctagttcattgtaggttta

SEQ ID NO: 218211 - DNA, 19 bp, Mus musculus
tatgcatatatatgcaaat

SEQ ID NO: 218212 - DNA, 22 bp, Mus musculus
aatgcatatgtgtgtgtataca

SEQ ID NO: 218213 - DNA, 20 bp, Mus musculus
tgtatggcttttacatgtgt

SEQ ID NO: 218214 - DNA, 22 bp, Mus musculus
tacctcaaatgttgaaatgagg

SEQ ID NO: 218215 - DNA, 23 bp, Mus musculus
tttattgttcttctctatgcttt

SEQ ID NO: 218216 - DNA, 23 bp, Mus musculus
tatatgtgcagatatatgtataa

SEQ ID NO: 218217 - DNA, 23 bp, Mus musculus
atatgtgtttgtatcttcatgta

SEQ ID NO: 218218 - DNA, 22 bp, Mus musculus
tgttttgtgaccaattatatgg

SEQ ID NO: 218219 - DNA, 23 bp, Mus musculus
gacacacttcagcttccacaagt

SEQ ID NO: 218220 - DNA, 20 bp, Mus musculus
tctgagggaagggagttgga

SEQ ID NO: 218221 - DNA, 23 bp, Mus musculus
tagaagtttcttggtttctgact

SEQ ID NO: 218222 - DNA, 21 bp, Mus musculus
atgtatatatatatatgtgtg

SEQ ID NO: 218223 - DNA, 21 bp, Mus musculus
tatacatacatatacgtatgt

SEQ ID NO: 218224 - DNA, 23 bp, Mus musculus
atgtgacttgttagctttgttat

SEQ ID NO: 218225 - DNA, 23 bp, Mus musculus
gatatgttttgtagcacatatgg

SEQ ID NO: 218226 - DNA, 18 bp, Mus musculus
taccaagatgtaagttat

SEQ ID NO: 218227 - DNA, 23 bp, Mus musculus
atgtgtgtagatgtgcttgtgga

SEQ ID NO: 218228 - DNA, 23 bp, Mus musculus
tgtgcatatgtatgcatatgtgt

SEQ ID NO: 218229 - DNA, 23 bp, Mus musculus
tctctctctgtttcagtttaacc

SEQ ID NO: 218230 - DNA, 23 bp, Mus musculus
tatgcatgtatatatctatgtat

SEQ ID NO: 218231 - DNA, 23 bp, Mus musculus
tgtgctttgcagtttgattcctg

SEQ ID NO: 218232 - DNA, 20 bp, Mus musculus
tctgtgtgtatgtgcatgtt

SEQ ID NO: 218233 - DNA, 23 bp, Mus musculus
tagtgcatggtgatctgatagga

SEQ ID NO: 218234 - DNA, 22 bp, Mus musculus
tgttttgtgacctattatgtgg

SEQ ID NO: 218235 - DNA, 22 bp, Mus musculus
tgttttgtgaccaattatatgg

SEQ ID NO: 218236 - DNA, 22 bp, Mus musculus
tgttttgtgaccaattatatgg

SEQ ID NO: 218237 - DNA, 23 bp, Mus musculus
attcctgagtgattcatgtctga

SEQ ID NO: 218238 - DNA, 22 bp, Mus musculus
tgttttgtgaccaattatatgg

SEQ ID NO: 218239 - DNA, 21 bp, Mus musculus
ttaatacagagaaaatgttat

SEQ ID NO: 218240 - DNA, 23 bp, Mus musculus
tctcagaacagtgtcaggattct

SEQ ID NO: 218241 - DNA, 22 bp, Mus musculus
tgttttgtgaccaattatatgg

SEQ ID NO: 218242 - DNA, 22 bp, Mus musculus
aaaattcatgattttggaggca

SEQ ID NO: 218243 - DNA, 23 bp, Mus musculus
tgtgtctctgtgtgtatgtgcgt

SEQ ID NO: 218244 - DNA, 18 bp, Mus musculus
tatatgtatataacattt

SEQ ID NO: 218245 - DNA, 23 bp, Mus musculus
aggctgtagcttgattagtagag

SEQ ID NO: 218246 - DNA, 23 bp, Mus musculus
aacactgtttacattctcgctct

SEQ ID NO: 218247 - DNA, 23 bp, Mus musculus
atgtgtatgtgctagtgcatgtg

SEQ ID NO: 218248 - DNA, 21 bp, Mus musculus
ttcaggacatagttcatggaa

SEQ ID NO: 218249 - DNA, 23 bp, Mus musculus
attttagctgtactagggtttct

SEQ ID NO: 218250 - DNA, 23 bp, Mus musculus
gtatgtgtgtgtgtatatgcaca

SEQ ID NO: 218251 - DNA, 21 bp, Mus musculus
atgtatgtatgcatgtgtgtg

SEQ ID NO: 218252 - DNA, 21 bp, Mus musculus
ttagctcatgttcttttccat

SEQ ID NO: 218253 - DNA, 21 bp, Mus musculus
aatgagcatcacaatacttag

SEQ ID NO: 218254 - DNA, 22 bp, Mus musculus
tgttttgtgaccaattatatgg

SEQ ID NO: 218255 - DNA, 23 bp, Mus musculus
ccattatgatgataatggattga

SEQ ID NO: 218256 - DNA, 22 bp, Mus musculus
tggttgactactgttgctgctg

SEQ ID NO: 218257 - DNA, 22 bp, Mus musculus
tatatatgtgtgtgtgtataca

SEQ ID NO: 218258 - DNA, 23 bp, Mus musculus
aaactctggatatgactgagaga

SEQ ID NO: 218259 - DNA, 23 bp, Mus musculus
acacacacatatatactgtgtgt

SEQ ID NO: 218260 - DNA, 22 bp, Mus musculus
tatgtatatggatgtgtatatg

SEQ ID NO: 218261 - DNA, 22 bp, Mus musculus
tgtttcagcaagtccttgagag

SEQ ID NO: 218262 - DNA, 22 bp, Mus musculus
tgttttgtgaccaattatatgg

SEQ ID NO: 218263 - DNA, 22 bp, Mus musculus
tgttttgtgaccaattatatgg

SEQ ID NO: 218264 - DNA, 21 bp, Mus musculus
gtttctggttagaatttcact

SEQ ID NO: 218265 - DNA, 20 bp, Mus musculus
gcagaggcagatataggtga

SEQ ID NO: 218266 - DNA, 18 bp, Mus musculus
ctactgactcagtaagtt

SEQ ID NO: 218267 - DNA, 23 bp, Mus musculus
tgtatatgtatatgtatatgtat

SEQ ID NO: 218268 - DNA, 19 bp, Mus musculus
ctttcatgatttacgtgta

SEQ ID NO: 218269 - DNA, 22 bp, Mus musculus
atactccataaagtttgtggct

SEQ ID NO: 218270 - DNA, 23 bp, Mus musculus
tagtgctacattacatgtgtgaa

SEQ ID NO: 218271 - DNA, 23 bp, Mus musculus
cacatgcacatacacactctgga

SEQ ID NO: 218272 - DNA, 22 bp, Mus musculus
cagtcttaggccatggtggtct

SEQ ID NO: 218273 - DNA, 23 bp, Mus musculus
tgtctctctgtctgtctataggc

SEQ ID NO: 218274 - DNA, 21 bp, Mus musculus
tcagacctaagtgttcacact

SEQ ID NO: 218275 - DNA, 22 bp, Mus musculus
ttcctccataaaaattgataat

SEQ ID NO: 218276 - DNA, 23 bp, Mus musculus
atgtgtgtgtgtatatgatgtat

SEQ ID NO: 218277 - DNA, 22 bp, Mus musculus
tgtatatatatgatgtatatgt

SEQ ID NO: 218278 - DNA, 23 bp, Mus musculus
gagttgtactgggtatggttaca

SEQ ID NO: 218279 - DNA, 23 bp, Mus musculus
attgtgactgtatggtgtgattt

SEQ ID NO: 218280 - DNA, 21 bp, Mus musculus
cagcagcatataaatgctctt

SEQ ID NO: 218281 - DNA, 23 bp, Mus musculus
tgtttaattgttcatttaccgtg

SEQ ID NO: 218282 - DNA, 22 bp, Mus musculus
tcgtagactagagttaatgatg

SEQ ID NO: 218283 - DNA, 20 bp, Mus musculus
aatttctcaggcattgatgt

SEQ ID NO: 218284 - DNA, 18 bp, Mus musculus
actacaagtttatcccta

SEQ ID NO: 218285 - DNA, 23 bp, Mus musculus
tgcctctgtgtgtcattgtctga

SEQ ID NO: 218286 - DNA, 19 bp, Mus musculus
ttcaatcagtgcatgaggt

SEQ ID NO: 218287 - DNA, 19 bp, Mus musculus
aagacctagctcagctgct

SEQ ID NO: 218288 - DNA, 23 bp, Mus musculus
ttgtcacttcagtatctgtgagc

SEQ ID NO: 218289 - DNA, 23 bp, Mus musculus
tctgtgactcctttggatttgtt

SEQ ID NO: 218290 - DNA, 18 bp, Mus musculus
gtatatatttatgtatgc

SEQ ID NO: 218291 - DNA, 20 bp, Mus musculus
atatgtatgcatatatgtgg

SEQ ID NO: 218292 - DNA, 19 bp, Mus musculus
ttaaaaacttttggatcgt

SEQ ID NO: 218293 - DNA, 20 bp, Mus musculus
tgagacgatgcccattgaca

SEQ ID NO: 218294 - DNA, 23 bp, Mus musculus
aaacccgtagatccgatcttgtg

SEQ ID NO: 218295 - DNA, 23 bp, Mus musculus
gtctgtggcagtgtggtgatctg

SEQ ID NO: 218296 - DNA, 22 bp, Mus musculus
tgaggtagtaggttgtatggtt

SEQ ID NO: 218297 - DNA, 20 bp, Mus musculus
gcgctctgagtcagcatcag

SEQ ID NO: 218298 - DNA, 23 bp, Mus musculus
tccctgagaccctaacttgtgag

SEQ ID NO: 218299 - DNA, 18 bp, Mus musculus
tcacaagtcaggttcttg

SEQ ID NO: 218300 - DNA, 22 bp, Mus musculus
tttgttgggacagtctctcact

SEQ ID NO: 218301 - DNA, 23 bp, Mus musculus
tgtgtatatgtatacatatgtgt

SEQ ID NO: 218302 - DNA, 23 bp, Mus musculus
agatgtcttatttaatcactttc

SEQ ID NO: 218303 - DNA, 23 bp, Mus musculus
ctagtgagtctgactaagggttt

SEQ ID NO: 218304 - DNA, 23 bp, Mus musculus
tttcagaacagactgagcacaga

SEQ ID NO: 218305 - DNA, 22 bp, Mus musculus
atatatgtatgtatgtatatgt

SEQ ID NO: 218306 - DNA, 20 bp, Mus musculus
tgtgtacatacatgtgtgtg

SEQ ID NO: 218307 - DNA, 23 bp, Mus musculus
ctctgactgtcacttcagtctct

SEQ ID NO: 218308 - DNA, 23 bp, Mus musculus
tcacagcctctgtggttgcctgc

SEQ ID NO: 218309 - DNA, 23 bp, Mus musculus
tatgaggtagatccagttgtgac

SEQ ID NO: 218310 - DNA, 20 bp, Mus musculus
cagagtcaacagttgcttgc

SEQ ID NO: 218311 - DNA, 18 bp, Mus musculus
actggagagatggctcag

SEQ ID NO: 218312 - DNA, 21 bp, Mus musculus
atgtgcatgtgcaagtgcatg

SEQ ID NO: 218313 - DNA, 22 bp, Mus musculus
tgttttgtgaccaattatatgg

SEQ ID NO: 218314 - DNA, 22 bp, Mus musculus
tgtgtgtatatatgtatatacg

SEQ ID NO: 218315 - DNA, 23 bp, Mus musculus
ttttggaatacttttctattcaa

SEQ ID NO: 218316 - DNA, 22 bp, Mus musculus
tgttttgtgaccaattatatgg

SEQ ID NO: 218317 - DNA, 21 bp, Mus musculus
agtatgacattctggatcaga

SEQ ID NO: 218318 - DNA, 23 bp, Mus musculus
ctctgtatgtatatctatgtgta

SEQ ID NO: 218319 - DNA, 22 bp, Mus musculus
aagcagcattgttagattgtac

SEQ ID NO: 218320 - DNA, 22 bp, Mus musculus
agagatgtgtcatgtaggtctg

SEQ ID NO: 218321 - DNA, 23 bp, Mus musculus
ccatatgtatatatgaatatgta

SEQ ID NO: 218322 - DNA, 23 bp, Mus musculus
atatatgtgtttatgaatatgag

SEQ ID NO: 218323 - DNA, 22 bp, Mus musculus
tgacatcaagactgacagttga

SEQ ID NO: 218324 - DNA, 18 bp, Mus musculus
gcacacacacacacacac

SEQ ID NO: 218325 - DNA, 23 bp, Mus musculus
acgtgtgtgtgtgtattctgtat

SEQ ID NO: 218326 - DNA, 20 bp, Mus musculus
atgcgtatgtacatgtatgt

SEQ ID NO: 218327 - DNA, 23 bp, Mus musculus
tgtatatgtgttgtatatatgta

SEQ ID NO: 218328 - DNA, 23 bp, Mus musculus
tgtgtatctatttgtctctatat

SEQ ID NO: 218329 - DNA, 23 bp, Mus musculus
gtgtgtgtctgtgtgtgtatgta

SEQ ID NO: 218330 - DNA, 23 bp, Mus musculus
tgtgtgtgtatgtatatgtgtgt

SEQ ID NO: 218331 - DNA, 22 bp, Mus musculus
tgttttgtgaccaattatatgg

SEQ ID NO: 218332 - DNA, 23 bp, Mus musculus
ttctgtagtgagagagctgatga

SEQ ID NO: 218333 - DNA, 22 bp, Mus musculus
atacacacttaggtctgtctga

SEQ ID NO: 218334 - DNA, 23 bp, Mus musculus
tgtatgtgtgcatgtgtatgtgc

SEQ ID NO: 218335 - DNA, 23 bp, Mus musculus
tgtgcatgcatgtgtgtgacatg

SEQ ID NO: 218336 - DNA, 22 bp, Mus musculus
tgttttgtgaccaattatatgg

SEQ ID NO: 218337 - DNA, 21 bp, Mus musculus
cagagaagagtcagaggagag

SEQ ID NO: 218338 - DNA, 18 bp, Mus musculus
tttccctctgataggctc

SEQ ID NO: 218339 - DNA, 19 bp, Mus musculus
tacaccttggtcttcatgt

SEQ ID NO: 218340 - DNA, 22 bp, Mus musculus
tgactcagactgtgttgtctgc

SEQ ID NO: 218341 - DNA, 23 bp, Mus musculus
tttgtgaccaattatattgtcaa

SEQ ID NO: 218342 - DNA, 21 bp, Mus musculus
atgtgctttaactatgtgaat

SEQ ID NO: 218343 - DNA, 23 bp, Mus musculus
atatgtatatatacatatgtatg

SEQ ID NO: 218344 - DNA, 23 bp, Mus musculus
acatatgtgtatataggtgtatg

SEQ ID NO: 218345 - DNA, 23 bp, Mus musculus
agaagaaatcttatggttcacta

SEQ ID NO: 218346 - DNA, 20 bp, Mus musculus
tttcagaggacagccatgct

SEQ ID NO: 218347 - DNA, 23 bp, Mus musculus
gcgtgtgtgtgtgtgtgtctatg

SEQ ID NO: 218348 - DNA, 21 bp, Mus musculus
atctgcactgaatagttaggg

SEQ ID NO: 218349 - DNA, 23 bp, Mus musculus
taaaagtggtatttattatgtct

SEQ ID NO: 218350 - DNA, 22 bp, Mus musculus
tgttttgtgaccaattatatgg

SEQ ID NO: 218351 - DNA, 21 bp, Mus musculus
ggtaatctttggagtcagttg

SEQ ID NO: 218352 - DNA, 23 bp, Mus musculus
tatagttgtctctggttagagtt

SEQ ID NO: 218353 - DNA, 23 bp, Mus musculus
gactgactgactgattctctttt

SEQ ID NO: 218354 - DNA, 23 bp, Mus musculus
atgcatgtatatatgtatgtatg

SEQ ID NO: 218355 - DNA, 23 bp, Mus musculus
gtaaactgatttgatgctgtgag

SEQ ID NO: 218356 - DNA, 22 bp, Mus musculus
atagcataaggaattttttgct

SEQ ID NO: 218357 - DNA, 22 bp, Mus musculus
aactgcatcatgtcatgacaga

SEQ ID NO: 218358 - DNA, 20 bp, Mus musculus
agtggtgtttgaagactgag

SEQ ID NO: 218359 - DNA, 19 bp, Mus musculus
tcggggatttcattgccat

SEQ ID NO: 218360 - DNA, 20 bp, Mus musculus
tttagtgcatatgaacatgc

SEQ ID NO: 218361 - DNA, 22 bp, Mus musculus
ttaatgctaattgtgatagggg

SEQ ID NO: 218362 - DNA, 23 bp, Mus musculus
gactgactcctacctgttagcat

SEQ ID NO: 218363 - DNA, 20 bp, Mus musculus
tgtgtgtgtgtatatatata

SEQ ID NO: 218364 - DNA, 19 bp, Mus musculus
tgtgcatatatatgtatat

SEQ ID NO: 218365 - DNA, 22 bp, Mus musculus
aaagccagacgatcttatttgc

SEQ ID NO: 218366 - DNA, 21 bp, Mus musculus
atctttatttacaaggttttg

SEQ ID NO: 218367 - DNA, 23 bp, Mus musculus
ttttctctctgtcagttcttatt

SEQ ID NO: 218368 - DNA, 23 bp, Mus musculus
tagaactctgtcctagatctggc

SEQ ID NO: 218369 - DNA, 23 bp, Mus musculus
gaaatgtgacaggagtgactggt

SEQ ID NO: 218370 - DNA, 23 bp, Mus musculus
tctctgtgtatgtgtgtgttcgt

SEQ ID NO: 218371 - DNA, 19 bp, Mus musculus
agttgtgagctcattggat

SEQ ID NO: 218372 - DNA, 23 bp, Mus musculus
tatgtgcatatgtgaagttgttg

SEQ ID NO: 218373 - DNA, 19 bp, Mus musculus
acagcaggcatttcttggg

SEQ ID NO: 218374 - DNA, 22 bp, Mus musculus
cctgcaggtgtgttattgttgt

SEQ ID NO: 218375 - DNA, 22 bp, Mus musculus
tgttttgtgaccaattatatgg

SEQ ID NO: 218376 - DNA, 19 bp, Mus musculus
tgtatatgtgtatatgtgg

SEQ ID NO: 218377 - DNA, 22 bp, Mus musculus
atctatgtatatgtatgtgtgt

SEQ ID NO: 218378 - DNA, 21 bp, Mus musculus
tgtatatgtatggatgtgtgt

SEQ ID NO: 218379 - DNA, 21 bp, Mus musculus
tctatgtgtatgtatatgtgt

SEQ ID NO: 218380 - DNA, 23 bp, Mus musculus
tctgtatctgtctgagtcagctg

SEQ ID NO: 218381 - DNA, 23 bp, Mus musculus
tatgtgtgtgtatatgtatatat

SEQ ID NO: 218382 - DNA, 23 bp, Mus musculus
tagtctgagctggcttctgtggc

SEQ ID NO: 218383 - DNA, 18 bp, Mus musculus
cactagttgggttggaga

SEQ ID NO: 218384 - DNA, 19 bp, Mus musculus
cattttttgattgggttgt

SEQ ID NO: 218385 - DNA, 23 bp, Mus musculus
ggtgtgtctctctgtgtgtctga

SEQ ID NO: 218386 - DNA, 20 bp, Mus musculus
aaggacaacagtgtgggctc

SEQ ID NO: 218387 - DNA, 22 bp, Mus musculus
tatatcttaattttttaatgac

SEQ ID NO: 218388 - DNA, 20 bp, Mus musculus
agactgtagtcacagtgcag

SEQ ID NO: 218389 - DNA, 23 bp, Mus musculus
tgtgtgaatgtttgtatgtgtgt

SEQ ID NO: 218390 - DNA, 22 bp, Mus musculus
atgtatgtatgtatgtgtatgt

SEQ ID NO: 218391 - DNA, 23 bp, Mus musculus
tcactcacagtcttatgccagtg

SEQ ID NO: 218392 - DNA, 20 bp, Mus musculus
aagtatgaatatgtatgcat

SEQ ID NO: 218393 - DNA, 23 bp, Mus musculus
ttatgtgagtttatccatagtta

SEQ ID NO: 218394 - DNA, 23 bp, Mus musculus
aacatatgacaggatattagtga

SEQ ID NO: 218395 - DNA, 23 bp, Mus musculus
tggctgtgtctgaagacagctac

SEQ ID NO: 218396 - DNA, 23 bp, Mus musculus
atctgagttctttgtctgtcacc

SEQ ID NO: 218397 - DNA, 23 bp, Mus musculus
acagggaaagttatgacataggc

SEQ ID NO: 218398 - DNA, 23 bp, Mus musculus
ctgtgtctctgtgtctgtgtgtc

SEQ ID NO: 218399 - DNA, 18 bp, Mus musculus
tgtatatatatacacata

SEQ ID NO: 218400 - DNA, 23 bp, Mus musculus
catgtgtgtctgtgtgtgtatgc

SEQ ID NO: 218401 - DNA, 20 bp, Mus musculus
taatgtgtaatattatagct

SEQ ID NO: 218402 - DNA, 23 bp, Mus musculus
aatgagagtggtactatactcaa

SEQ ID NO: 218403 - DNA, 23 bp, Mus musculus
taggtacagttgttgctcttcat

SEQ ID NO: 218404 - DNA, 20 bp, Mus musculus
atatgtgtatatgcttatgt

SEQ ID NO: 218405 - DNA, 20 bp, Mus musculus
tgtgcatatgtatatatgta

SEQ ID NO: 218406 - DNA, 22 bp, Mus musculus
tatttctgtgtaatatatgtgt

SEQ ID NO: 218407 - DNA, 23 bp, Mus musculus
ttttagatacagttagatttgtc

SEQ ID NO: 218408 - DNA, 23 bp, Mus musculus
tgtatatatgtatgtatataaac

SEQ ID NO: 218409 - DNA, 23 bp, Mus musculus
cagaagagagagaggactgtagc

SEQ ID NO: 218410 - DNA, 22 bp, Mus musculus
tatgtatgtatgtatgtatgta

SEQ ID NO: 218411 - DNA, 20 bp, Mus musculus
tgtgtgtgtgtgtatatata

SEQ ID NO: 218412 - DNA, 20 bp, Mus musculus
acacacacacatatatatgt

SEQ ID NO: 218413 - DNA, 23 bp, Mus musculus
atatgtgtatatatatgtgtgtg

SEQ ID NO: 218414 - DNA, 23 bp, Mus musculus
catgctgcaggtgtgtgtgtgtg

SEQ ID NO: 218415 - DNA, 23 bp, Mus musculus
ttccttgtagaagcatgcatctt

SEQ ID NO: 218416 - DNA, 23 bp, Mus musculus
tcagagttgcagagtaaagtgaa

SEQ ID NO: 218417 - DNA, 22 bp, Mus musculus
aagatggagcagagactgagga

SEQ ID NO: 218418 - DNA, 23 bp, Mus musculus
ctgaggtagaaggatcagaagtt

SEQ ID NO: 218419 - DNA, 22 bp, Mus musculus
tgtgtgtgtcagagagagagag

SEQ ID NO: 218420 - DNA, 20 bp, Mus musculus
tcactcagtttctctctcct

SEQ ID NO: 218421 - DNA, 18 bp, Mus musculus
acatgcagatacagagtg

SEQ ID NO: 218422 - DNA, 20 bp, Mus musculus
agacacacagctatggtggt

SEQ ID NO: 218423 - DNA, 18 bp, Mus musculus
agttcctccttcagcctg

SEQ ID NO: 218424 - DNA, 23 bp, Mus musculus
aggaggtctgtctctgttagtca

SEQ ID NO: 218425 - DNA, 23 bp, Mus musculus
tgtctgtctgtctgtgcatttgc

SEQ ID NO: 218426 - DNA, 23 bp, Mus musculus
ctctgtctcacaggcatggtcat

SEQ ID NO: 218427 - DNA, 19 bp, Mus musculus
agagcattgtttggggaga

SEQ ID NO: 218428 - DNA, 23 bp, Mus musculus
atgtgcttgtgagcatgtgcatg

SEQ ID NO: 218429 - DNA, 23 bp, Mus musculus
aagagcactgactgctcttccag

SEQ ID NO: 218430 - DNA, 22 bp, Mus musculus
ttactggatccttggatcttct

SEQ ID NO: 218431 - DNA, 23 bp, Mus musculus
gtgtagtcagagatgactgtgaa

SEQ ID NO: 218432 - DNA, 20 bp, Mus musculus
tgtgtggctctctctcactt

SEQ ID NO: 218433 - DNA, 21 bp, Mus musculus
tgagagaggagagagagcttg

SEQ ID NO: 218434 - DNA, 20 bp, Mus musculus
ctgcactgctaaattgtctg

SEQ ID NO: 218435 - DNA, 22 bp, Mus musculus
agacaggcactgcttttgttgt

SEQ ID NO: 218436 - DNA, 23 bp, Mus musculus
atgtatgtatatatgtgtgtgta

SEQ ID NO: 218437 - DNA, 22 bp, Mus musculus
atgtgtatatgtatatgtgtct

SEQ ID NO: 218438 - DNA, 18 bp, Mus musculus
cagaggtcctgagttcaa

SEQ ID NO: 218439 - DNA, 23 bp, Mus musculus
cacaactgacactctcacagtcc

SEQ ID NO: 218440 - DNA, 19 bp, Mus musculus
agagcactgactgctcttc

SEQ ID NO: 218441 - DNA, 23 bp, Mus musculus
gtcaacagtcacttattcttagc

SEQ ID NO: 218442 - DNA, 22 bp, Mus musculus
tcagttttgagtctgtgttact

SEQ ID NO: 218443 - DNA, 23 bp, Mus musculus
ctctgtgtgtgcgtgtgtctctg

SEQ ID NO: 218444 - DNA, 19 bp, Mus musculus
taagtctgaaatgttccca

SEQ ID NO: 218445 - DNA, 23 bp, Mus musculus
agtttgtggtactagcttgaaga

SEQ ID NO: 218446 - DNA, 23 bp, Mus musculus
aggctgactgtggctctcttgtc

SEQ ID NO: 218447 - DNA, 23 bp, Mus musculus
cagtttggttttaaaacaactat

SEQ ID NO: 218448 - DNA, 18 bp, Mus musculus
tgtgagaacagagagacc

SEQ ID NO: 218449 - DNA, 23 bp, Mus musculus
gctcgctcagtggctctgtcggt

SEQ ID NO: 218450 - DNA, 23 bp, Mus musculus
gtgtgtctgtctgtctgtctgtt

SEQ ID NO: 218451 - DNA, 23 bp, Mus musculus
tatgtgcaacaagtggagactgc

SEQ ID NO: 218452 - DNA, 23 bp, Mus musculus
gggagtctcactgttacactgtg

SEQ ID NO: 218453 - DNA, 21 bp, Mus musculus
ccctctctctctctcaggcca

SEQ ID NO: 218454 - DNA, 23 bp, Mus musculus
agcaacacattagtttagcgtga

SEQ ID NO: 218455 - DNA, 18 bp, Mus musculus
cacaagttaagaaactgt

SEQ ID NO: 218456 - DNA, 22 bp, Mus musculus
gtgtgtgtatatgtatgtgtgt

SEQ ID NO: 218457 - DNA, 23 bp, Mus musculus
tcactgagtggctagctggatca

SEQ ID NO: 218458 - DNA, 23 bp, Mus musculus
tctgtgtgttagtctccctctga

SEQ ID NO: 218459 - DNA, 19 bp, Mus musculus
taatggtccagaatacttg

SEQ ID NO: 218460 - DNA, 19 bp, Mus musculus
gtgtcagtctcagagtgcc

SEQ ID NO: 218461 - DNA, 23 bp, Mus musculus
ggttcaagagagagagctgacac

SEQ ID NO: 218462 - DNA, 18 bp, Mus musculus
ctactggctactgggaga

SEQ ID NO: 218463 - DNA, 23 bp, Mus musculus
tcttcagttgtgtgcccattggt

SEQ ID NO: 218464 - DNA, 21 bp, Mus musculus
tatgtatatatacatatgtgt

SEQ ID NO: 218465 - DNA, 23 bp, Mus musculus
atgcatgtgtgcctgtgtgtgtt

SEQ ID NO: 218466 - DNA, 23 bp, Mus musculus
tctctgtctgcctgcctgtctgt

SEQ ID NO: 218467 - DNA, 23 bp, Mus musculus
aatgattgcttctgtccttgcat

SEQ ID NO: 218468 - DNA, 23 bp, Mus musculus
tgtgggactcagtgcctgtgtga

SEQ ID NO: 218469 - DNA, 23 bp, Mus musculus
cctctcactctcaaagacttgac

SEQ ID NO: 218470 - DNA, 22 bp, Mus musculus
tacatacatatgtatacatgta

SEQ ID NO: 218471 - DNA, 23 bp, Mus musculus
tgtctgtgagtgtgtgtgcatgc

SEQ ID NO: 218472 - DNA, 23 bp, Mus musculus
cttctgtcgctcagactcaccct

SEQ ID NO: 218473 - DNA, 23 bp, Mus musculus
tctctggacggtagtgtggggga

SEQ ID NO: 218474 - DNA, 21 bp, Mus musculus
tgtgacttccagagaacactg

SEQ ID NO: 218475 - DNA, 23 bp, Mus musculus
tttgtactgtttctgttgttctg

SEQ ID NO: 218476 - DNA, 23 bp, Mus musculus
tctcagcctctgtccctccctct

SEQ ID NO: 218477 - DNA, 19 bp, Mus musculus
agaccagattaaaagtaga

SEQ ID NO: 218478 - DNA, 19 bp, Mus musculus
atacttgatatacatatgt

SEQ ID NO: 218479 - DNA, 19 bp, Mus musculus
gccatcagtctgtgggaca

SEQ ID NO: 218480 - DNA, 23 bp, Mus musculus
ggctccctctctggctcacactt

SEQ ID NO: 218481 - DNA, 21 bp, Mus musculus
taacagcctggtatgcttctc

SEQ ID NO: 218482 - DNA, 23 bp, Mus musculus
tgtgcatgagcatgtgcatgtgt

SEQ ID NO: 218483 - DNA, 23 bp, Mus musculus
tctctgcgtctctgtctgggatc

SEQ ID NO: 218484 - DNA, 23 bp, Mus musculus
tcactgcgagatgtctaactgca

SEQ ID NO: 218485 - DNA, 19 bp, Mus musculus
tgtgtatggatgtgtgtgt

SEQ ID NO: 218486 - DNA, 22 bp, Mus musculus
tctgagacaatagtaggagttg

SEQ ID NO: 218487 - DNA, 21 bp, Mus musculus
tgcctccctgtgtccctcaga

SEQ ID NO: 218488 - DNA, 23 bp, Mus musculus
aagccacacagtgtctgagtcac

SEQ ID NO: 218489 - DNA, 22 bp, Mus musculus
tatgtatgtatgtatgtatgta

SEQ ID NO: 218490 - DNA, 23 bp, Mus musculus
attatgatatgtatatgtgtaca

SEQ ID NO: 218491 - DNA, 20 bp, Mus musculus
ttatatgtatgcatgtatgt

SEQ ID NO: 218492 - DNA, 20 bp, Mus musculus
tatgcatgtatgtatgatac

SEQ ID NO: 218493 - DNA, 23 bp, Mus musculus
tgtctgtctgtctgtccctctac

SEQ ID NO: 218494 - DNA, 23 bp, Mus musculus
ggtaaaactctgtggtaaagaat

SEQ ID NO: 218495 - DNA, 21 bp, Mus musculus
gttcaaatctcagcaaccaca

SEQ ID NO: 218496 - DNA, 20 bp, Mus musculus
cagatcatggttctgtgaga

SEQ ID NO: 218497 - DNA, 19 bp, Mus musculus
tgtgcagtcttcccagccc

SEQ ID NO: 218498 - DNA, 19 bp, Mus musculus
aggctactgtaatccatgc

SEQ ID NO: 218499 - DNA, 19 bp, Mus musculus
tatggatggatggttatgt

SEQ ID NO: 218500 - DNA, 22 bp, Mus musculus
agaggaaggctgtagaggatgc

SEQ ID NO: 218501 - DNA, 23 bp, Mus musculus
catgtgactctgtgtgtgtgagc

SEQ ID NO: 218502 - DNA, 21 bp, Mus musculus
tctcacactgagtcatctccc

SEQ ID NO: 218503 - DNA, 23 bp, Mus musculus
tgacagcagagagtgagtttggt

SEQ ID NO: 218504 - DNA, 19 bp, Mus musculus
agcctgagaattctgtgag

SEQ ID NO: 218505 - DNA, 23 bp, Mus musculus
agcttgtctctctgtgtctctta

SEQ ID NO: 218506 - DNA, 21 bp, Mus musculus
tgtatgacaggcatgtttaga

SEQ ID NO: 218507 - DNA, 23 bp, Mus musculus
tctctgtagaaagacagctgact

SEQ ID NO: 218508 - DNA, 23 bp, Mus musculus
cacagtgaagagagacagctcac

SEQ ID NO: 218509 - DNA, 23 bp, Mus musculus
tgttatgtgtgcatgtgcatatg

SEQ ID NO: 218510 - DNA, 20 bp, Mus musculus
tatatgtgtgtgtgtacatg

SEQ ID NO: 218511 - DNA, 22 bp, Mus musculus
tgtgtacacacatgactgtaca

SEQ ID NO: 218512 - DNA, 23 bp, Mus musculus
tctgtgtgtgtgcatgtgcatgt

SEQ ID NO: 218513 - DNA, 23 bp, Mus musculus
tctgtgtgtatttctgtgtgtgt

SEQ ID NO: 218514 - DNA, 22 bp, Mus musculus
tgtgtgcatctatgtgtctgtg

SEQ ID NO: 218515 - DNA, 19 bp, Mus musculus
tatatgtacatgtagatgc

SEQ ID NO: 218516 - DNA, 23 bp, Mus musculus
tgagtctgtctgtcgctgggtca

SEQ ID NO: 218517 - DNA, 23 bp, Mus musculus
atacacacatatattgtgtgtat

SEQ ID NO: 218518 - DNA, 22 bp, Mus musculus
gaggctccgtgactgggtctgt

SEQ ID NO: 218519 - DNA, 18 bp, Mus musculus
cactgcttagaatctggt

SEQ ID NO: 218520 - DNA, 22 bp, Mus musculus
atgtttcagaaattgtatttga

SEQ ID NO: 218521 - DNA, 20 bp, Mus musculus
tgtgtgtatatgtctgtgtt

SEQ ID NO: 218522 - DNA, 23 bp, Mus musculus
tgtgagtacatatgcatgtgttt

SEQ ID NO: 218523 - DNA, 20 bp, Mus musculus
ctgtgggcagaagctgtggg

SEQ ID NO: 218524 - DNA, 23 bp, Mus musculus
tactttcacgtcgtttctctcag

SEQ ID NO: 218525 - DNA, 21 bp, Mus musculus
aaggaccttggttattttgat

SEQ ID NO: 218526 - DNA, 23 bp, Mus musculus
tgactctgagtcactgatgctgt

SEQ ID NO: 218527 - DNA, 23 bp, Mus musculus
tgactctgagtcactgatgctgt

SEQ ID NO: 218528 - DNA, 21 bp, Mus musculus
tcagggacattcagtgagtca

SEQ ID NO: 218529 - DNA, 23 bp, Mus musculus
atctctgtgaactgagtgtgctg

SEQ ID NO: 218530 - DNA, 21 bp, Mus musculus
tgcctgcctgcctggctggca

SEQ ID NO: 218531 - DNA, 23 bp, Mus musculus
taatgtgtgtggtttgcatgtgt

SEQ ID NO: 218532 - DNA, 20 bp, Mus musculus
tctcggtcagtcacaccctg

SEQ ID NO: 218533 - DNA, 20 bp, Mus musculus
tgtatgtgtgcatgtgcata

SEQ ID NO: 218534 - DNA, 22 bp, Mus musculus
tggtatgtatatgtatgtgtat

SEQ ID NO: 218535 - DNA, 22 bp, Mus musculus
tgtctctctgtttagtttctgt

SEQ ID NO: 218536 - DNA, 23 bp, Mus musculus
atgtatgtatgtatgtatgtatg

SEQ ID NO: 218537 - DNA, 21 bp, Mus musculus
acatatgcacacacacttgca

SEQ ID NO: 218538 - DNA, 21 bp, Mus musculus
tccatggtggtctgataggat

SEQ ID NO: 218539 - DNA, 22 bp, Mus musculus
tgttttgtgaccaattatatgg

SEQ ID NO: 218540 - DNA, 23 bp, Mus musculus
aaccagagagtagagagtgaggt

SEQ ID NO: 218541 - DNA, 23 bp, Mus musculus
ctctgatgacactgagctgagaa

SEQ ID NO: 218542 - DNA, 23 bp, Mus musculus
actctgtgtgtgtgtcaagttgg

SEQ ID NO: 218543 - DNA, 20 bp, Mus musculus
tgtacacatgagtaggtgtc

SEQ ID NO: 218544 - DNA, 23 bp, Mus musculus
gaatgtccttttgtatttgaata

SEQ ID NO: 218545 - DNA, 21 bp, Mus musculus
tcactggatctgtgaagccat

SEQ ID NO: 218546 - DNA, 23 bp, Mus musculus
tgtatatgcatctgtatatgtat

SEQ ID NO: 218547 - DNA, 22 bp, Mus musculus
atatgtattgatgtatgtgtat

SEQ ID NO: 218548 - DNA, 23 bp, Mus musculus
ttgctgtgggctctgcctctctc

SEQ ID NO: 218549 - DNA, 18 bp, Mus musculus
gcttctgaggtcaattct

SEQ ID NO: 218550 - DNA, 23 bp, Mus musculus
tgtatatgtgtatgtacatgtat

SEQ ID NO: 218551 - DNA, 23 bp, Mus musculus
ctcactcactgtgtgactgccag

SEQ ID NO: 218552 - DNA, 23 bp, Mus musculus
gagtaaagagattctgtctctgt

SEQ ID NO: 218553 - DNA, 23 bp, Mus musculus
taagatccacctgtctctctgtc

SEQ ID NO: 218554 - DNA, 22 bp, Mus musculus
tcagtgtctgtttgcagggtgt

SEQ ID NO: 218555 - DNA, 19 bp, Mus musculus
cagcctcactctgtgactc

SEQ ID NO: 218556 - DNA, 19 bp, Mus musculus
tcattgtttttcaaaatgt

SEQ ID NO: 218557 - DNA, 20 bp, Mus musculus
agagaactagagagtgggag

SEQ ID NO: 218558 - DNA, 21 bp, Mus musculus
cacacatatacacacacatat

SEQ ID NO: 218559 - DNA, 22 bp, Mus musculus
tgactctgtgggtcattatttt

SEQ ID NO: 218560 - DNA, 23 bp, Mus musculus
ggctcgctcgctggctcgctggc

SEQ ID NO: 218561 - DNA, 23 bp, Mus musculus
actgtctctgagtcccttgcgtt

SEQ ID NO: 218562 - DNA, 23 bp, Mus musculus
aaatgtcaaaaactaagagtgag

SEQ ID NO: 218563 - DNA, 19 bp, Mus musculus
tcacaggaggtagcagtgt

SEQ ID NO: 218564 - DNA, 18 bp, Mus musculus
agatgcacacacacatgt

SEQ ID NO: 218565 - DNA, 23 bp, Mus musculus
cagacagtggctctgtctctggc

SEQ ID NO: 218566 - DNA, 18 bp, Mus musculus
acacacacacacatggag

SEQ ID NO: 218567 - DNA, 23 bp, Mus musculus
agggagaacacattttgtaattc

SEQ ID NO: 218568 - DNA, 23 bp, Mus musculus
gagccagtcactgtcactgtcac

SEQ ID NO: 218569 - DNA, 20 bp, Mus musculus
tctcctctgtctcactctgc

SEQ ID NO: 218570 - DNA, 22 bp, Mus musculus
atatatgtgtatatgtatatat

SEQ ID NO: 218571 - DNA, 23 bp, Mus musculus
agaattcagaatggtaggagtct

SEQ ID NO: 218572 - DNA, 21 bp, Mus musculus
ttacaccgtggtttgcttgtt

SEQ ID NO: 218573 - DNA, 23 bp, Mus musculus
tagataagagtgtggactgtgtg

SEQ ID NO: 218574 - DNA, 23 bp, Mus musculus
acacacacacacactcttaacac

SEQ ID NO: 218575 - DNA, 20 bp, Mus musculus
ggggagagagtattctgaac

SEQ ID NO: 218576 - DNA, 23 bp, Mus musculus
tgcatgtctgcatgtgtgtggta

SEQ ID NO: 218577 - DNA, 23 bp, Mus musculus
atgtgtgtgcatgtgtatgtgta

SEQ ID NO: 218578 - DNA, 22 bp, Mus musculus
tgttttgtgaccaattatatgg

SEQ ID NO: 218579 - DNA, 21 bp, Mus musculus
tagaacatcccatttctgtgt

SEQ ID NO: 218580 - DNA, 22 bp, Mus musculus
tatgtgtgtgtctgtgtgcctg

SEQ ID NO: 218581 - DNA, 20 bp, Mus musculus
tccagcaaccatgtggctca

SEQ ID NO: 218582 - DNA, 23 bp, Mus musculus
tgtgtgtgtatatgtatatgtgc

SEQ ID NO: 218583 - DNA, 23 bp, Mus musculus
atatgtgtgtgtatatgtatgtg

SEQ ID NO: 218584 - DNA, 23 bp, Mus musculus
tgaccctctctctcagtgaccag

SEQ ID NO: 218585 - DNA, 23 bp, Mus musculus
tggctccctgggtccctgcctcc

SEQ ID NO: 218586 - DNA, 23 bp, Mus musculus
tatgcatttgtatgcatatggca

SEQ ID NO: 218587 - DNA, 22 bp, Mus musculus
tgtgtactgcctgtgtacatgt

SEQ ID NO: 218588 - DNA, 19 bp, Mus musculus
tatgcctcagtatgtgcct

SEQ ID NO: 218589 - DNA, 23 bp, Mus musculus
gtatgtgtgtgcatgtgcatgtg

SEQ ID NO: 218590 - DNA, 19 bp, Mus musculus
agctggatgttacagagct

SEQ ID NO: 218591 - DNA, 23 bp, Mus musculus
tttgtgactgcctgtgtcccttc

SEQ ID NO: 218592 - DNA, 23 bp, Mus musculus
tctgtgagccattcttttttctg

SEQ ID NO: 218593 - DNA, 20 bp, Mus musculus
tacagaggtgtgtatccaca

SEQ ID NO: 218594 - DNA, 23 bp, Mus musculus
acagtcttgattttcctcaggta

SEQ ID NO: 218595 - DNA, 22 bp, Mus musculus
tagatccaattctagatataga

SEQ ID NO: 218596 - DNA, 20 bp, Mus musculus
tactcagttcagtctctgtg

SEQ ID NO: 218597 - DNA, 23 bp, Mus musculus
tgtagtcagtgtttgttcttctc

SEQ ID NO: 218598 - DNA, 23 bp, Mus musculus
tcagttttgaaagtcatggttat

SEQ ID NO: 218599 - DNA, 23 bp, Mus musculus
ttttctgtctgtctgtctatctg

SEQ ID NO: 218600 - DNA, 23 bp, Mus musculus
tatgtaaatatgtatctatgtgt

SEQ ID NO: 218601 - DNA, 23 bp, Mus musculus
tatatatctatgcatttgtgtgt

SEQ ID NO: 218602 - DNA, 23 bp, Mus musculus
tatgaatgtatctgtgtatgtat

SEQ ID NO: 218603 - DNA, 21 bp, Mus musculus
tgaaagatggttctacgtgag

SEQ ID NO: 218604 - DNA, 23 bp, Mus musculus
tgtatgtgcatatagtacatatg

SEQ ID NO: 218605 - DNA, 23 bp, Mus musculus
acatatgtatatggtatgtatgt

SEQ ID NO: 218606 - DNA, 23 bp, Mus musculus
gtatgcatgtatgtatgtatgta

SEQ ID NO: 218607 - DNA, 21 bp, Mus musculus
tcactgaatctcaaattgcct

SEQ ID NO: 218608 - DNA, 19 bp, Mus musculus
ttggttcaacatgagcaca

SEQ ID NO: 218609 - DNA, 23 bp, Mus musculus
gtgtgtctgtgtgtgcatgttca

SEQ ID NO: 218610 - DNA, 23 bp, Mus musculus
atgtgtgtatgtgcatgtgtatg

SEQ ID NO: 218611 - DNA, 22 bp, Mus musculus
tgcctctgtcccactgtcactt

SEQ ID NO: 218612 - DNA, 20 bp, Mus musculus
tgacctgctggacactagct

SEQ ID NO: 218613 - DNA, 21 bp, Mus musculus
acaggcactgttgtctcgctc

SEQ ID NO: 218614 - DNA, 23 bp, Mus musculus
tcgagtgtcactctctgggtccc

SEQ ID NO: 218615 - DNA, 23 bp, Mus musculus
tgctgtgacaaatcactgtgacc

SEQ ID NO: 218616 - DNA, 23 bp, Mus musculus
atctccgaactctctctctctgg

SEQ ID NO: 218617 - DNA, 19 bp, Mus musculus
gtatgcatgtatgtgtgta

SEQ ID NO: 218618 - DNA, 23 bp, Mus musculus
tgtatgtgtgcatgtgtatatgt

SEQ ID NO: 218619 - DNA, 18 bp, Mus musculus
cagaggttttgagttcaa

SEQ ID NO: 218620 - DNA, 23 bp, Mus musculus
tatgtcaccctctgtcactccca

SEQ ID NO: 218621 - DNA, 23 bp, Mus musculus
aattaaagtggtgaccgagcaat

SEQ ID NO: 218622 - DNA, 23 bp, Mus musculus
ttatgtgtgtatatatgtaagca

SEQ ID NO: 218623 - DNA, 21 bp, Mus musculus
tgtatgtgtatatgtgcatgt

SEQ ID NO: 218624 - DNA, 21 bp, Mus musculus
atgtatgcatatatgtgtgta

SEQ ID NO: 218625 - DNA, 22 bp, Mus musculus
atatatgtgtgcatatgtattc

SEQ ID NO: 218626 - DNA, 23 bp, Mus musculus
atgctgtgggtcagatgtaagct

SEQ ID NO: 218627 - DNA, 23 bp, Mus musculus
tgcctgcctgcctacctgcttgc

SEQ ID NO: 218628 - DNA, 23 bp, Mus musculus
tgtcactctctgtgtttttgtgt

SEQ ID NO: 218629 - DNA, 22 bp, Mus musculus
ggacttgaagagtttctgttgt

SEQ ID NO: 218630 - DNA, 21 bp, Mus musculus
tttcagttttgttgctgatcg

SEQ ID NO: 218631 - DNA, 23 bp, Mus musculus
atatgtatacatgtatgtatgtg

SEQ ID NO: 218632 - DNA, 20 bp, Mus musculus
ttcctttagaatagcttcag

SEQ ID NO: 218633 - DNA, 22 bp, Mus musculus
tctctctctgggtcttttatct

SEQ ID NO: 218634 - DNA, 23 bp, Mus musculus
gtgtcactgtctgagactgttct

SEQ ID NO: 218635 - DNA, 19 bp, Mus musculus
aggtgctttctgctccgct

SEQ ID NO: 218636 - DNA, 23 bp, Mus musculus
agtgtctgtgagtctgtaatcag

SEQ ID NO: 218637 - DNA, 19 bp, Mus musculus
agagagtgctcacagaggc

SEQ ID NO: 218638 - DNA, 23 bp, Mus musculus
ggttgtctttagaggatgtgcta

SEQ ID NO: 218639 - DNA, 23 bp, Mus musculus
tgcctgcctgcgtgtaacaggaa

SEQ ID NO: 218640 - DNA, 20 bp, Mus musculus
agcaactggccctgctcagt

SEQ ID NO: 218641 - DNA, 22 bp, Mus musculus
aagaaagaacaaccctttgaca

SEQ ID NO: 218642 - DNA, 20 bp, Mus musculus
cagtctctctgtgccatcta

SEQ ID NO: 218643 - DNA, 22 bp, Mus musculus
gtacttgtcactctgctaggac

SEQ ID NO: 218644 - DNA, 22 bp, Mus musculus
tatatgtgtgctatacatatat

SEQ ID NO: 218645 - DNA, 23 bp, Mus musculus
ctgcctgcctgcctgcctgcctg

SEQ ID NO: 218646 - DNA, 21 bp, Mus musculus
aaagaatttgttgagggattg

SEQ ID NO: 218647 - DNA, 23 bp, Mus musculus
gtctgtgactccacgtgagtctg

SEQ ID NO: 218648 - DNA, 23 bp, Mus musculus
agtgagaaaagtgagtggccatg

SEQ ID NO: 218649 - DNA, 23 bp, Mus musculus
tgagaatctctttctagaatgtt

SEQ ID NO: 218650 - DNA, 23 bp, Mus musculus
aggtagacttgtgaaatagaagg

SEQ ID NO: 218651 - DNA, 23 bp, Mus musculus
tcactcccacaccttgtcctctg

SEQ ID NO: 218652 - DNA, 21 bp, Mus musculus
aagcaggtcaaagtgttgtga

SEQ ID NO: 218653 - DNA, 23 bp, Mus musculus
ctcacacactgtgaaagtctgct

SEQ ID NO: 218654 - DNA, 21 bp, Mus musculus
tgtgcatggcccagttgctgg

SEQ ID NO: 218655 - DNA, 21 bp, Mus musculus
aagggttgagattttcttgtg

SEQ ID NO: 218656 - DNA, 23 bp, Mus musculus
gtgtgcatcagtatgtgcatgtg

SEQ ID NO: 218657 - DNA, 18 bp, Mus musculus
aattcctgtactcagggg

SEQ ID NO: 218658 - DNA, 19 bp, Mus musculus
acagaacactgtgagttca

SEQ ID NO: 218659 - DNA, 22 bp, Mus musculus
tggggtagatctaactagagag

SEQ ID NO: 218660 - DNA, 21 bp, Mus musculus
gcatgtatgtatatatgtatg

SEQ ID NO: 218661 - DNA, 23 bp, Mus musculus
cgcatgtgagtgggtatgtatgc

SEQ ID NO: 218662 - DNA, 19 bp, Mus musculus
ccatgaactagatggagtt

SEQ ID NO: 218663 - DNA, 18 bp, Mus musculus
acagaatggcttccttct

SEQ ID NO: 218664 - DNA, 22 bp, Mus musculus
agagtagaggctgagtacaagc

SEQ ID NO: 218665 - DNA, 23 bp, Mus musculus
tgcatgcatctgttctctcactc

SEQ ID NO: 218666 - DNA, 23 bp, Mus musculus
tcttcatgtgggactcctaacag

SEQ ID NO: 218667 - DNA, 23 bp, Mus musculus
tctgtcactcacaactgttggca

SEQ ID NO: 218668 - DNA, 23 bp, Mus musculus
agaaatgtttgcctgcttgcctg

SEQ ID NO: 218669 - DNA, 23 bp, Mus musculus
ttatctgtctttggaatagagag

SEQ ID NO: 218670 - DNA, 22 bp, Mus musculus
acactgtactggaagctgttta

SEQ ID NO: 218671 - DNA, 23 bp, Mus musculus
agacagggtctctctctcattca

SEQ ID NO: 218672 - DNA, 22 bp, Mus musculus
tatgtatgtatgtatgagtgtg

SEQ ID NO: 218673 - DNA, 22 bp, Mus musculus
ctcagacagtctgacaccttcg

SEQ ID NO: 218674 - DNA, 23 bp, Mus musculus
gggtgtagttgcaggcctggagc

SEQ ID NO: 218675 - DNA, 20 bp, Mus musculus
gtttcttcagttcttggttc

SEQ ID NO: 218676 - DNA, 19 bp, Mus musculus
aagtttaagagcataggtt

SEQ ID NO: 218677 - DNA, 23 bp, Mus musculus
gtgctagccctttccatcagtct

SEQ ID NO: 218678 - DNA, 18 bp, Mus musculus
cattgcatgctcgtgtgt

SEQ ID NO: 218679 - DNA, 23 bp, Mus musculus
cacacactcagttttgcgtttgt

SEQ ID NO: 218680 - DNA, 23 bp, Mus musculus
gaatggttgtcctagtgttgtgt

SEQ ID NO: 218681 - DNA, 23 bp, Mus musculus
acatatgtgtgtgtgtctgtctg

SEQ ID NO: 218682 - DNA, 21 bp, Mus musculus
tatgggacttcatgatatccc

SEQ ID NO: 218683 - DNA, 22 bp, Mus musculus
atgtgtactgtatgtatgcagt

SEQ ID NO: 218684 - DNA, 23 bp, Mus musculus
gactgagagagcaatggcatact

SEQ ID NO: 218685 - DNA, 21 bp, Mus musculus
aggaatcttaagtagtatgaa

SEQ ID NO: 218686 - DNA, 19 bp, Mus musculus
tgtatatatatatgtatgt

SEQ ID NO: 218687 - DNA, 23 bp, Mus musculus
gttttctcagtaattgttaatgc

SEQ ID NO: 218688 - DNA, 23 bp, Mus musculus
aataaagtgtttatccaggtact

SEQ ID NO: 218689 - DNA, 22 bp, Mus musculus
tcactgtgacacactatgctct

SEQ ID NO: 218690 - DNA, 20 bp, Mus musculus
aggagctagagacagtcctg

SEQ ID NO: 218691 - DNA, 22 bp, Mus musculus
tctatcactgtgattgtctctc

SEQ ID NO: 218692 - DNA, 19 bp, Mus musculus
tttgagttgcatatgtact

SEQ ID NO: 218693 - DNA, 22 bp, Mus musculus
aaagagagagaacatgaagtca

SEQ ID NO: 218694 - DNA, 22 bp, Mus musculus
atgtgtgtatatgtatgtatgt

SEQ ID NO: 218695 - DNA, 23 bp, Mus musculus
atatatgtatatgtatatgagtg

SEQ ID NO: 218696 - DNA, 22 bp, Mus musculus
tgttttgtgaccaattatatgg

SEQ ID NO: 218697 - DNA, 22 bp, Mus musculus
tgttttgtgaccaattatatgg

SEQ ID NO: 218698 - DNA, 22 bp, Mus musculus
atattgatgatgatgatgatga

SEQ ID NO: 218699 - DNA, 22 bp, Mus musculus
taacttagtggtgatcttctgc

SEQ ID NO: 218700 - DNA, 21 bp, Mus musculus
tctgtgggtatgagtatgtac

SEQ ID NO: 218701 - DNA, 23 bp, Mus musculus
ctctgagagcagctgcatgtgaa

SEQ ID NO: 218702 - DNA, 18 bp, Mus musculus
atgtctcaggagagagag

SEQ ID NO: 218703 - DNA, 23 bp, Mus musculus
tggttctgacagacattcgaggg

SEQ ID NO: 218704 - DNA, 20 bp, Mus musculus
aatgtttttctttataagag

SEQ ID NO: 218705 - DNA, 18 bp, Mus musculus
catagcagtagaaaccct

SEQ ID NO: 218706 - DNA, 19 bp, Mus musculus
tgagtgcttcctgagagtc

SEQ ID NO: 218707 - DNA, 23 bp, Mus musculus
tgtgacaagagagtgtctacagt

SEQ ID NO: 218708 - DNA, 23 bp, Mus musculus
tcactcgctcagtccctccttgc

SEQ ID NO: 218709 - DNA, 23 bp, Mus musculus
gaggttctgagttcaaatctcag

SEQ ID NO: 218710 - DNA, 22 bp, Mus musculus
cttggcagaacatagagagcag

SEQ ID NO: 218711 - DNA, 22 bp, Mus musculus
tgttttgtgaccaattatatgg

SEQ ID NO: 218712 - DNA, 20 bp, Mus musculus
agagatgaaggtctcaagat

SEQ ID NO: 218713 - DNA, 22 bp, Mus musculus
attaatgatgctttatagaact

SEQ ID NO: 218714 - DNA, 22 bp, Mus musculus
tgttttgtgaccaattatatgg

SEQ ID NO: 218715 - DNA, 23 bp, Mus musculus
tgtgtgtgtgtgtatgtgcgtgt

SEQ ID NO: 218716 - DNA, 22 bp, Mus musculus
taagtgtgtgtacatgcagaag

SEQ ID NO: 218717 - DNA, 22 bp, Mus musculus
tcagttctcattcctagctgtt

SEQ ID NO: 218718 - DNA, 20 bp, Mus musculus
tatgtatatgtatatgtata

SEQ ID NO: 218719 - DNA, 23 bp, Mus musculus
tataatgtatatgtatatgtaca

SEQ ID NO: 218720 - DNA, 20 bp, Mus musculus
tgctcatctgcaaggacaat

SEQ ID NO: 218721 - DNA, 23 bp, Mus musculus
atagagtgaggcatatttcagtc

SEQ ID NO: 218722 - DNA, 22 bp, Mus musculus
gtgtatatatatatgtgtgtgt

SEQ ID NO: 218723 - DNA, 23 bp, Mus musculus
tgcatatgtatatcatatgtaac

SEQ ID NO: 218724 - DNA, 23 bp, Mus musculus
tgtctattgtatatatgtatata

SEQ ID NO: 218725 - DNA, 22 bp, Mus musculus
tgttttgtgaccaattatatgg

SEQ ID NO: 218726 - DNA, 19 bp, Mus musculus
ctgttgtttcctaactgtg

SEQ ID NO: 218727 - DNA, 23 bp, Mus musculus
tgtctgtccctgtctgtcaccct

SEQ ID NO: 218728 - DNA, 21 bp, Mus musculus
atgttgaccttatagaataca

SEQ ID NO: 218729 - DNA, 20 bp, Mus musculus
tatatggtcatatttggaga

SEQ ID NO: 218730 - DNA, 22 bp, Mus musculus
atagacagattacagagtgaac

SEQ ID NO: 218731 - DNA, 23 bp, Mus musculus
tgtgagcatctgcatctgtattg

SEQ ID NO: 218732 - DNA, 23 bp, Mus musculus
gtgtgtgtgtgtgtgtatcctga

SEQ ID NO: 218733 - DNA, 19 bp, Mus musculus
tatgcatatataatgtatt

SEQ ID NO: 218734 - DNA, 19 bp, Mus musculus
atacatggatatggcatga

SEQ ID NO: 218735 - DNA, 23 bp, Mus musculus
tgtatgtatatgtgtatatgtgt

SEQ ID NO: 218736 - DNA, 18 bp, Mus musculus
tacacacacacatatatc

SEQ ID NO: 218737 - DNA, 23 bp, Mus musculus
tgagtgtgtctgtcggtctgtcc

SEQ ID NO: 218738 - DNA, 21 bp, Mus musculus
atactgcacctggatctgtat

SEQ ID NO: 218739 - DNA, 23 bp, Mus musculus
tatgcatctatgtatttatgtat

SEQ ID NO: 218740 - DNA, 23 bp, Mus musculus
agacactgatcgttttgctgcct

SEQ ID NO: 218741 - DNA, 23 bp, Mus musculus
atatatgtgtatatgtatgtatg

SEQ ID NO: 218742 - DNA, 23 bp, Mus musculus
atatgtgcatatgtaatgaaaga

SEQ ID NO: 218743 - DNA, 23 bp, Mus musculus
tatgtatatctatatgtatgtat

SEQ ID NO: 218744 - DNA, 21 bp, Mus musculus
tgtgtatatatgtatgtgtgt

SEQ ID NO: 218745 - DNA, 18 bp, Mus musculus
tgtgtgagaatgtatgtg

SEQ ID NO: 218746 - DNA, 19 bp, Mus musculus
gtatatatatatgtgtgtg

SEQ ID NO: 218747 - DNA, 21 bp, Mus musculus
ttcaagaggtcatggaagctg

SEQ ID NO: 218748 - DNA, 21 bp, Mus musculus
tcagagcagaagtgatggtct

SEQ ID NO: 218749 - DNA, 23 bp, Mus musculus
tcacctctctctctctgcagtat

SEQ ID NO: 218750 - DNA, 23 bp, Mus musculus
ttacagtacagtcagctaatttt

SEQ ID NO: 218751 - DNA, 22 bp, Mus musculus
tagctgccaaatttttttctgt

SEQ ID NO: 218752 - DNA, 23 bp, Mus musculus
gtgtgcgtctgtctgtcagtcat

SEQ ID NO: 218753 - DNA, 23 bp, Mus musculus
taagtacagccattggaactgct

SEQ ID NO: 218754 - DNA, 23 bp, Mus musculus
aatggttttcacctgctggaaag

SEQ ID NO: 218755 - DNA, 22 bp, Mus musculus
tatactctatagaagtatagac

SEQ ID NO: 218756 - DNA, 23 bp, Mus musculus
acttacataagtatagaagtaag

SEQ ID NO: 218757 - DNA, 22 bp, Mus musculus
tgttttgtgaccaattatatgg

SEQ ID NO: 218758 - DNA, 19 bp, Mus musculus
gtatgcacggatgtgtata

SEQ ID NO: 218759 - DNA, 22 bp, Mus musculus
tgttttgtgaccaattatatgg

SEQ ID NO: 218760 - DNA, 23 bp, Mus musculus
agatgtctagtgagtttcatgta

SEQ ID NO: 218761 - DNA, 18 bp, Mus musculus
atgactactcatggtggg

SEQ ID NO: 218762 - DNA, 23 bp, Mus musculus
tctcagaggcctttctttcagtc

SEQ ID NO: 218763 - DNA, 22 bp, Mus musculus
tgttttgtgaccaattatatgg

SEQ ID NO: 218764 - DNA, 23 bp, Mus musculus
aaaacttttttttttgttgtggc

SEQ ID NO: 218765 - DNA, 23 bp, Mus musculus
tgtgtgtgtatatgtatatatga

SEQ ID NO: 218766 - DNA, 22 bp, Mus musculus
tgagtgcttgctgtttcaccct

SEQ ID NO: 218767 - DNA, 23 bp, Mus musculus
tcagtctcagtctgtgtggtgag

SEQ ID NO: 218768 - DNA, 23 bp, Mus musculus
tgtctgcctgtctgcctgactgt

SEQ ID NO: 218769 - DNA, 23 bp, Mus musculus
aattgggattttgttcatgtcag

SEQ ID NO: 218770 - DNA, 19 bp, Mus musculus
tacctccacaacaaaattc

SEQ ID NO: 218771 - DNA, 23 bp, Mus musculus
atatgtgagtgtatgtacttgca

SEQ ID NO: 218772 - DNA, 23 bp, Mus musculus
gtttctgtgtgtgcatgtgcatc

SEQ ID NO: 218773 - DNA, 23 bp, Mus musculus
cttgcagctttagatatctgtct

SEQ ID NO: 218774 - DNA, 19 bp, Mus musculus
ctctctctcatttttgtgc

SEQ ID NO: 218775 - DNA, 20 bp, Mus musculus
tatggatatatatccataat

SEQ ID NO: 218776 - DNA, 23 bp, Mus musculus
tagtgcatggtgatctgatagga

SEQ ID NO: 218777 - DNA, 22 bp, Mus musculus
tgttttgtgacctattatgtgg

SEQ ID NO: 218778 - DNA, 21 bp, Mus musculus
ttgtgaattatggattcatgt

SEQ ID NO: 218779 - DNA, 20 bp, Mus musculus
gataatgatcaaagcaattg

SEQ ID NO: 218780 - DNA, 23 bp, Mus musculus
acaggatctctctcactgactgg

SEQ ID NO: 218781 - DNA, 23 bp, Mus musculus
gctattcactttcataatgagct

SEQ ID NO: 218782 - DNA, 20 bp, Mus musculus
tttcagagaccgtgagttca

SEQ ID NO: 218783 - DNA, 18 bp, Mus musculus
agagaactcctaaacttg

SEQ ID NO: 218784 - DNA, 22 bp, Mus musculus
gttgtgttcttgtagtatctgg

SEQ ID NO: 218785 - DNA, 18 bp, Mus musculus
tgcttgtgtatatatatg

SEQ ID NO: 218786 - DNA, 23 bp, Mus musculus
tgcaataatttggacatggtggt

SEQ ID NO: 218787 - DNA, 22 bp, Mus musculus
tgttttgtgaccaattatatgg

SEQ ID NO: 218788 - DNA, 23 bp, Mus musculus
tgttatcatatatatgtatgtgt

SEQ ID NO: 218789 - DNA, 23 bp, Mus musculus
tcatgttatcatacatatgtatg

SEQ ID NO: 218790 - DNA, 23 bp, Mus musculus
tcatgttatcatgtataaatcac

SEQ ID NO: 218791 - DNA, 23 bp, Mus musculus
tatctatgtatgtgtgtgtgtgt

SEQ ID NO: 218792 - DNA, 20 bp, Mus musculus
gtgttcatgcaacacagtaa

SEQ ID NO: 218793 - DNA, 22 bp, Mus musculus
atggggatcatattgaatctat

SEQ ID NO: 218794 - DNA, 22 bp, Mus musculus
attgattcgtcctgtccatgag

SEQ ID NO: 218795 - DNA, 23 bp, Mus musculus
tctctgtttcagtcacttagtca

SEQ ID NO: 218796 - DNA, 22 bp, Mus musculus
tgttttgtgaccaattatatgg

SEQ ID NO: 218797 - DNA, 18 bp, Mus musculus
tatctgtgtctgcatctg

SEQ ID NO: 218798 - DNA, 23 bp, Mus musculus
acacaacaaagtctggacactga

SEQ ID NO: 218799 - DNA, 23 bp, Mus musculus
gtctctctgtgtgtctcagatcc

SEQ ID NO: 218800 - DNA, 21 bp, Mus musculus
ttgcagacagttgtgagctgc

SEQ ID NO: 218801 - DNA, 23 bp, Mus musculus
atgtatgtgcatatctatctatc

SEQ ID NO: 218802 - DNA, 22 bp, Mus musculus
cgtcttcacagtgcaagggatg

SEQ ID NO: 218803 - DNA, 23 bp, Mus musculus
taagtgcatttgaaatctctgtt

SEQ ID NO: 218804 - DNA, 19 bp, Mus musculus
tatctgtctgagtcaactg

SEQ ID NO: 218805 - DNA, 21 bp, Mus musculus
tacactctcacacacaataca

SEQ ID NO: 218806 - DNA, 20 bp, Mus musculus
agctagaaggttgtacagtt

SEQ ID NO: 218807 - DNA, 21 bp, Mus musculus
tagcatcaacactgtctgcag

SEQ ID NO: 218808 - DNA, 23 bp, Mus musculus
aaagagacaagaagatgagtaag

SEQ ID NO: 218809 - DNA, 23 bp, Mus musculus
ttgtgagcttccttgtgtgggtg

SEQ ID NO: 218810 - DNA, 19 bp, Mus musculus
taggtcctgagttcaattc

SEQ ID NO: 218811 - DNA, 23 bp, Mus musculus
tgtgtcagtgttcagagagagct

SEQ ID NO: 218812 - DNA, 18 bp, Mus musculus
aatccaccagaaagcact

SEQ ID NO: 218813 - DNA, 22 bp, Mus musculus
ttgattctaaagatgattgatg

SEQ ID NO: 218814 - DNA, 23 bp, Mus musculus
tgtaagagcttgtggatgtgtgt

SEQ ID NO: 218815 - DNA, 22 bp, Mus musculus
atagatgtatgtgagcttcaag

SEQ ID NO: 218816 - DNA, 21 bp, Mus musculus
actgtgtgacactctccatga

SEQ ID NO: 218817 - DNA, 23 bp, Mus musculus
ctgtttagacagacataaatctg

SEQ ID NO: 218818 - DNA, 20 bp, Mus musculus
ttttgtacttagacagaaag

SEQ ID NO: 218819 - DNA, 19 bp, Mus musculus
agagggggagttaaaattg

SEQ ID NO: 218820 - DNA, 20 bp, Mus musculus
tctcagtcaactgctggtag

SEQ ID NO: 218821 - DNA, 21 bp, Mus musculus
tgttttgtgaccaattatatg

SEQ ID NO: 218822 - DNA, 23 bp, Mus musculus
ttttgagaaatgtgtgtgagcac

SEQ ID NO: 218823 - DNA, 23 bp, Mus musculus
tcacttccttgtataggcattca

SEQ ID NO: 218824 - DNA, 21 bp, Mus musculus
tatctagatgcaattctctga

SEQ ID NO: 218825 - DNA, 21 bp, Mus musculus
tgtgtgtctctctctgtctgt

SEQ ID NO: 218826 - DNA, 18 bp, Mus musculus
taaggtagtaaatatttt

SEQ ID NO: 218827 - DNA, 23 bp, Mus musculus
tgtgtgtgtgtgtgtatgcatgt

SEQ ID NO: 218828 - DNA, 21 bp, Mus musculus
atatagctacatataatttca

SEQ ID NO: 218829 - DNA, 22 bp, Mus musculus
actttctacttgatttgttgca

SEQ ID NO: 218830 - DNA, 23 bp, Mus musculus
tagtgtgcatttgtatgtgtgtg

SEQ ID NO: 218831 - DNA, 23 bp, Mus musculus
tataaggtagatttagtatgtat

SEQ ID NO: 218832 - DNA, 23 bp, Mus musculus
atttcagtgggatctttcctggt

SEQ ID NO: 218833 - DNA, 18 bp, Mus musculus
aaaatccttcatatgcat

SEQ ID NO: 218834 - DNA, 23 bp, Mus musculus
tgcaatgaaaagtagtttcctca

SEQ ID NO: 218835 - DNA, 23 bp, Mus musculus
aaattgaacattttggagggagt

SEQ ID NO: 218836 - DNA, 23 bp, Mus musculus
ttagtctgtgtttttctgtgctg

SEQ ID NO: 218837 - DNA, 20 bp, Mus musculus
acacacacatatatatatgt

SEQ ID NO: 218838 - DNA, 23 bp, Mus musculus
atatacatatgtatatgtgtgta

SEQ ID NO: 218839 - DNA, 22 bp, Mus musculus
tctgtgtaggtgtgtgtgtata

SEQ ID NO: 218840 - DNA, 20 bp, Mus musculus
gtgtgtgtgtgtgtgtgtat

SEQ ID NO: 218841 - DNA, 20 bp, Mus musculus
tggttatctgataggatgca

SEQ ID NO: 218842 - DNA, 23 bp, Mus musculus
tctgttgagacctgttttgtgac

SEQ ID NO: 218843 - DNA, 21 bp, Mus musculus
tatatgtgtgtgtgtgtgtat

SEQ ID NO: 218844 - DNA, 21 bp, Mus musculus
aaagcgtcttctagcttgctc

SEQ ID NO: 218845 - DNA, 23 bp, Mus musculus
tactgatggataatgatgctaaa

SEQ ID NO: 218846 - DNA, 23 bp, Mus musculus
tagtccatgaccatgagtttaga

SEQ ID NO: 218847 - DNA, 22 bp, Mus musculus
tcattggcacaggaaaaggtgt

SEQ ID NO: 218848 - DNA, 20 bp, Mus musculus
agtcctattctgttgtattt

SEQ ID NO: 218849 - DNA, 21 bp, Mus musculus
attgtcactcatacaatttgc

SEQ ID NO: 218850 - DNA, 23 bp, Mus musculus
ttcagagtctcttaatctctctg

SEQ ID NO: 218851 - DNA, 21 bp, Mus musculus
cacgcagatgctgagtaactg

SEQ ID NO: 218852 - DNA, 23 bp, Mus musculus
cagtgggtcagtgggtcactggg

SEQ ID NO: 218853 - DNA, 19 bp, Mus musculus
acaattcatgtctgtttgc

SEQ ID NO: 218854 - DNA, 23 bp, Mus musculus
aggctctgtctctgtctctttct

SEQ ID NO: 218855 - DNA, 21 bp, Mus musculus
agaattgcttgataaggcaaa

SEQ ID NO: 218856 - DNA, 18 bp, Mus musculus
aggaaggtattgttgctc

SEQ ID NO: 218857 - DNA, 23 bp, Mus musculus
tgtgtatgcatatgtatatgtat

SEQ ID NO: 218858 - DNA, 19 bp, Mus musculus
tatgtacatttgtatatac

SEQ ID NO: 218859 - DNA, 23 bp, Mus musculus
ggctttgaaatcactgcctctgt

SEQ ID NO: 218860 - DNA, 19 bp, Mus musculus
tgttgagaggatgtactaa

SEQ ID NO: 218861 - DNA, 23 bp, Mus musculus
gaatcttgaagaaggtgacttca

SEQ ID NO: 218862 - DNA, 20 bp, Mus musculus
tatgcttatataaacatata

SEQ ID NO: 218863 - DNA, 23 bp, Mus musculus
atgcatttacacacatgtataca

SEQ ID NO: 218864 - DNA, 23 bp, Mus musculus
gatctgagtctgtctcagtcagt

SEQ ID NO: 218865 - DNA, 22 bp, Mus musculus
tgttttgtgaccaattatatgg

SEQ ID NO: 218866 - DNA, 22 bp, Mus musculus
tgttttgtgaccaattatatgg

SEQ ID NO: 218867 - DNA, 22 bp, Mus musculus
tgcacttgtgtgcgtgtgtata

SEQ ID NO: 218868 - DNA, 23 bp, Mus musculus
atatatgtatttttctaggtgta

SEQ ID NO: 218869 - DNA, 23 bp, Mus musculus
tgtctggctgtgtgtctctatac

SEQ ID NO: 218870 - DNA, 23 bp, Mus musculus
tctagagactagagagtctggag

SEQ ID NO: 218871 - DNA, 21 bp, Mus musculus
agaagttaagttcttgatcct

SEQ ID NO: 218872 - DNA, 21 bp, Mus musculus
atatatacacacacttgtaga

SEQ ID NO: 218873 - DNA, 23 bp, Mus musculus
ttagtgtctctgtgtgtgcgtgt

SEQ ID NO: 218874 - DNA, 23 bp, Mus musculus
gtctgtctctgtctctatgttct

SEQ ID NO: 218875 - DNA, 22 bp, Mus musculus
aatttagtattggggctggaga

SEQ ID NO: 218876 - DNA, 20 bp, Mus musculus
atatgtatatatacatatgt

SEQ ID NO: 218877 - DNA, 23 bp, Mus musculus
atatacatgcatatatatacata

SEQ ID NO: 218878 - DNA, 22 bp, Mus musculus
tgttttgtgaccaattatatgg

SEQ ID NO: 218879 - DNA, 23 bp, Mus musculus
cagagagtgctaattatttgcat

SEQ ID NO: 218880 - DNA, 18 bp, Mus musculus
taacagacgatttcatag

SEQ ID NO: 218881 - DNA, 20 bp, Mus musculus
atatgtatgtatatatatgt

SEQ ID NO: 218882 - DNA, 23 bp, Mus musculus
tgtctctatctgtcagatatcct

SEQ ID NO: 218883 - DNA, 23 bp, Mus musculus
tctgagagtcaagtgtgtgatca

SEQ ID NO: 218884 - DNA, 23 bp, Mus musculus
aattgtgctaatgaagaagaatg

SEQ ID NO: 218885 - DNA, 19 bp, Mus musculus
tgtgtgcttgtttagatat

SEQ ID NO: 218886 - DNA, 23 bp, Mus musculus
atgaagtggatgtgtgtatatat

SEQ ID NO: 218887 - DNA, 23 bp, Mus musculus
tatatatgtgtatacacacacac

SEQ ID NO: 218888 - DNA, 22 bp, Mus musculus
tgttttgtgaccaattatatgg

SEQ ID NO: 218889 - DNA, 23 bp, Mus musculus
aatctacatgtattacatgcata

SEQ ID NO: 218890 - DNA, 23 bp, Mus musculus
tatatgcatgtaaatgtatgttt

SEQ ID NO: 218891 - DNA, 23 bp, Mus musculus
atgcatatatgtaaatatgtatg

SEQ ID NO: 218892 - DNA, 23 bp, Mus musculus
tatatgtgtatatgtatatatgt

SEQ ID NO: 218893 - DNA, 20 bp, Mus musculus
ttaacctcatgagaggggct

SEQ ID NO: 218894 - DNA, 22 bp, Mus musculus
tgacagaggtgactgagctggt

SEQ ID NO: 218895 - DNA, 21 bp, Mus musculus
tatgtataaatgtataagtgt

SEQ ID NO: 218896 - DNA, 21 bp, Mus musculus
aattgtactctttaagttgta

SEQ ID NO: 218897 - DNA, 21 bp, Mus musculus
actatagagtattagttaacg

SEQ ID NO: 218898 - DNA, 18 bp, Mus musculus
ctgtgggaaagtttggcg

SEQ ID NO: 218899 - DNA, 22 bp, Mus musculus
tgttttgtgaccaattatatgg

SEQ ID NO: 218900 - DNA, 22 bp, Mus musculus
tgtatgtatatgtatataggta

SEQ ID NO: 218901 - DNA, 21 bp, Mus musculus
ccaaggtgaggcagtctctgg

SEQ ID NO: 218902 - DNA, 23 bp, Mus musculus
tctctaagtctctgcttcacact

SEQ ID NO: 218903 - DNA, 23 bp, Mus musculus
atgctgcaagagagaactgaaat

SEQ ID NO: 218904 - DNA, 22 bp, Mus musculus
atatgtgtatatgtatatatat

SEQ ID NO: 218905 - DNA, 22 bp, Mus musculus
tatgtgtgtatatacgcatgtg

SEQ ID NO: 218906 - DNA, 23 bp, Mus musculus
aaactgagttatttttcttttct

SEQ ID NO: 218907 - DNA, 22 bp, Mus musculus
tgttttgtgaccaattatatgg

SEQ ID NO: 218908 - DNA, 20 bp, Mus musculus
tgagagcagagtgagcccaa

SEQ ID NO: 218909 - DNA, 23 bp, Mus musculus
tctgctcttctggaagttctctc

SEQ ID NO: 218910 - DNA, 23 bp, Mus musculus
agtccatggtgaagtgataggaa

SEQ ID NO: 218911 - DNA, 22 bp, Mus musculus
tgttttgtgaccaattatatgg

SEQ ID NO: 218912 - DNA, 20 bp, Mus musculus
tccatccatccatctatctg

SEQ ID NO: 218913 - DNA, 23 bp, Mus musculus
acattgttgacactgctataaat

SEQ ID NO: 218914 - DNA, 22 bp, Mus musculus
ctgtcactgactgccagacctc

SEQ ID NO: 218915 - DNA, 19 bp, Mus musculus
atcacagcagttaccaata

SEQ ID NO: 218916 - DNA, 21 bp, Mus musculus
tacagtttagatgtcatagaa

SEQ ID NO: 218917 - DNA, 23 bp, Mus musculus
gtctgtgtgtctatgtatactga

SEQ ID NO: 218918 - DNA, 19 bp, Mus musculus
gactctggtggggctggtg

SEQ ID NO: 218919 - DNA, 20 bp, Mus musculus
aagagcactgactgctcttt

SEQ ID NO: 218920 - DNA, 22 bp, Mus musculus
tgttttgtgaccaattatatgg

SEQ ID NO: 218921 - DNA, 23 bp, Mus musculus
tacacccatggcagtggctgaat

SEQ ID NO: 218922 - DNA, 23 bp, Mus musculus
agctattgttgatgatgtggtag

SEQ ID NO: 218923 - DNA, 23 bp, Mus musculus
cttttgtgaatggtttgccatgg

SEQ ID NO: 218924 - DNA, 23 bp, Mus musculus
atttcacatgctgaaacttcaca

SEQ ID NO: 218925 - DNA, 23 bp, Mus musculus
tagtgcatggtgatctgatagga

SEQ ID NO: 218926 - DNA, 22 bp, Mus musculus
tgttttgtgacctattatgtgg

SEQ ID NO: 218927 - DNA, 21 bp, Mus musculus
acagtgagaaggcagctcctt

SEQ ID NO: 218928 - DNA, 19 bp, Mus musculus
agagcacctaagtgctggg

SEQ ID NO: 218929 - DNA, 23 bp, Mus musculus
tttctgtggtttagatatcagag

SEQ ID NO: 218930 - DNA, 22 bp, Mus musculus
aatctctgtgagttcatatgtt

SEQ ID NO: 218931 - DNA, 23 bp, Mus musculus
tggatgtgagtggcaaacttccc

SEQ ID NO: 218932 - DNA, 22 bp, Mus musculus
tgagcatctgcatctgtattgg

SEQ ID NO: 218933 - DNA, 22 bp, Mus musculus
ttatctcttttatatttaaagt

SEQ ID NO: 218934 - DNA, 22 bp, Mus musculus
tctggctcactctgatctgtgt

SEQ ID NO: 218935 - DNA, 23 bp, Mus musculus
aagagctgtcattttgttgtctt

SEQ ID NO: 218936 - DNA, 20 bp, Mus musculus
ttgtatatatttatgtatgt

SEQ ID NO: 218937 - DNA, 20 bp, Mus musculus
tgcatgtatgtatgtatgta

SEQ ID NO: 218938 - DNA, 23 bp, Mus musculus
tgtattctatgtggaagatgtca

SEQ ID NO: 218939 - DNA, 23 bp, Mus musculus
actgaagtacagaggctaatcac

SEQ ID NO: 218940 - DNA, 21 bp, Mus musculus
tttgcatccatgtatgtctga

SEQ ID NO: 218941 - DNA, 21 bp, Mus musculus
tgttttgtgaccaattatatg

SEQ ID NO: 218942 - DNA, 23 bp, Mus musculus
tcagtgactatatgtgctagtgt

SEQ ID NO: 218943 - DNA, 20 bp, Mus musculus
tttacaaatgtgagtgtact

SEQ ID NO: 218944 - DNA, 23 bp, Mus musculus
ttacagttcagtgagagcagtgc

SEQ ID NO: 218945 - DNA, 20 bp, Mus musculus
tcacagaactgagtgacttg

SEQ ID NO: 218946 - DNA, 18 bp, Mus musculus
attgttatacacatacat

SEQ ID NO: 218947 - DNA, 21 bp, Mus musculus
tgagagtggagagagaggtca

SEQ ID NO: 218948 - DNA, 23 bp, Mus musculus
tcagtcactatctcagcctcttt

SEQ ID NO: 218949 - DNA, 20 bp, Mus musculus
atggttgtagttttttgttt

SEQ ID NO: 218950 - DNA, 23 bp, Mus musculus
atgtatacatgtatgtatacttg

SEQ ID NO: 218951 - DNA, 20 bp, Mus musculus
cctttagaatgtatatatgt

SEQ ID NO: 218952 - DNA, 23 bp, Mus musculus
atgtatgcatatatgtatgtatg

SEQ ID NO: 218953 - DNA, 19 bp, Mus musculus
atatctatgtatttatgta

SEQ ID NO: 218954 - DNA, 23 bp, Mus musculus
taattatatatgtgtatgtatat

SEQ ID NO: 218955 - DNA, 19 bp, Mus musculus
tatgagcaacttggttgca

SEQ ID NO: 218956 - DNA, 18 bp, Mus musculus
tatagtttgtagctgtga

SEQ ID NO: 218957 - DNA, 22 bp, Mus musculus
tgttttgtgaccaattatatgg

SEQ ID NO: 218958 - DNA, 23 bp, Mus musculus
tgtgtatgcatgtatatatgtat

SEQ ID NO: 218959 - DNA, 23 bp, Mus musculus
tgtgtggttttctttcactttct

SEQ ID NO: 218960 - DNA, 19 bp, Mus musculus
taatagttacataagtgag

SEQ ID NO: 218961 - DNA, 23 bp, Mus musculus
gtggtgagagacaagacagagct

SEQ ID NO: 218962 - DNA, 23 bp, Mus musculus
gtctgactcactcagaggctgcc

SEQ ID NO: 218963 - DNA, 23 bp, Mus musculus
agagagtagagtgagacaacatg

SEQ ID NO: 218964 - DNA, 23 bp, Mus musculus
gcttgactgtgtctgtgtgtgtg

SEQ ID NO: 218965 - DNA, 19 bp, Mus musculus
agagtttggctgggtatag

SEQ ID NO: 218966 - DNA, 23 bp, Mus musculus
tctcagtgtctgtataacatctg

SEQ ID NO: 218967 - DNA, 23 bp, Mus musculus
gtttttgcctgtggtacacactg

SEQ ID NO: 218968 - DNA, 22 bp, Mus musculus
taatgtgtatatgtggatgtgc

SEQ ID NO: 218969 - DNA, 22 bp, Mus musculus
tgtgtgtgtatggaatgtgtgt

SEQ ID NO: 218970 - DNA, 21 bp, Mus musculus
agtgtgtgtgtgtatgtatat

SEQ ID NO: 218971 - DNA, 23 bp, Mus musculus
gtatgtatgtaaatatgtatgta

SEQ ID NO: 218972 - DNA, 23 bp, Mus musculus
tctaacactctgtgactgtgagc

SEQ ID NO: 218973 - DNA, 23 bp, Mus musculus
tagtgcatggtgatctgatagga

SEQ ID NO: 218974 - DNA, 23 bp, Mus musculus
tatgtgtgtgtatatgtatatat

SEQ ID NO: 218975 - DNA, 23 bp, Mus musculus
tctctagagactgagcactggat

SEQ ID NO: 218976 - DNA, 23 bp, Mus musculus
ttactcagctgaagaagcccttt

SEQ ID NO: 218977 - DNA, 23 bp, Mus musculus
ttctgaaatctcttcctctgact

SEQ ID NO: 218978 - DNA, 23 bp, Mus musculus
cgtgtgcatgcatgtgtgtgtgt

SEQ ID NO: 218979 - DNA, 23 bp, Mus musculus
atgtatgtatgtatgtgtgtatg

SEQ ID NO: 218980 - DNA, 18 bp, Mus musculus
atttaagttcctatagtt

SEQ ID NO: 218981 - DNA, 22 bp, Mus musculus
tagagggaggcttacatgagtc

SEQ ID NO: 218982 - DNA, 23 bp, Mus musculus
gagagacaagatcctggctttct

SEQ ID NO: 218983 - DNA, 22 bp, Mus musculus
tgttttgtgaccaattatatgg

SEQ ID NO: 218984 - DNA, 23 bp, Mus musculus
atgtatgtatgcatgtgtttgca

SEQ ID NO: 218985 - DNA, 18 bp, Mus musculus
acatggaggacactaaca

SEQ ID NO: 218986 - DNA, 23 bp, Mus musculus
aagagtcattttcttcttctttc

SEQ ID NO: 218987 - DNA, 20 bp, Mus musculus
atggcaaggtaggaggtgga

SEQ ID NO: 218988 - DNA, 23 bp, Mus musculus
tgtctctctctcaccaccaagtg

SEQ ID NO: 218989 - DNA, 22 bp, Mus musculus
ctgtctcagcctctccctctct

SEQ ID NO: 218990 - DNA, 21 bp, Mus musculus
ttggagtcggtcagcagagtg

SEQ ID NO: 218991 - DNA, 23 bp, Mus musculus
tgtatgcatgtctgtctgtctgt

SEQ ID NO: 218992 - DNA, 18 bp, Mus musculus
tatgtgtgtatataaatg

SEQ ID NO: 218993 - DNA, 21 bp, Mus musculus
tcattggtgatcaagctgaac

SEQ ID NO: 218994 - DNA, 22 bp, Mus musculus
tgttttgtgaccaattatatgg

SEQ ID NO: 218995 - DNA, 21 bp, Mus musculus
tattggagctgaagagatggc

SEQ ID NO: 218996 - DNA, 18 bp, Mus musculus
tgtatttacatcaggttg

SEQ ID NO: 218997 - DNA, 19 bp, Mus musculus
atgtatacatatactatgg

SEQ ID NO: 218998 - DNA, 22 bp, Mus musculus
tggatggatagatgatagtggt

SEQ ID NO: 218999 - DNA, 23 bp, Mus musculus
tgccacagagaaaacactgaggt

SEQ ID NO: 219000 - DNA, 23 bp, Mus musculus
tgagtgcatgtgtgtgtgtgtgt

SEQ ID NO: 219001 - DNA, 23 bp, Mus musculus
tatatgtgtgtatatgtatgtgt

SEQ ID NO: 219002 - DNA, 21 bp, Mus musculus
tatgtcatatacacatatatg

SEQ ID NO: 219003 - DNA, 23 bp, Mus musculus
gaatgtggatatgttttcagata

SEQ ID NO: 219004 - DNA, 23 bp, Mus musculus
tttgtcactgcaagagttctctc

SEQ ID NO: 219005 - DNA, 22 bp, Mus musculus
aggctgatttagagatccttgt

SEQ ID NO: 219006 - DNA, 22 bp, Mus musculus
actttggtttttatgctctttg

SEQ ID NO: 219007 - DNA, 18 bp, Mus musculus
tatatgtacgtatgtatg

SEQ ID NO: 219008 - DNA, 23 bp, Mus musculus
atgcatgcatgtatgtatgtgtg

SEQ ID NO: 219009 - DNA, 23 bp, Mus musculus
tatatgtacatatacatatgtat

SEQ ID NO: 219010 - DNA, 23 bp, Mus musculus
tgcatgtatgtatgtgtgtatgt

SEQ ID NO: 219011 - DNA, 23 bp, Mus musculus
atgtgagtggatgtgaattgttt

SEQ ID NO: 219012 - DNA, 23 bp, Mus musculus
atcctggtgcctaagaatccaga

SEQ ID NO: 219013 - DNA, 23 bp, Mus musculus
tgtctgtctgtatgtctctgtgc

SEQ ID NO: 219014 - DNA, 23 bp, Mus musculus
tataagtgtatatgtatatgtgt

SEQ ID NO: 219015 - DNA, 19 bp, Mus musculus
tatgtgtgtcatatatatc

SEQ ID NO: 219016 - DNA, 22 bp, Mus musculus
tgttttgtgaccaattatatgg

SEQ ID NO: 219017 - DNA, 22 bp, Mus musculus
tgtgtgtgtgtgtatatgatgt

SEQ ID NO: 219018 - DNA, 23 bp, Mus musculus
ttaagtaagctatcctttaccac

SEQ ID NO: 219019 - DNA, 23 bp, Mus musculus
acatgtatgtttactcacagaca

SEQ ID NO: 219020 - DNA, 19 bp, Mus musculus
ttctctctgccacacttag

SEQ ID NO: 219021 - DNA, 23 bp, Mus musculus
actctctcagcctctgtgatgtc

SEQ ID NO: 219022 - DNA, 23 bp, Mus musculus
caagtgttctctcagagctggac

SEQ ID NO: 219023 - DNA, 23 bp, Mus musculus
tccatgtcaagagattttcttca

SEQ ID NO: 219024 - DNA, 22 bp, Mus musculus
attatgtgtatagtgtatgtat

SEQ ID NO: 219025 - DNA, 20 bp, Mus musculus
atatacatatagtgtatgta

SEQ ID NO: 219026 - DNA, 23 bp, Mus musculus
gaaactgagggtggttttcatga

SEQ ID NO: 219027 - DNA, 23 bp, Mus musculus
atttcttgtgattctttgtctga

SEQ ID NO: 219028 - DNA, 23 bp, Mus musculus
taatagtgtcaggatttagtgtg

SEQ ID NO: 219029 - DNA, 22 bp, Mus musculus
tgttttgtgaccaattatatgg

SEQ ID NO: 219030 - DNA, 22 bp, Mus musculus
tgttttgtgaccaattatatgg

SEQ ID NO: 219031 - DNA, 21 bp, Mus musculus
agagagaataggattagagaa

SEQ ID NO: 219032 - DNA, 23 bp, Mus musculus
cacacatgtgtatctgtatgttt

SEQ ID NO: 219033 - DNA, 20 bp, Mus musculus
attgtctagaaatcaagtac

SEQ ID NO: 219034 - DNA, 21 bp, Mus musculus
agagcaacagtgtgcacatca

SEQ ID NO: 219035 - DNA, 23 bp, Mus musculus
attactgcctctctctgtgtctg

SEQ ID NO: 219036 - DNA, 23 bp, Mus musculus
tatgtatctatgtatttatgtac

SEQ ID NO: 219037 - DNA, 22 bp, Mus musculus
tgttttgtgaccaattatatgg

SEQ ID NO: 219038 - DNA, 23 bp, Mus musculus
tgtgtatgcttgtgtgtgtgttc

SEQ ID NO: 219039 - DNA, 23 bp, Mus musculus
gaatgtatgtatgtatgtgtgtg

SEQ ID NO: 219040 - DNA, 19 bp, Mus musculus
ttgtcctttgtatttgtaa

SEQ ID NO: 219041 - DNA, 20 bp, Mus musculus
gatttgtcaagaagatcaag

SEQ ID NO: 219042 - DNA, 23 bp, Mus musculus
tagcttgaaatgacagtgtgcac

SEQ ID NO: 219043 - DNA, 19 bp, Mus musculus
actgtgaattctaagccag

SEQ ID NO: 219044 - DNA, 23 bp, Mus musculus
cagaacacagaggctgagacctg

SEQ ID NO: 219045 - DNA, 23 bp, Mus musculus
actctcagactctatttgaccag

SEQ ID NO: 219046 - DNA, 23 bp, Mus musculus
gcagagaagatagtatactcttg

SEQ ID NO: 219047 - DNA, 23 bp, Mus musculus
ataactggtagaacatttctact

SEQ ID NO: 219048 - DNA, 23 bp, Mus musculus
attattgtagaggctgtggttag

SEQ ID NO: 219049 - DNA, 23 bp, Mus musculus
tgtgcagagagaaaacagaggga

SEQ ID NO: 219050 - DNA, 23 bp, Mus musculus
agtcctttacattcccacttttc

SEQ ID NO: 219051 - DNA, 23 bp, Mus musculus
gatctcagtactttggtatgtca

SEQ ID NO: 219052 - DNA, 23 bp, Mus musculus
tttcacgacctaaaagctggaat

SEQ ID NO: 219053 - DNA, 22 bp, Mus musculus
tgttttgtgaccaattatatgg

SEQ ID NO: 219054 - DNA, 23 bp, Mus musculus
tgctggcaagttttcagagtgta

SEQ ID NO: 219055 - DNA, 23 bp, Mus musculus
attctgcatgtgcaagtgtatgc

SEQ ID NO: 219056 - DNA, 23 bp, Mus musculus
ctgtctctctgtctgtgtgtgtg

SEQ ID NO: 219057 - DNA, 22 bp, Mus musculus
tgttttgtgaccaattatatgg

SEQ ID NO: 219058 - DNA, 23 bp, Mus musculus
tcagtcccagtgtctgtctttcc

SEQ ID NO: 219059 - DNA, 23 bp, Mus musculus
tactgttaggatgattagagact

SEQ ID NO: 219060 - DNA, 19 bp, Mus musculus
acagcatatatatgacata

SEQ ID NO: 219061 - DNA, 19 bp, Mus musculus
actcactctttgagtcaca

SEQ ID NO: 219062 - DNA, 23 bp, Mus musculus
tatgtatatgtatatatatgtgt

SEQ ID NO: 219063 - DNA, 23 bp, Mus musculus
tatgtgtatgtatgtatatgtgt

SEQ ID NO: 219064 - DNA, 23 bp, Mus musculus
atgctgccactgttttacctgtc

SEQ ID NO: 219065 - DNA, 22 bp, Mus musculus
tgttttgtgaccaattatatgg

SEQ ID NO: 219066 - DNA, 18 bp, Mus musculus
ctctctcactgtgtggtc

SEQ ID NO: 219067 - DNA, 22 bp, Mus musculus
tgttttgtgaccaattatatgg

SEQ ID NO: 219068 - DNA, 23 bp, Mus musculus
ctctgtgtgtctgtgtgtctcca

SEQ ID NO: 219069 - DNA, 23 bp, Mus musculus
tttgagttcacagtcactgcatt

SEQ ID NO: 219070 - DNA, 22 bp, Mus musculus
tgagttgataatgattggagga

SEQ ID NO: 219071 - DNA, 20 bp, Mus musculus
atgttattatgttattctca

SEQ ID NO: 219072 - DNA, 23 bp, Mus musculus
ttctttctatttgtattgcattc

SEQ ID NO: 219073 - DNA, 19 bp, Mus musculus
tattacaaaactatagaga

SEQ ID NO: 219074 - DNA, 23 bp, Mus musculus
ctctatgtctatatatgtatgta

SEQ ID NO: 219075 - DNA, 21 bp, Mus musculus
tgacctactagtccatcctca

SEQ ID NO: 219076 - DNA, 23 bp, Mus musculus
gagtctctctgtgtgtttagtcc

SEQ ID NO: 219077 - DNA, 21 bp, Mus musculus
tccatggtggtcagataggat

SEQ ID NO: 219078 - DNA, 22 bp, Mus musculus
tgttttgtgaccaattatatgg

SEQ ID NO: 219079 - DNA, 22 bp, Mus musculus
tgatgactacagatgttgaaca

SEQ ID NO: 219080 - DNA, 19 bp, Mus musculus
tctcagcccttctgtattc

SEQ ID NO: 219081 - DNA, 23 bp, Mus musculus
attcatgattcattgctctggga

SEQ ID NO: 219082 - DNA, 21 bp, Mus musculus
tatgtgtcattggtttcaaag

SEQ ID NO: 219083 - DNA, 23 bp, Mus musculus
ataagtgtgaggaattgctttgg

SEQ ID NO: 219084 - DNA, 19 bp, Mus musculus
ttgtcattttcattagtgg

SEQ ID NO: 219085 - DNA, 23 bp, Mus musculus
tgtgtgtgttagtcactcatcta

SEQ ID NO: 219086 - DNA, 23 bp, Mus musculus
ctgttgtctgtgtgtctgttagc

SEQ ID NO: 219087 - DNA, 21 bp, Mus musculus
aagtccttgggcaaactgcta

SEQ ID NO: 219088 - DNA, 21 bp, Mus musculus
tccatggtggtctgataggat

SEQ ID NO: 219089 - DNA, 22 bp, Mus musculus
tgttttgtgaccaattatatgg

SEQ ID NO: 219090 - DNA, 21 bp, Mus musculus
ttatatgtacttatgtgtatg

SEQ ID NO: 219091 - DNA, 23 bp, Mus musculus
gctcctgactcagtctctctgtc

SEQ ID NO: 219092 - DNA, 21 bp, Mus musculus
tatctacatatgtatgtatgt

SEQ ID NO: 219093 - DNA, 23 bp, Mus musculus
atatgtacatatactatatgtgt

SEQ ID NO: 219094 - DNA, 23 bp, Mus musculus
agagagaaaactcagagcttaca

SEQ ID NO: 219095 - DNA, 22 bp, Mus musculus
tggacgatgtgattgtcttctt

SEQ ID NO: 219096 - DNA, 20 bp, Mus musculus
tctctgtgagtcaaagttca

SEQ ID NO: 219097 - DNA, 18 bp, Mus musculus
gacctcacaaaggagtag

SEQ ID NO: 219098 - DNA, 22 bp, Mus musculus
agagtagaaaaggcactcttct

SEQ ID NO: 219099 - DNA, 23 bp, Mus musculus
actggtgttcactgtctctctca

SEQ ID NO: 219100 - DNA, 23 bp, Mus musculus
taggtgacagtagatagtatgga

SEQ ID NO: 219101 - DNA, 22 bp, Mus musculus
tttactgtccataacctaaaga

SEQ ID NO: 219102 - DNA, 22 bp, Mus musculus
aatgccagtgcatgaaatcaga

SEQ ID NO: 219103 - DNA, 23 bp, Mus musculus
ggcactgactgctcttccagagg

SEQ ID NO: 219104 - DNA, 21 bp, Mus musculus
atgtaagtgtgcatatgtatg

SEQ ID NO: 219105 - DNA, 23 bp, Mus musculus
atcagaactgtttttgtaggttt

SEQ ID NO: 219106 - DNA, 23 bp, Mus musculus
aaccttaatcactaatttgatgt

SEQ ID NO: 219107 - DNA, 23 bp, Mus musculus
tagattgtgtgcatgtgcatgtc

SEQ ID NO: 219108 - DNA, 20 bp, Mus musculus
gacagggtttctctgtgtaa

SEQ ID NO: 219109 - DNA, 21 bp, Mus musculus
tttccatcttctaagtgttca

SEQ ID NO: 219110 - DNA, 23 bp, Mus musculus
gttaatttattggactggcagga

SEQ ID NO: 219111 - DNA, 23 bp, Mus musculus
acttgtctctctgtcaccctgtg

SEQ ID NO: 219112 - DNA, 20 bp, Mus musculus
agacaaatccttacagtgtg

SEQ ID NO: 219113 - DNA, 20 bp, Mus musculus
actcagtggctcatttctgt

SEQ ID NO: 219114 - DNA, 18 bp, Mus musculus
agggagagtgatatgaaa

SEQ ID NO: 219115 - DNA, 23 bp, Mus musculus
cctctctgtccatctgtctgtct

SEQ ID NO: 219116 - DNA, 23 bp, Mus musculus
actgagtagagcttagagccctg

SEQ ID NO: 219117 - DNA, 23 bp, Mus musculus
tttttctctctgtctgtgtacca

SEQ ID NO: 219118 - DNA, 22 bp, Mus musculus
taactgagtacagagtaggcgg

SEQ ID NO: 219119 - DNA, 20 bp, Mus musculus
tggatgtatgtatgtatgta

SEQ ID NO: 219120 - DNA, 21 bp, Mus musculus
atatatgtatatgtatatgtg

SEQ ID NO: 219121 - DNA, 18 bp, Mus musculus
aagaagctacagttgctg

SEQ ID NO: 219122 - DNA, 18 bp, Mus musculus
ttggttaggacatgaatg

SEQ ID NO: 219123 - DNA, 23 bp, Mus musculus
tgtatgtacatgtgcatgtgtat

SEQ ID NO: 219124 - DNA, 21 bp, Mus musculus
tatgagatagtttgaataggt

SEQ ID NO: 219125 - DNA, 22 bp, Mus musculus
taagagtgaagacagagagaaa

SEQ ID NO: 219126 - DNA, 23 bp, Mus musculus
tgtgcatgtctctctctctctct

SEQ ID NO: 219127 - DNA, 23 bp, Mus musculus
tgtatgtgtatatgtatatgtgt

SEQ ID NO: 219128 - DNA, 22 bp, Mus musculus
agtgaaacagttctacctggag

SEQ ID NO: 219129 - DNA, 20 bp, Mus musculus
atatacacacacatatacgt

SEQ ID NO: 219130 - DNA, 22 bp, Mus musculus
gactggctcacacactctcccc

SEQ ID NO: 219131 - DNA, 22 bp, Mus musculus
atgctgggagttgtagttctta

SEQ ID NO: 219132 - DNA, 23 bp, Mus musculus
ttgtgctagctgatactttctat

SEQ ID NO: 219133 - DNA, 23 bp, Mus musculus
tgtaagtgctctgggttatgtct

SEQ ID NO: 219134 - DNA, 22 bp, Mus musculus
tgttttgtgaccaattatatgg

SEQ ID NO: 219135 - DNA, 22 bp, Mus musculus
aatctgtcttttcttgcattgg

SEQ ID NO: 219136 - DNA, 23 bp, Mus musculus
tatatatgtatatatatgtgtgt

SEQ ID NO: 219137 - DNA, 23 bp, Mus musculus
tctatgaatgcctgtgcatgtgt

SEQ ID NO: 219138 - DNA, 18 bp, Mus musculus
tgtatacatgtatgtatg

SEQ ID NO: 219139 - DNA, 22 bp, Mus musculus
atgtatgcatgtatgtatgtat

SEQ ID NO: 219140 - DNA, 23 bp, Mus musculus
cagtctcacagattgtgttcatt

SEQ ID NO: 219141 - DNA, 22 bp, Mus musculus
tgttttgtgaccaattatatgg

SEQ ID NO: 219142 - DNA, 23 bp, Mus musculus
tcttttgttggttttctattcta

SEQ ID NO: 219143 - DNA, 21 bp, Mus musculus
atttcacagagataatgttga

SEQ ID NO: 219144 - DNA, 22 bp, Mus musculus
gaaaacaacctggagttctagg

SEQ ID NO: 219145 - DNA, 23 bp, Mus musculus
tccctgtctctgtgactctactc

SEQ ID NO: 219146 - DNA, 23 bp, Mus musculus
atgtatgtatgtatgtatgtatg

SEQ ID NO: 219147 - DNA, 23 bp, Mus musculus
gtatgtatgtatgtatgtgtgtg

SEQ ID NO: 219148 - DNA, 23 bp, Mus musculus
tctgtctcactcacaattttctg

SEQ ID NO: 219149 - DNA, 23 bp, Mus musculus
aagagacacaagataggagtgag

SEQ ID NO: 219150 - DNA, 23 bp, Mus musculus
cagacaggtttggaaatctctga

SEQ ID NO: 219151 - DNA, 23 bp, Mus musculus
tatatgtcacatgtacatatgtc

SEQ ID NO: 219152 - DNA, 23 bp, Mus musculus
aaatatatatttgtatatgtgag

SEQ ID NO: 219153 - DNA, 22 bp, Mus musculus
tatgagcatggttgttgtgtat

SEQ ID NO: 219154 - DNA, 23 bp, Mus musculus
agcaatactggatcataatggaa

SEQ ID NO: 219155 - DNA, 23 bp, Mus musculus
gattctgcaagttcatgtgtgtc

SEQ ID NO: 219156 - DNA, 22 bp, Mus musculus
tgttttgtgaccaattatatgg

SEQ ID NO: 219157 - DNA, 22 bp, Mus musculus
tgttttgtgaccaattatatgg

SEQ ID NO: 219158 - DNA, 23 bp, Mus musculus
atatgtgtgtgtatatgtgtgtg

SEQ ID NO: 219159 - DNA, 22 bp, Mus musculus
aaacacaaccatatatatgtgt

SEQ ID NO: 219160 - DNA, 23 bp, Mus musculus
tatattatgtgcatgtatacata

SEQ ID NO: 219161 - DNA, 21 bp, Mus musculus
caactcctgcaggaggaccta

SEQ ID NO: 219162 - DNA, 23 bp, Mus musculus
tcggctggtagtttccaggtagt

SEQ ID NO: 219163 - DNA, 23 bp, Mus musculus
ctgtatttgtgtctgtttgtagt

SEQ ID NO: 219164 - DNA, 23 bp, Mus musculus
tgagaggctctgtcagtgcctga

SEQ ID NO: 219165 - DNA, 23 bp, Mus musculus
gtgtgtgtgcatgtgcaagtgta

SEQ ID NO: 219166 - DNA, 23 bp, Mus musculus
cctgagacagaatggagagagca

SEQ ID NO: 219167 - DNA, 23 bp, Mus musculus
tcccactttctgtctctctctgg

SEQ ID NO: 219168 - DNA, 23 bp, Mus musculus
ttctctgtctggctctcttaaga

SEQ ID NO: 219169 - DNA, 23 bp, Mus musculus
acagtcaatcaaagatcagtctg

SEQ ID NO: 219170 - DNA, 23 bp, Mus musculus
tcagactgtggttgttcatagtt

SEQ ID NO: 219171 - DNA, 22 bp, Mus musculus
gaatcaccagatgctccagatt

SEQ ID NO: 219172 - DNA, 22 bp, Mus musculus
tgaggttctgggttcaattctt

SEQ ID NO: 219173 - DNA, 18 bp, Mus musculus
ttagcatcttgaataaac

SEQ ID NO: 219174 - DNA, 22 bp, Mus musculus
atgtatatatatatgtatgtgt

SEQ ID NO: 219175 - DNA, 22 bp, Mus musculus
tgttttgtgaccaattatatgg

SEQ ID NO: 219176 - DNA, 20 bp, Mus musculus
tctgctttttaatgtgtgtg

SEQ ID NO: 219177 - DNA, 20 bp, Mus musculus
tataaaagttgagaagctgt

SEQ ID NO: 219178 - DNA, 23 bp, Mus musculus
atgagctgggcctccactgtctg

SEQ ID NO: 219179 - DNA, 23 bp, Mus musculus
ctgtctgtctgtctgtctctaac

SEQ ID NO: 219180 - DNA, 23 bp, Mus musculus
tttctgagacagtctctcactgg

SEQ ID NO: 219181 - DNA, 23 bp, Mus musculus
cgtgtctcactctgagcctctgg

SEQ ID NO: 219182 - DNA, 23 bp, Mus musculus
acttcccagaattcacagtccac

SEQ ID NO: 219183 - DNA, 22 bp, Mus musculus
tgtgtatatgtatatacatatg

SEQ ID NO: 219184 - DNA, 22 bp, Mus musculus
tatatgtgtatatatgtatatg

SEQ ID NO: 219185 - DNA, 23 bp, Mus musculus
gatgaggtagaaggtagaagtga

SEQ ID NO: 219186 - DNA, 23 bp, Mus musculus
tctctctggcaccctgtttcccc

SEQ ID NO: 219187 - DNA, 23 bp, Mus musculus
acatacacacacatatagatgta

SEQ ID NO: 219188 - DNA, 23 bp, Mus musculus
gtatgtgtgtatatgtatgtata

SEQ ID NO: 219189 - DNA, 23 bp, Mus musculus
ctctcactgtgacagctgcttgt

SEQ ID NO: 219190 - DNA, 19 bp, Mus musculus
gtcagatgacagccagcag

SEQ ID NO: 219191 - DNA, 22 bp, Mus musculus
tttcctaattcgttccaatgct

SEQ ID NO: 219192 - DNA, 21 bp, Mus musculus
tactgactgctcttccagagg

SEQ ID NO: 219193 - DNA, 22 bp, Mus musculus
taacagaatatgtaaatgtttg

SEQ ID NO: 219194 - DNA, 23 bp, Mus musculus
agacttcagcagtcactcgacca

SEQ ID NO: 219195 - DNA, 20 bp, Mus musculus
aagtctgagagcatagttgg

SEQ ID NO: 219196 - DNA, 23 bp, Mus musculus
agagaagtgactgtgctctctct

SEQ ID NO: 219197 - DNA, 23 bp, Mus musculus
gtggctctctgtctgtgggagag

SEQ ID NO: 219198 - DNA, 23 bp, Mus musculus
tatgtatatgtatatgtatatgt

SEQ ID NO: 219199 - DNA, 23 bp, Mus musculus
gctagagtagtgaagttgtacat

SEQ ID NO: 219200 - DNA, 23 bp, Mus musculus
acaagcttcatttttgcagatgg

SEQ ID NO: 219201 - DNA, 23 bp, Mus musculus
tcccagagaagagtgtgagttgt

SEQ ID NO: 219202 - DNA, 23 bp, Mus musculus
tctcccagtctcactcagtcaca

SEQ ID NO: 219203 - DNA, 23 bp, Mus musculus
taagtctgtgactctcacaccta

SEQ ID NO: 219204 - DNA, 23 bp, Mus musculus
ttgctccatcactgtctttaaag

SEQ ID NO: 219205 - DNA, 18 bp, Mus musculus
gtgtgtcactgggagtgg

SEQ ID NO: 219206 - DNA, 23 bp, Mus musculus
ttcactcactctctgcttcctga

SEQ ID NO: 219207 - DNA, 22 bp, Mus musculus
ctgtctggctctatggctgcct

SEQ ID NO: 219208 - DNA, 23 bp, Mus musculus
gtgtgtgtatgtgtctgtgtgtg

SEQ ID NO: 219209 - DNA, 23 bp, Mus musculus
tgacagatctgtgtgagttttga

SEQ ID NO: 219210 - DNA, 22 bp, Mus musculus
catagtccatgttatttctgct

SEQ ID NO: 219211 - DNA, 23 bp, Mus musculus
acatctccatctgtctctctctg

SEQ ID NO: 219212 - DNA, 23 bp, Mus musculus
tctctgacactctctttgcctca

SEQ ID NO: 219213 - DNA, 21 bp, Mus musculus
cagcctctctgagtctgtgga

SEQ ID NO: 219214 - DNA, 19 bp, Mus musculus
tcacagctaagagagagtg

SEQ ID NO: 219215 - DNA, 23 bp, Mus musculus
tgtatgcatatgtatgtgtatac

SEQ ID NO: 219216 - DNA, 23 bp, Mus musculus
gaatgtgactctcagtctgactg

SEQ ID NO: 219217 - DNA, 23 bp, Mus musculus
tcaattctcagcatccacatggt

SEQ ID NO: 219218 - DNA, 22 bp, Mus musculus
tgggagctagagagatggctca

SEQ ID NO: 219219 - DNA, 20 bp, Mus musculus
aggcagaacacagagctcac

SEQ ID NO: 219220 - DNA, 23 bp, Mus musculus
cagcaatctacctgtgtctgtct

SEQ ID NO: 219221 - DNA, 23 bp, Mus musculus
tgtgtctctgtatgtatttttgt

SEQ ID NO: 219222 - DNA, 23 bp, Mus musculus
tctctgtgtgtatgtctgcatgc

SEQ ID NO: 219223 - DNA, 20 bp, Mus musculus
agacaccacatggtggctct

SEQ ID NO: 219224 - DNA, 23 bp, Mus musculus
tgctgatgtgtctgaagagagag

SEQ ID NO: 219225 - DNA, 23 bp, Mus musculus
tgactcactgtggcagagttttg

SEQ ID NO: 219226 - DNA, 22 bp, Mus musculus
ctagagtcacctgggaagagag

SEQ ID NO: 219227 - DNA, 22 bp, Mus musculus
tactgcttccttttccagcgtc

SEQ ID NO: 219228 - DNA, 22 bp, Mus musculus
tagattgtaaagaagagtgtgg

SEQ ID NO: 219229 - DNA, 23 bp, Mus musculus
acctttggacttagtactgagag

SEQ ID NO: 219230 - DNA, 22 bp, Mus musculus
gtgagtgcctgagtgcctgggt

SEQ ID NO: 219231 - DNA, 23 bp, Mus musculus
aagagagaaatgaagtcagcaag

SEQ ID NO: 219232 - DNA, 23 bp, Mus musculus
acacagaagacagacaggataaa

SEQ ID NO: 219233 - DNA, 23 bp, Mus musculus
agggtctctgtctctctatagcc

SEQ ID NO: 219234 - DNA, 23 bp, Mus musculus
aatgcctcatgttccattgagtg

SEQ ID NO: 219235 - DNA, 21 bp, Mus musculus
cagacagtaaagactgggctg

SEQ ID NO: 219236 - DNA, 22 bp, Mus musculus
tacacagaactatgacagcagc

SEQ ID NO: 219237 - DNA, 19 bp, Mus musculus
tgatgtggtgttggtgcac

SEQ ID NO: 219238 - DNA, 23 bp, Mus musculus
tgataatcttcctggaagatctc

SEQ ID NO: 219239 - DNA, 22 bp, Mus musculus
gatatcttccaacagtctgaca

SEQ ID NO: 219240 - DNA, 20 bp, Mus musculus
tgtgagagtcaagggacagc

SEQ ID NO: 219241 - DNA, 20 bp, Mus musculus
tcacacacacaagacgaggt

SEQ ID NO: 219242 - DNA, 22 bp, Mus musculus
tgtgtctgtgcatgtgcacatg

SEQ ID NO: 219243 - DNA, 23 bp, Mus musculus
tgtctctgtgactctctggtact

SEQ ID NO: 219244 - DNA, 23 bp, Mus musculus
tcaagtagaaggttctatagatg

SEQ ID NO: 219245 - DNA, 23 bp, Mus musculus
ttactgggtgcacagctcttctt

SEQ ID NO: 219246 - DNA, 21 bp, Mus musculus
atgtatgtatgtatgtatgtg

SEQ ID NO: 219247 - DNA, 23 bp, Mus musculus
tgcatgtgttttgttgatgtgtg

SEQ ID NO: 219248 - DNA, 21 bp, Mus musculus
agagtgagaacagtgtgagtg

SEQ ID NO: 219249 - DNA, 23 bp, Mus musculus
ctcacaagtgtccttcacagtgt

SEQ ID NO: 219250 - DNA, 23 bp, Mus musculus
ctgtgtgtctctgtgaggctcag

SEQ ID NO: 219251 - DNA, 23 bp, Mus musculus
cagacagagctcacagtggtgaa

SEQ ID NO: 219252 - DNA, 21 bp, Mus musculus
tttgactgagggaacaggctc

SEQ ID NO: 219253 - DNA, 20 bp, Mus musculus
aaagtgaggaaatttgcctg

SEQ ID NO: 219254 - DNA, 23 bp, Mus musculus
tttgttttaacagcaaatagctt

SEQ ID NO: 219255 - DNA, 23 bp, Mus musculus
cctctgtcactgtctgtcactgt

SEQ ID NO: 219256 - DNA, 22 bp, Mus musculus
acacccgcacactttgttttca

SEQ ID NO: 219257 - DNA, 18 bp, Mus musculus
tgagcaaggctgagtgag

SEQ ID NO: 219258 - DNA, 23 bp, Mus musculus
ctgagttcaaatcttatcagtct

SEQ ID NO: 219259 - DNA, 23 bp, Mus musculus
tcagtcagtcagtgactgcagtg

SEQ ID NO: 219260 - DNA, 21 bp, Mus musculus
agtacaggaacactgattttg

SEQ ID NO: 219261 - DNA, 23 bp, Mus musculus
ctcactgagaacagttgaaaggg

SEQ ID NO: 219262 - DNA, 21 bp, Mus musculus
tccatctgtgtttagcctctc

SEQ ID NO: 219263 - DNA, 20 bp, Mus musculus
ctcacttctctttgactgtg

SEQ ID NO: 219264 - DNA, 23 bp, Mus musculus
ctctcactgtctctgaggtttcc

SEQ ID NO: 219265 - DNA, 22 bp, Mus musculus
taagctgtcagcttaggtggca

SEQ ID NO: 219266 - DNA, 22 bp, Mus musculus
acgagtcacaggagctggagag

SEQ ID NO: 219267 - DNA, 23 bp, Mus musculus
agcaccagagtagacagtcctcc

SEQ ID NO: 219268 - DNA, 23 bp, Mus musculus
tctctcagtgtgacttggagtgg

SEQ ID NO: 219269 - DNA, 18 bp, Mus musculus
ctgagggactgtcatggc

SEQ ID NO: 219270 - DNA, 23 bp, Mus musculus
cctgtgactctgactcttaaatg

SEQ ID NO: 219271 - DNA, 23 bp, Mus musculus
tgtgtgcatgtgcatgtgcatgt

SEQ ID NO: 219272 - DNA, 20 bp, Mus musculus
agagtctaaggtttaggact

SEQ ID NO: 219273 - DNA, 21 bp, Mus musculus
ttctcttgctggtagtgactc

SEQ ID NO: 219274 - DNA, 23 bp, Mus musculus
gtcctgctgtcagagctgtaggg

SEQ ID NO: 219275 - DNA, 22 bp, Mus musculus
taagtgggagtgggtcaacatt

SEQ ID NO: 219276 - DNA, 23 bp, Mus musculus
attgtgaaacctttccctgacgc

SEQ ID NO: 219277 - DNA, 22 bp, Mus musculus
tgttttgtgaccaattatatgg

SEQ ID NO: 219278 - DNA, 23 bp, Mus musculus
tatgtgtgtagtatacatgtatt

SEQ ID NO: 219279 - DNA, 23 bp, Mus musculus
atgggcatatgtattcatgtatg

SEQ ID NO: 219280 - DNA, 23 bp, Mus musculus
agcagtttctccatgagcacctg

SEQ ID NO: 219281 - DNA, 18 bp, Mus musculus
acaagacaaagcctgaag

SEQ ID NO: 219282 - DNA, 23 bp, Mus musculus
gggtgactctctgcctggctctc

SEQ ID NO: 219283 - DNA, 19 bp, Mus musculus
tgtgtgtatgtatatgtgt

SEQ ID NO: 219284 - DNA, 19 bp, Mus musculus
atgttctggggctggagag

SEQ ID NO: 219285 - DNA, 23 bp, Mus musculus
tggcagctgcttttcatttcctt

SEQ ID NO: 219286 - DNA, 19 bp, Mus musculus
tttgcatatgtatagtata

SEQ ID NO: 219287 - DNA, 19 bp, Mus musculus
atttgttctctccttccac

SEQ ID NO: 219288 - DNA, 23 bp, Mus musculus
aatggaaggtaatctagtaagta

SEQ ID NO: 219289 - DNA, 23 bp, Mus musculus
agccaggatgtctggaaacctgt

SEQ ID NO: 219290 - DNA, 23 bp, Mus musculus
cccactgtgcacacttcctgttc

SEQ ID NO: 219291 - DNA, 23 bp, Mus musculus
tgtagatgcttatgtaatgttta

SEQ ID NO: 219292 - DNA, 23 bp, Mus musculus
acactgagctgatggtcaatgga

SEQ ID NO: 219293 - DNA, 20 bp, Mus musculus
agagacacagaacaagcagc

SEQ ID NO: 219294 - DNA, 22 bp, Mus musculus
ttcttgtctggagttcttgtct

SEQ ID NO: 219295 - DNA, 22 bp, Mus musculus
tatatcactatatatgcgtgtg

SEQ ID NO: 219296 - DNA, 23 bp, Mus musculus
ttagagcttgttctttccgtgat

SEQ ID NO: 219297 - DNA, 20 bp, Mus musculus
tgtctgttattccaatgctt

SEQ ID NO: 219298 - DNA, 19 bp, Mus musculus
tattttcttcatgacatgg

SEQ ID NO: 219299 - DNA, 19 bp, Mus musculus
catggtggtctgataggat

SEQ ID NO: 219300 - DNA, 22 bp, Mus musculus
tgttttgtgaccaattatatgg

SEQ ID NO: 219301 - DNA, 23 bp, Mus musculus
tcacatgtccttgtgctaggtta

SEQ ID NO: 219302 - DNA, 19 bp, Mus musculus
tgcatgcatgcatgtatgt

SEQ ID NO: 219303 - DNA, 19 bp, Mus musculus
tgtatgtatgtatgtatgc

SEQ ID NO: 219304 - DNA, 18 bp, Mus musculus
tccatgcatgcatgtatg

SEQ ID NO: 219305 - DNA, 22 bp, Mus musculus
tgttttgtgaccaattatatgg

SEQ ID NO: 219306 - DNA, 19 bp, Mus musculus
tacaaagttcactgacagc

SEQ ID NO: 219307 - DNA, 23 bp, Mus musculus
cttgtgagcatttgaaatgtagc

SEQ ID NO: 219308 - DNA, 20 bp, Mus musculus
ttgccagcatgtaagtgtat

SEQ ID NO: 219309 - DNA, 22 bp, Mus musculus
atatgcacatgtttatgtttgt

SEQ ID NO: 219310 - DNA, 18 bp, Mus musculus
ttttgaacttttctccca

SEQ ID NO: 219311 - DNA, 22 bp, Mus musculus
tgttttgtgaccaattatatgg

SEQ ID NO: 219312 - DNA, 23 bp, Mus musculus
tggcttgcaaatggtctctttct

SEQ ID NO: 219313 - DNA, 21 bp, Mus musculus
gatagagacaatgcacagtga

SEQ ID NO: 219314 - DNA, 19 bp, Mus musculus
tgtggattatatatgtata

SEQ ID NO: 219315 - DNA, 22 bp, Mus musculus
aagtaacattgtttttgaactc

SEQ ID NO: 219316 - DNA, 21 bp, Mus musculus
ttgacagtagagcatcgtaca

SEQ ID NO: 219317 - DNA, 20 bp, Mus musculus
tcagacagagaactgcctcg

SEQ ID NO: 219318 - DNA, 23 bp, Mus musculus
tgctttctgaagattcagtgcac

SEQ ID NO: 219319 - DNA, 23 bp, Mus musculus
atgaccttcatggatctatctat

SEQ ID NO: 219320 - DNA, 23 bp, Mus musculus
tacaaggttgaattgttctaagg

SEQ ID NO: 219321 - DNA, 23 bp, Mus musculus
atgaatgtgtatatctatatatg

SEQ ID NO: 219322 - DNA, 23 bp, Mus musculus
tgcatatatatattgaattcata

SEQ ID NO: 219323 - DNA, 21 bp, Mus musculus
tctctgggtctgtcactgaat

SEQ ID NO: 219324 - DNA, 22 bp, Mus musculus
tgtgtgtgtatatatatgtgtg

SEQ ID NO: 219325 - DNA, 23 bp, Mus musculus
atgactgaagatactgaacactt

SEQ ID NO: 219326 - DNA, 22 bp, Mus musculus
tttcagtaatgcaggctactgt

SEQ ID NO: 219327 - DNA, 23 bp, Mus musculus
atctagaattgtgagaaatgtga

SEQ ID NO: 219328 - DNA, 21 bp, Mus musculus
tcagtctgtctcagtgtggag

SEQ ID NO: 219329 - DNA, 23 bp, Mus musculus
atctgtcagaacacacacagcag

SEQ ID NO: 219330 - DNA, 22 bp, Mus musculus
aaaacatttcatcttaagagaa

SEQ ID NO: 219331 - DNA, 23 bp, Mus musculus
ctctcagctcctgctccagcacc

SEQ ID NO: 219332 - DNA, 21 bp, Mus musculus
acagctacccatttcttggcg

SEQ ID NO: 219333 - DNA, 23 bp, Mus musculus
aggactgactggtagtcacagag

SEQ ID NO: 219334 - DNA, 19 bp, Mus musculus
actcagagaggactgactg

SEQ ID NO: 219335 - DNA, 23 bp, Mus musculus
tggaagacaagtgaattcgtgct

SEQ ID NO: 219336 - DNA, 23 bp, Mus musculus
tgttgcacaggaataaagatgag

SEQ ID NO: 219337 - DNA, 22 bp, Mus musculus
tgtttttatttagaaagctgtt

SEQ ID NO: 219338 - DNA, 22 bp, Mus musculus
acactgactgctcttccagagg

SEQ ID NO: 219339 - DNA, 23 bp, Mus musculus
tcattgctacttcttaactgaga

SEQ ID NO: 219340 - DNA, 22 bp, Mus musculus
ctgttatgaatggtaatgtaaa

SEQ ID NO: 219341 - DNA, 23 bp, Mus musculus
aatctctgtgtctcactttgtgc

SEQ ID NO: 219342 - DNA, 20 bp, Mus musculus
aagctctctgcattatgtag

SEQ ID NO: 219343 - DNA, 23 bp, Mus musculus
atcccagaacttactgtgcagac

SEQ ID NO: 219344 - DNA, 19 bp, Mus musculus
tctgtcacagtcacagtgt

SEQ ID NO: 219345 - DNA, 23 bp, Mus musculus
gactgtgtctgtgtgactgtctt

SEQ ID NO: 219346 - DNA, 18 bp, Mus musculus
tgtatatgtatgcacata

SEQ ID NO: 219347 - DNA, 21 bp, Mus musculus
aggctctctcactgaacctct

SEQ ID NO: 219348 - DNA, 23 bp, Mus musculus
actgcagccagccactgttctct

SEQ ID NO: 219349 - DNA, 23 bp, Mus musculus
gagtctgtctgtgcctgtgtaat

SEQ ID NO: 219350 - DNA, 23 bp, Mus musculus
tcagtgaagtgagactgcagatg

SEQ ID NO: 219351 - DNA, 23 bp, Mus musculus
tgattcagcttgcctgtctgtgg

SEQ ID NO: 219352 - DNA, 23 bp, Mus musculus
actcagcaagaaggagatgatga

SEQ ID NO: 219353 - DNA, 23 bp, Mus musculus
cgcctcagcctctgtattccagc

SEQ ID NO: 219354 - DNA, 22 bp, Mus musculus
tggaagagcagctggtgctctt

SEQ ID NO: 219355 - DNA, 19 bp, Mus musculus
gttgtctaactgtcttttt

SEQ ID NO: 219356 - DNA, 23 bp, Mus musculus
aagatgggtgagcgtctctagag

SEQ ID NO: 219357 - DNA, 21 bp, Mus musculus
tgcctgcctcccagaaggcca

SEQ ID NO: 219358 - DNA, 23 bp, Mus musculus
agtgtgtctctctgactggtctg

SEQ ID NO: 219359 - DNA, 23 bp, Mus musculus
tagtccatggtgatctgatagga

SEQ ID NO: 219360 - DNA, 23 bp, Mus musculus
gagttgatgtacaggtcctggag

SEQ ID NO: 219361 - DNA, 23 bp, Mus musculus
aaaagtgcactgactgctcttcc

SEQ ID NO: 219362 - DNA, 23 bp, Mus musculus
ccagtctctgtctctgcctctaa

SEQ ID NO: 219363 - DNA, 21 bp, Mus musculus
gagagagagatatggaagctg

SEQ ID NO: 219364 - DNA, 23 bp, Mus musculus
gtgtgaggtgagtgtgcatacag

SEQ ID NO: 219365 - DNA, 23 bp, Mus musculus
tttaaggaacaattctgagctct

SEQ ID NO: 219366 - DNA, 23 bp, Mus musculus
tatgtatgcatgtatgatgctgc

SEQ ID NO: 219367 - DNA, 23 bp, Mus musculus
gtcccaagttctatgggcatgag

SEQ ID NO: 219368 - DNA, 20 bp, Mus musculus
tgtcccactggttaggagtg

SEQ ID NO: 219369 - DNA, 23 bp, Mus musculus
acgcagacacatagttaaaaaca

SEQ ID NO: 219370 - DNA, 22 bp, Mus musculus
actgttcttcaagactaggtgt

SEQ ID NO: 219371 - DNA, 21 bp, Mus musculus
tgtgtatgtatgtatatgtgt

SEQ ID NO: 219372 - DNA, 21 bp, Mus musculus
taagagcacagagagagcaca

SEQ ID NO: 219373 - DNA, 20 bp, Mus musculus
gagtcctctctgtctctctc

SEQ ID NO: 219374 - DNA, 23 bp, Mus musculus
gtatatatatatgtatacatatg

SEQ ID NO: 219375 - DNA, 23 bp, Mus musculus
tagtccatggtgatctgatagga

SEQ ID NO: 219376 - DNA, 22 bp, Mus musculus
tgttttgtgaccaattatatgg

SEQ ID NO: 219377 - DNA, 23 bp, Mus musculus
tcacttttggttttcatttgttg

SEQ ID NO: 219378 - DNA, 23 bp, Mus musculus
acattacaacttgatatgccctg

SEQ ID NO: 219379 - DNA, 21 bp, Mus musculus
ttttcgaacatgtaagagctg

SEQ ID NO: 219380 - DNA, 23 bp, Mus musculus
cctgtgggtctctcagaccctga

SEQ ID NO: 219381 - DNA, 23 bp, Mus musculus
tctcagagtaggcccagctgact

SEQ ID NO: 219382 - DNA, 18 bp, Mus musculus
actgtcccagtctctgac

SEQ ID NO: 219383 - DNA, 23 bp, Mus musculus
cgtgtgtgagtgcatgtgtgtgc

SEQ ID NO: 219384 - DNA, 23 bp, Mus musculus
tgtgtgtgtacatatgtgtgtgt

SEQ ID NO: 219385 - DNA, 19 bp, Mus musculus
aagagcacagacagctcat

SEQ ID NO: 219386 - DNA, 23 bp, Mus musculus
tattcatgtggaactggagagat

SEQ ID NO: 219387 - DNA, 23 bp, Mus musculus
tggttaagagctctgactgctct

SEQ ID NO: 219388 - DNA, 18 bp, Mus musculus
cagcaactacatgatgac

SEQ ID NO: 219389 - DNA, 20 bp, Mus musculus
ataagtatatctatatatgt

SEQ ID NO: 219390 - DNA, 23 bp, Mus musculus
tctcactgtgtttccctcactgt

SEQ ID NO: 219391 - DNA, 18 bp, Mus musculus
tctgctgtctctctgtct

SEQ ID NO: 219392 - DNA, 23 bp, Mus musculus
gtgagtactcactcagcacacgg

SEQ ID NO: 219393 - DNA, 23 bp, Mus musculus
ctgctctatggtactgtctctga

SEQ ID NO: 219394 - DNA, 23 bp, Mus musculus
ttcccttactgtctctctgtgtt

SEQ ID NO: 219395 - DNA, 23 bp, Mus musculus
tacacacacacacatatatgtgt

SEQ ID NO: 219396 - DNA, 22 bp, Mus musculus
cagtgcaatgatgaaagggcat

SEQ ID NO: 219397 - DNA, 23 bp, Mus musculus
taggaccttttgaattcatggtc

SEQ ID NO: 219398 - DNA, 19 bp, Mus musculus
tggaactggggatagttgt

SEQ ID NO: 219399 - DNA, 23 bp, Mus musculus
tccctgtctcagaattcggtatg

SEQ ID NO: 219400 - DNA, 21 bp, Mus musculus
tccatggtggtctgataggat

SEQ ID NO: 219401 - DNA, 22 bp, Mus musculus
tgttttgtgaccaattatatgg

SEQ ID NO: 219402 - DNA, 23 bp, Mus musculus
tatttgtgtacatgtatacttat

SEQ ID NO: 219403 - DNA, 23 bp, Mus musculus
gtttatatgtgtgcatgtatatg

SEQ ID NO: 219404 - DNA, 23 bp, Mus musculus
tatgcgtgtgtatgggtatgtgt

SEQ ID NO: 219405 - DNA, 23 bp, Mus musculus
ttgtgtgtacttgtatatatgtg

SEQ ID NO: 219406 - DNA, 21 bp, Mus musculus
tgagtgattacagtgaggtca

SEQ ID NO: 219407 - DNA, 23 bp, Mus musculus
tctgtctgtctgtctgtctgcca

SEQ ID NO: 219408 - DNA, 22 bp, Mus musculus
aatcacacatctgaagctgtgg

SEQ ID NO: 219409 - DNA, 22 bp, Mus musculus
tagctgtatgagcatcacctgt

SEQ ID NO: 219410 - DNA, 23 bp, Mus musculus
aagtcaggagagagtgctgagtc

SEQ ID NO: 219411 - DNA, 19 bp, Mus musculus
tacatgcacatatatatgt

SEQ ID NO: 219412 - DNA, 18 bp, Mus musculus
tatgtatatgtatacaca

SEQ ID NO: 219413 - DNA, 20 bp, Mus musculus
actgtgataggcattttttt

SEQ ID NO: 219414 - DNA, 21 bp, Mus musculus
aattttctatgattttgttga

SEQ ID NO: 219415 - DNA, 23 bp, Mus musculus
gtctatttgaagttctgtaggct

SEQ ID NO: 219416 - DNA, 22 bp, Mus musculus
tgttttgtgaccaattatatgg

SEQ ID NO: 219417 - DNA, 18 bp, Mus musculus
tctgaacacagatctcct

SEQ ID NO: 219418 - DNA, 23 bp, Mus musculus
ttctgtctatttgtatgtctaac

SEQ ID NO: 219419 - DNA, 23 bp, Mus musculus
aagatacaagtgccaagaagctg

SEQ ID NO: 219420 - DNA, 20 bp, Mus musculus
ccatggtgatctgataggat

SEQ ID NO: 219421 - DNA, 23 bp, Mus musculus
gtatatgttgaagcttgttttgt

SEQ ID NO: 219422 - DNA, 23 bp, Mus musculus
tgtagacagaagataggaagctg

SEQ ID NO: 219423 - DNA, 23 bp, Mus musculus
tgtagacagaagataggaagctg

SEQ ID NO: 219424 - DNA, 19 bp, Mus musculus
gacagctgctctcatttgg

SEQ ID NO: 219425 - DNA, 21 bp, Mus musculus
tccatggtggtctgataggat

SEQ ID NO: 219426 - DNA, 23 bp, Mus musculus
aatctgtctgtctgtctgtctgt

SEQ ID NO: 219427 - DNA, 23 bp, Mus musculus
tgtctgagtgtctgtgtctgtgt

SEQ ID NO: 219428 - DNA, 22 bp, Mus musculus
atcatagtactgacagagcaca

SEQ ID NO: 219429 - DNA, 23 bp, Mus musculus
agtgttgagtctcaatctctctc

SEQ ID NO: 219430 - DNA, 23 bp, Mus musculus
tgtgtatatgtatgtaggtatgt

SEQ ID NO: 219431 - DNA, 18 bp, Mus musculus
gtatgcatgcaggtgtgt

SEQ ID NO: 219432 - DNA, 23 bp, Mus musculus
tgactccatctgtatgagacagt

SEQ ID NO: 219433 - DNA, 19 bp, Mus musculus
tatatgtatgtatatatac

SEQ ID NO: 219434 - DNA, 23 bp, Mus musculus
atgtgtgtgtgtgtacatatggt

SEQ ID NO: 219435 - DNA, 21 bp, Mus musculus
acacagcctgtgataatgcca

SEQ ID NO: 219436 - DNA, 23 bp, Mus musculus
aaaatgtatctctatgtctgtgt

SEQ ID NO: 219437 - DNA, 21 bp, Mus musculus
agtgcttgctgataggagcct

SEQ ID NO: 219438 - DNA, 23 bp, Mus musculus
gagaggctctgtcagtgcctgac

SEQ ID NO: 219439 - DNA, 23 bp, Mus musculus
agtgtctgtctgtctgtctgtcc

SEQ ID NO: 219440 - DNA, 23 bp, Mus musculus
aatcattccttcattctctgaat

SEQ ID NO: 219441 - DNA, 23 bp, Mus musculus
tgtctctgtctgtctgtctgtcc

SEQ ID NO: 219442 - DNA, 20 bp, Mus musculus
tcagctgggtgatactgaag

SEQ ID NO: 219443 - DNA, 23 bp, Mus musculus
tgagaatggatgatgtctgactg

SEQ ID NO: 219444 - DNA, 23 bp, Mus musculus
tgtgtacatgtacaggcagacag

SEQ ID NO: 219445 - DNA, 23 bp, Mus musculus
ttgttatcttgttgctcagaagg

SEQ ID NO: 219446 - DNA, 20 bp, Mus musculus
tggtttctctgcaggttgga

SEQ ID NO: 219447 - DNA, 23 bp, Mus musculus
tctctgtctctctgagggaatgc

SEQ ID NO: 219448 - DNA, 20 bp, Mus musculus
tctctgaggaggcagtagag

SEQ ID NO: 219449 - DNA, 20 bp, Mus musculus
aacggtggagagggtgccca

SEQ ID NO: 219450 - DNA, 20 bp, Mus musculus
atgacctagttctgaatggg

SEQ ID NO: 219451 - DNA, 22 bp, Mus musculus
tgtgtatgcatgagtgtgcatg

SEQ ID NO: 219452 - DNA, 18 bp, Mus musculus
tctgagcttgcagatagt

SEQ ID NO: 219453 - DNA, 23 bp, Mus musculus
tctctgcctgtctgtctgtctgg

SEQ ID NO: 219454 - DNA, 23 bp, Mus musculus
tatattttctttgtataggggtg

SEQ ID NO: 219455 - DNA, 23 bp, Mus musculus
ttcactgggtcactcacactcag

SEQ ID NO: 219456 - DNA, 23 bp, Mus musculus
actaactgcatgtgaaatcctca

SEQ ID NO: 219457 - DNA, 20 bp, Mus musculus
atttgtatatatgtatatgt

SEQ ID NO: 219458 - DNA, 23 bp, Mus musculus
tttagattagttatcttttctgg

SEQ ID NO: 219459 - DNA, 21 bp, Mus musculus
ttactggttgtttgctgttgg

SEQ ID NO: 219460 - DNA, 22 bp, Mus musculus
tgtaagcctgagatgtgatcgg

SEQ ID NO: 219461 - DNA, 18 bp, Mus musculus
actgatctctgggtggag

SEQ ID NO: 219462 - DNA, 23 bp, Mus musculus
tctcagaagtgagtgtgaaccag

SEQ ID NO: 219463 - DNA, 23 bp, Mus musculus
gtatagatacatatgtgtatatg

SEQ ID NO: 219464 - DNA, 21 bp, Mus musculus
tatgtatgtgtatacgtgtgt

SEQ ID NO: 219465 - DNA, 21 bp, Mus musculus
tatgtgtgtatatgtatgtat

SEQ ID NO: 219466 - DNA, 23 bp, Mus musculus
tctgtctgtctacctgtctgtga

SEQ ID NO: 219467 - DNA, 23 bp, Mus musculus
cacagccagcctcactctgcctc

SEQ ID NO: 219468 - DNA, 23 bp, Mus musculus
tcatctctagctgcttttctctg

SEQ ID NO: 219469 - DNA, 23 bp, Mus musculus
agtgtttgcaactctcttgtaat

SEQ ID NO: 219470 - DNA, 18 bp, Mus musculus
ttgtggttctgcttggat

SEQ ID NO: 219471 - DNA, 19 bp, Mus musculus
tctgctggctgtgaactgt

SEQ ID NO: 219472 - DNA, 23 bp, Mus musculus
atgtgcgtgtgcatgtgcatgtg

SEQ ID NO: 219473 - DNA, 22 bp, Mus musculus
tgcatgcgtgcgtgcgtgcgtg

SEQ ID NO: 219474 - DNA, 23 bp, Mus musculus
agaggatcagtaagtggttcaag

SEQ ID NO: 219475 - DNA, 22 bp, Mus musculus
tatgagattttttttttctgtc

SEQ ID NO: 219476 - DNA, 23 bp, Mus musculus
accaggaggaggctctctctttc

SEQ ID NO: 219477 - DNA, 18 bp, Mus musculus
tctatctatctattgtgt

SEQ ID NO: 219478 - DNA, 23 bp, Mus musculus
tgagatggtcagaagacagctga

SEQ ID NO: 219479 - DNA, 23 bp, Mus musculus
tctctgggcctctgtgggtctct

SEQ ID NO: 219480 - DNA, 21 bp, Mus musculus
aagtagactgaacaggaagtg

SEQ ID NO: 219481 - DNA, 23 bp, Mus musculus
tcagagactcacttcttttagta

SEQ ID NO: 219482 - DNA, 23 bp, Mus musculus
taggatttgtctgtctgtctgtc

SEQ ID NO: 219483 - DNA, 22 bp, Mus musculus
atcctcaggccttagcatgggt

SEQ ID NO: 219484 - DNA, 23 bp, Mus musculus
tttcttactcactgtctgaaagc

SEQ ID NO: 219485 - DNA, 23 bp, Mus musculus
acagtggatggcactagagagtg

SEQ ID NO: 219486 - DNA, 22 bp, Mus musculus
acacactcagtgttggtagtag

SEQ ID NO: 219487 - DNA, 23 bp, Mus musculus
tgagaacacagactgcaagctaa

SEQ ID NO: 219488 - DNA, 23 bp, Mus musculus
tgtgtgagagatttttttctggg

SEQ ID NO: 219489 - DNA, 23 bp, Mus musculus
tgcgtaagtacatgtgcatgtac

SEQ ID NO: 219490 - DNA, 22 bp, Mus musculus
ttacacagtagggccaaggtgt

SEQ ID NO: 219491 - DNA, 23 bp, Mus musculus
tatgtccctgtctgtgtctgtct

SEQ ID NO: 219492 - DNA, 23 bp, Mus musculus
tgctatttttgttgttgaaaatg

SEQ ID NO: 219493 - DNA, 23 bp, Mus musculus
actcagtcttattctgtctctat

SEQ ID NO: 219494 - DNA, 23 bp, Mus musculus
ctctctctctctgtctctctatg

SEQ ID NO: 219495 - DNA, 22 bp, Mus musculus
tgttttgtgaccaattatatgg

SEQ ID NO: 219496 - DNA, 23 bp, Mus musculus
agttcatggtggtcagataggat

SEQ ID NO: 219497 - DNA, 22 bp, Mus musculus
atttttgtatctgtggaggcct

SEQ ID NO: 219498 - DNA, 21 bp, Mus musculus
ttttgtgaccaattatattgt

SEQ ID NO: 219499 - DNA, 23 bp, Mus musculus
tggggctgtctctgtgtccctgc

SEQ ID NO: 219500 - DNA, 23 bp, Mus musculus
tgactgtgtgtcacttagtcact

SEQ ID NO: 219501 - DNA, 22 bp, Mus musculus
tgttttgtgaccaattatatgg

SEQ ID NO: 219502 - DNA, 23 bp, Mus musculus
tgtgtgagagtgcatgtacactc

SEQ ID NO: 219503 - DNA, 21 bp, Mus musculus
atgtatatgtgcatgtgcatg

SEQ ID NO: 219504 - DNA, 22 bp, Mus musculus
tttttttggattgggaggctga

SEQ ID NO: 219505 - DNA, 19 bp, Mus musculus
tgacagaagagaggctgca

SEQ ID NO: 219506 - DNA, 21 bp, Mus musculus
tcaggagatcttttgcatgat

SEQ ID NO: 219507 - DNA, 22 bp, Mus musculus
tgttttgtgaccaattatatgg

SEQ ID NO: 219508 - DNA, 21 bp, Mus musculus
tatgtggatatatacatatgt

SEQ ID NO: 219509 - DNA, 22 bp, Mus musculus
tgttttgtgaccaattatatgg

SEQ ID NO: 219510 - DNA, 21 bp, Mus musculus
tgtgtagaaattccagagcaa

SEQ ID NO: 219511 - DNA, 21 bp, Mus musculus
tgtgtacatgtgtgtgcatgt

SEQ ID NO: 219512 - DNA, 18 bp, Mus musculus
gagagaagtgggagagga

SEQ ID NO: 219513 - DNA, 23 bp, Mus musculus
tctctgcctctgtctctgcctct

SEQ ID NO: 219514 - DNA, 23 bp, Mus musculus
tggctttgttttctagtatgaat

SEQ ID NO: 219515 - DNA, 21 bp, Mus musculus
aattacaccgaataacttgag

SEQ ID NO: 219516 - DNA, 19 bp, Mus musculus
tcagagatgagacacaggt

SEQ ID NO: 219517 - DNA, 23 bp, Mus musculus
acatctgtctcgaagctcactca

SEQ ID NO: 219518 - DNA, 23 bp, Mus musculus
gttttcacactgatgtttgcttc

SEQ ID NO: 219519 - DNA, 23 bp, Mus musculus
tattctcactttgttcttctctg

SEQ ID NO: 219520 - DNA, 18 bp, Mus musculus
aggtaggcatatatgtgt

SEQ ID NO: 219521 - DNA, 22 bp, Mus musculus
atacacacctgtctgtctgtct

SEQ ID NO: 219522 - DNA, 23 bp, Mus musculus
tctggatctctgtcacttttctg

SEQ ID NO: 219523 - DNA, 21 bp, Mus musculus
gtaggacacatatgttgaaag

SEQ ID NO: 219524 - DNA, 22 bp, Mus musculus
tatatggtgtagatcctgcaag

SEQ ID NO: 219525 - DNA, 23 bp, Mus musculus
gtatgtatgtatgtatgtatgta

SEQ ID NO: 219526 - DNA, 23 bp, Mus musculus
atgatcatcagagctaatgaact

SEQ ID NO: 219527 - DNA, 23 bp, Mus musculus
tgcatgtgtatgcatgtatttgt

SEQ ID NO: 219528 - DNA, 20 bp, Mus musculus
gtatgtgcaaatgcatgtgt

SEQ ID NO: 219529 - DNA, 23 bp, Mus musculus
atgtatgtgtgcatgtgcatgtg

SEQ ID NO: 219530 - DNA, 23 bp, Mus musculus
acacatgtgaatgtggaggctga

SEQ ID NO: 219531 - DNA, 23 bp, Mus musculus
acagaatttaaggaaatgtcaaa

SEQ ID NO: 219532 - DNA, 23 bp, Mus musculus
tgtgtgtatgtatgtatgtgtgt

SEQ ID NO: 219533 - DNA, 20 bp, Mus musculus
atgtatgtatgtatgtatgt

SEQ ID NO: 219534 - DNA, 23 bp, Mus musculus
cagagaagacaggcagcaccaga

SEQ ID NO: 219535 - DNA, 21 bp, Mus musculus
gtggtggtaggttgtatccta

SEQ ID NO: 219536 - DNA, 21 bp, Mus musculus
atgctcactgctcttccagag

SEQ ID NO: 219537 - DNA, 22 bp, Mus musculus
tctcatttagtttaagagttca

SEQ ID NO: 219538 - DNA, 19 bp, Mus musculus
cacctgtgtgtgtgttcac

SEQ ID NO: 219539 - DNA, 23 bp, Mus musculus
tgtgtgttcacttgtgtgtgtgt

SEQ ID NO: 219540 - DNA, 21 bp, Mus musculus
atgtgcattctcagctgtgtg

SEQ ID NO: 219541 - DNA, 23 bp, Mus musculus
ctgtgtctccctccctctaagac

SEQ ID NO: 219542 - DNA, 22 bp, Mus musculus
tgtgtgtgcatgtgcatgtgca

SEQ ID NO: 219543 - DNA, 23 bp, Mus musculus
gaggtagatggatctctgagttc

SEQ ID NO: 219544 - DNA, 23 bp, Mus musculus
tagtctacagatcaatttctctc

SEQ ID NO: 219545 - DNA, 23 bp, Mus musculus
atgtgtgtgtgcatgtgcatgtg

SEQ ID NO: 219546 - DNA, 23 bp, Mus musculus
tattggaccttttgatttcacga

SEQ ID NO: 219547 - DNA, 23 bp, Mus musculus
ctctgaattgtgtgtgaagttgc

SEQ ID NO: 219548 - DNA, 23 bp, Mus musculus
atgttgattgaaaatgtatgtgt

SEQ ID NO: 219549 - DNA, 23 bp, Mus musculus
aagactgtgtgatgagtttgagg

SEQ ID NO: 219550 - DNA, 23 bp, Mus musculus
acacctgttctctgtgactctgt

SEQ ID NO: 219551 - DNA, 23 bp, Mus musculus
taccatgtactatactattcata

SEQ ID NO: 219552 - DNA, 23 bp, Mus musculus
tggctgtgtctgtgtgtctgtat

SEQ ID NO: 219553 - DNA, 20 bp, Mus musculus
acagctcacggagacactcc

SEQ ID NO: 219554 - DNA, 21 bp, Mus musculus
acccaggctccctcttagcct

SEQ ID NO: 219555 - DNA, 23 bp, Mus musculus
tggccattcagtctctctctctg

SEQ ID NO: 219556 - DNA, 21 bp, Mus musculus
tgtcaggatgaagactgtctg

SEQ ID NO: 219557 - DNA, 22 bp, Mus musculus
agggcatgctgctatcttgttg

SEQ ID NO: 219558 - DNA, 23 bp, Mus musculus
gagtctgcagaagctgctggcag

SEQ ID NO: 219559 - DNA, 22 bp, Mus musculus
ttcacagtgctcactgtggtgt

SEQ ID NO: 219560 - DNA, 22 bp, Mus musculus
ttcacagtgctcactgtggtgt

SEQ ID NO: 219561 - DNA, 23 bp, Mus musculus
tctctgtatatatatgtgtatgt

SEQ ID NO: 219562 - DNA, 23 bp, Mus musculus
ctgtgcggcacactatccgctga

SEQ ID NO: 219563 - DNA, 21 bp, Mus musculus
tacatgcatgtatatgtacac

SEQ ID NO: 219564 - DNA, 20 bp, Mus musculus
tctgtgtgatgtaaccatgt

SEQ ID NO: 219565 - DNA, 23 bp, Mus musculus
tatatcactggacatgtaagtct

SEQ ID NO: 219566 - DNA, 22 bp, Mus musculus
tgagttccctctccctgtctct

SEQ ID NO: 219567 - DNA, 22 bp, Mus musculus
acacagcctcctcatagcttct

SEQ ID NO: 219568 - DNA, 23 bp, Mus musculus
atcactgtgaagactggagctat

SEQ ID NO: 219569 - DNA, 18 bp, Mus musculus
aaggtcccatcatttttg

SEQ ID NO: 219570 - DNA, 22 bp, Mus musculus
tgttttgtgaccaattatatgg

SEQ ID NO: 219571 - DNA, 21 bp, Mus musculus
atgcagtagaaccctatttct

SEQ ID NO: 219572 - DNA, 23 bp, Mus musculus
atatctctgctatattatactat

SEQ ID NO: 219573 - DNA, 23 bp, Mus musculus
tgtatgcatgtatgtatgtatga

SEQ ID NO: 219574 - DNA, 23 bp, Mus musculus
tgagtctctctgtctctaaactg

SEQ ID NO: 219575 - DNA, 23 bp, Mus musculus
ttcgcactatgtacaaagatgtt

SEQ ID NO: 219576 - DNA, 22 bp, Mus musculus
tgttttgtgaccaattatatgg

SEQ ID NO: 219577 - DNA, 23 bp, Mus musculus
tgtgtgtatgtatatatgtgtgc

SEQ ID NO: 219578 - DNA, 20 bp, Mus musculus
atagaggcaccaaatgtaaa

SEQ ID NO: 219579 - DNA, 21 bp, Mus musculus
tatgtatatatgtatatgtgt

SEQ ID NO: 219580 - DNA, 23 bp, Mus musculus
tatgtgcatgagtatatatgtgt

SEQ ID NO: 219581 - DNA, 20 bp, Mus musculus
tccctgccaaattcctgggt

SEQ ID NO: 219582 - DNA, 23 bp, Mus musculus
tgtctgagtgtctgcatgtgtat

SEQ ID NO: 219583 - DNA, 20 bp, Mus musculus
cctgtgtcggtctctctggc

SEQ ID NO: 219584 - DNA, 23 bp, Mus musculus
gtgtgcatgtgcatctgcatgtg

SEQ ID NO: 219585 - DNA, 22 bp, Mus musculus
taagtgtgtgtacatgcacaag

SEQ ID NO: 219586 - DNA, 23 bp, Mus musculus
ggggtcacactcaggctgtcagg

SEQ ID NO: 219587 - DNA, 19 bp, Mus musculus
tgagacagagagaagcagc

SEQ ID NO: 219588 - DNA, 18 bp, Mus musculus
gtgtgtatacatgtgtgt

SEQ ID NO: 219589 - DNA, 23 bp, Mus musculus
tgtatttccatgtttaacatttt

SEQ ID NO: 219590 - DNA, 23 bp, Mus musculus
ttagaatgaggatcaaaagggaa

SEQ ID NO: 219591 - DNA, 23 bp, Mus musculus
tgtgggtctctgtctgtctgaga

SEQ ID NO: 219592 - DNA, 21 bp, Mus musculus
ttcagtgcagatgtgagagag

SEQ ID NO: 219593 - DNA, 22 bp, Mus musculus
atgtctctatatacagctgtga

SEQ ID NO: 219594 - DNA, 22 bp, Mus musculus
tcacaggctcacactctggctg

SEQ ID NO: 219595 - DNA, 23 bp, Mus musculus
ctctgccagtggctcttgtcttt

SEQ ID NO: 219596 - DNA, 19 bp, Mus musculus
ttctttttcatgatgtggt

SEQ ID NO: 219597 - DNA, 23 bp, Mus musculus
gttgtatggtagttctttcttta

SEQ ID NO: 219598 - DNA, 23 bp, Mus musculus
actttctctgagtctctgattcc

SEQ ID NO: 219599 - DNA, 23 bp, Mus musculus
tgtctctgtgggtctcagcttga

SEQ ID NO: 219600 - DNA, 23 bp, Mus musculus
ctctgtctctctcacatggttgt

SEQ ID NO: 219601 - DNA, 23 bp, Mus musculus
gtctgacactctgagtctctggg

SEQ ID NO: 219602 - DNA, 21 bp, Mus musculus
tgagatcagacagtccacaga

SEQ ID NO: 219603 - DNA, 23 bp, Mus musculus
agtgtgtgtatgtctgtgtctct

SEQ ID NO: 219604 - DNA, 21 bp, Mus musculus
tccctgggtcggtctatccca

SEQ ID NO: 219605 - DNA, 19 bp, Mus musculus
ctgtgtgcatgtgcatatg

SEQ ID NO: 219606 - DNA, 23 bp, Mus musculus
acagttttagatgtgctgatagg

SEQ ID NO: 219607 - DNA, 18 bp, Mus musculus
tggaactgaagtgagttg

SEQ ID NO: 219608 - DNA, 23 bp, Mus musculus
gcctctgacccactctcagccag

SEQ ID NO: 219609 - DNA, 18 bp, Mus musculus
tagcccttgcactgctgc

SEQ ID NO: 219610 - DNA, 23 bp, Mus musculus
aggctctatctgtctgtctgtcc

SEQ ID NO: 219611 - DNA, 19 bp, Mus musculus
ctcgtttatatatgtgtat

SEQ ID NO: 219612 - DNA, 23 bp, Mus musculus
tgtgtgtgtatgtatttatatgt

SEQ ID NO: 219613 - DNA, 23 bp, Mus musculus
tgttttgaacttcaacaagacat

SEQ ID NO: 219614 - DNA, 23 bp, Mus musculus
tgcctgcctgcctgcctgccttt

SEQ ID NO: 219615 - DNA, 19 bp, Mus musculus
tctctctgtttgtctaagg

SEQ ID NO: 219616 - DNA, 18 bp, Mus musculus
tcacacagacactgtctg

SEQ ID NO: 219617 - DNA, 21 bp, Mus musculus
gacacacactgcctgtgaggt

SEQ ID NO: 219618 - DNA, 23 bp, Mus musculus
tgtactctcaggctgtgggtctc

SEQ ID NO: 219619 - DNA, 23 bp, Mus musculus
aggaagaaaatccagcgatgtga

SEQ ID NO: 219620 - DNA, 19 bp, Mus musculus
gagtactgagtgtattgag

SEQ ID NO: 219621 - DNA, 23 bp, Mus musculus
cactctgggtgtgtcagcccttg

SEQ ID NO: 219622 - DNA, 23 bp, Mus musculus
atatgtgtttgtgttcttgtgat

SEQ ID NO: 219623 - DNA, 20 bp, Mus musculus
taacctcatttggaaaggtt

SEQ ID NO: 219624 - DNA, 22 bp, Mus musculus
tgactccctccctctctctttt

SEQ ID NO: 219625 - DNA, 20 bp, Mus musculus
tgtatatgtgtatatgtgta

SEQ ID NO: 219626 - DNA, 23 bp, Mus musculus
tgtgcatgtatatatgtatgcat

SEQ ID NO: 219627 - DNA, 23 bp, Mus musculus
tatatatgtgtatatgtatatat

SEQ ID NO: 219628 - DNA, 23 bp, Mus musculus
agtgtcttacttgttttcatttc

SEQ ID NO: 219629 - DNA, 23 bp, Mus musculus
cttggcttacactttcacatcag

SEQ ID NO: 219630 - DNA, 20 bp, Mus musculus
catcactgaaggaagtcagg

SEQ ID NO: 219631 - DNA, 23 bp, Mus musculus
tgtgacaacagagtgtcctgaag

SEQ ID NO: 219632 - DNA, 23 bp, Mus musculus
atgtctctctgtctgtaagagca

SEQ ID NO: 219633 - DNA, 23 bp, Mus musculus
aatcagactggttgatttctggg

SEQ ID NO: 219634 - DNA, 23 bp, Mus musculus
atatatgtatgtatatgtactct

SEQ ID NO: 219635 - DNA, 23 bp, Mus musculus
tatggatggctcgctctctctct

SEQ ID NO: 219636 - DNA, 22 bp, Mus musculus
tgtacctggtgtgtgactctgt

SEQ ID NO: 219637 - DNA, 18 bp, Mus musculus
accatctacccatggaac

SEQ ID NO: 219638 - DNA, 23 bp, Mus musculus
gtcagtgggtcagtgggtcagtg

SEQ ID NO: 219639 - DNA, 20 bp, Mus musculus
tgagttcttccaccaggata

SEQ ID NO: 219640 - DNA, 23 bp, Mus musculus
caggacagttgtgagtgtgcaca

SEQ ID NO: 219641 - DNA, 23 bp, Mus musculus
agcatctccaggtcctaactagc

SEQ ID NO: 219642 - DNA, 23 bp, Mus musculus
ctgagagataagagtctgcacac

SEQ ID NO: 219643 - DNA, 23 bp, Mus musculus
cttgagccagtgacagaattttc

SEQ ID NO: 219644 - DNA, 23 bp, Mus musculus
agagactgaagagacacagagtg

SEQ ID NO: 219645 - DNA, 23 bp, Mus musculus
agagcacagaagactgagatgac

SEQ ID NO: 219646 - DNA, 23 bp, Mus musculus
taattgtcattttgtatatctta

SEQ ID NO: 219647 - DNA, 19 bp, Mus musculus
tacctagattaagttacct

SEQ ID NO: 219648 - DNA, 23 bp, Mus musculus
actctgagaggtatctgtctcta

SEQ ID NO: 219649 - DNA, 22 bp, Mus musculus
tctgtctgtctgtctgcgtggg

SEQ ID NO: 219650 - DNA, 23 bp, Mus musculus
ttttgcttgtatatatgtatgta

SEQ ID NO: 219651 - DNA, 19 bp, Mus musculus
tgaggagagacagagcaca

SEQ ID NO: 219652 - DNA, 18 bp, Mus musculus
cagagaccctgagttcag

SEQ ID NO: 219653 - DNA, 23 bp, Mus musculus
atcactgtgtctgtcacagggcc

SEQ ID NO: 219654 - DNA, 23 bp, Mus musculus
acacatgcgtgtagatgctatgg

SEQ ID NO: 219655 - DNA, 22 bp, Mus musculus
tttaggctgtgattctactgta

SEQ ID NO: 219656 - DNA, 19 bp, Mus musculus
gcatgtatgtatacatgta

SEQ ID NO: 219657 - DNA, 23 bp, Mus musculus
atatgcatgagtgtctgtatgta

SEQ ID NO: 219658 - DNA, 18 bp, Mus musculus
aaacaaaggctctctcta

SEQ ID NO: 219659 - DNA, 21 bp, Mus musculus
atgtgtgtgtctgtgtatggg

SEQ ID NO: 219660 - DNA, 20 bp, Mus musculus
tgtatgtatgtatgtatata

SEQ ID NO: 219661 - DNA, 18 bp, Mus musculus
tgtatgtatgtatatatg

SEQ ID NO: 219662 - DNA, 23 bp, Mus musculus
acacactctggctttctctgagt

SEQ ID NO: 219663 - DNA, 23 bp, Mus musculus
ctgccactcacacaggctcacga

SEQ ID NO: 219664 - DNA, 23 bp, Mus musculus
gcctcactctctctttcactcac

SEQ ID NO: 219665 - DNA, 22 bp, Mus musculus
acagtagtattggagctgaagt

SEQ ID NO: 219666 - DNA, 23 bp, Mus musculus
tgtgtgtctctctctgtgtgtat

SEQ ID NO: 219667 - DNA, 22 bp, Mus musculus
ttgaaagaacttggagatatgt

SEQ ID NO: 219668 - DNA, 20 bp, Mus musculus
catatgtgtgtatggggatg

SEQ ID NO: 219669 - DNA, 23 bp, Mus musculus
tgtatgtatgtatatgtgggtgt

SEQ ID NO: 219670 - DNA, 23 bp, Mus musculus
tctgctttgctttggttttgaga

SEQ ID NO: 219671 - DNA, 23 bp, Mus musculus
tctcactcacactgtcctagagc

SEQ ID NO: 219672 - DNA, 21 bp, Mus musculus
tgcctgagtgctgaagttgtg

SEQ ID NO: 219673 - DNA, 19 bp, Mus musculus
gcatgagctgccacacctg

SEQ ID NO: 219674 - DNA, 21 bp, Mus musculus
acacacacacttactcactca

SEQ ID NO: 219675 - DNA, 19 bp, Mus musculus
actagcctgtgacaggcat

SEQ ID NO: 219676 - DNA, 21 bp, Mus musculus
gcctctgtacagtgtgaggtc

SEQ ID NO: 219677 - DNA, 23 bp, Mus musculus
gtgctcgctccgagtgttcaagc

SEQ ID NO: 219678 - DNA, 23 bp, Mus musculus
acagtgggagccttggtacttgc

SEQ ID NO: 219679 - DNA, 22 bp, Mus musculus
tctagccagatcatgcaactgt

SEQ ID NO: 219680 - DNA, 23 bp, Mus musculus
ctgactctgtcactgacttggca

SEQ ID NO: 219681 - DNA, 23 bp, Mus musculus
agtgtctgtcactctcttctacc

SEQ ID NO: 219682 - DNA, 23 bp, Mus musculus
cactatgggtatggtgtatgtga

SEQ ID NO: 219683 - DNA, 23 bp, Mus musculus
tgtgtgtcactgtgtatgtggtg

SEQ ID NO: 219684 - DNA, 23 bp, Mus musculus
tttcaggcttctctctgtctcac

SEQ ID NO: 219685 - DNA, 23 bp, Mus musculus
aggttcattgttgacctcggtgt

SEQ ID NO: 219686 - DNA, 23 bp, Mus musculus
gtgtggcagactggagaaatgac

SEQ ID NO: 219687 - DNA, 23 bp, Mus musculus
ttcaaatctcagcaactacatgg

SEQ ID NO: 219688 - DNA, 23 bp, Mus musculus
tcagtgaagactgtgtcctgacc

SEQ ID NO: 219689 - DNA, 23 bp, Mus musculus
agctggctctagagtgagagcac

SEQ ID NO: 219690 - DNA, 23 bp, Mus musculus
ttaactagacatttagttcatct

SEQ ID NO: 219691 - DNA, 23 bp, Mus musculus
attggattaatcagtgctggtct

SEQ ID NO: 219692 - DNA, 23 bp, Mus musculus
tatgtgtctgcatggatatgtgt

SEQ ID NO: 219693 - DNA, 23 bp, Mus musculus
tcctcagcctctctctctcacat

SEQ ID NO: 219694 - DNA, 23 bp, Mus musculus
ttatgtgtcgtaaatatatgtgt

SEQ ID NO: 219695 - DNA, 19 bp, Mus musculus
tatattgtattgtacatat

SEQ ID NO: 219696 - DNA, 20 bp, Mus musculus
tgtcttttttgttctgtgag

SEQ ID NO: 219697 - DNA, 23 bp, Mus musculus
gtgtgcatgtctagtgtgtatgt

SEQ ID NO: 219698 - DNA, 23 bp, Mus musculus
taacacagtgtggacagtgagct

SEQ ID NO: 219699 - DNA, 23 bp, Mus musculus
tctctgtgtctttgtgtgtcggt

SEQ ID NO: 219700 - DNA, 23 bp, Mus musculus
gaccaacactgtggtgtctccac

SEQ ID NO: 219701 - DNA, 23 bp, Mus musculus
tgccacactgtgtctctcagttc

SEQ ID NO: 219702 - DNA, 23 bp, Mus musculus
cccagagcagccgctgctgaagt

SEQ ID NO: 219703 - DNA, 23 bp, Mus musculus
tctcacactctgtttctgttgag

SEQ ID NO: 219704 - DNA, 23 bp, Mus musculus
gattatgtactagagaaaactag

SEQ ID NO: 219705 - DNA, 23 bp, Mus musculus
gtttttttgagactgtctcacgt

SEQ ID NO: 219706 - DNA, 23 bp, Mus musculus
tgtccatggtgatctgataggat

SEQ ID NO: 219707 - DNA, 23 bp, Mus musculus
ctctcacacacacatgagctctc

SEQ ID NO: 219708 - DNA, 20 bp, Mus musculus
tatttatgctgttattgaag

SEQ ID NO: 219709 - DNA, 21 bp, Mus musculus
tccatggtgatctgataggat

SEQ ID NO: 219710 - DNA, 20 bp, Mus musculus
tacattcacacatatatgtg

SEQ ID NO: 219711 - DNA, 23 bp, Mus musculus
tatgtgtatatatatatgtgtgt

SEQ ID NO: 219712 - DNA, 23 bp, Mus musculus
agaaacagaacttagagagcact

SEQ ID NO: 219713 - DNA, 19 bp, Mus musculus
aaggtctctcactctctgc

SEQ ID NO: 219714 - DNA, 22 bp, Mus musculus
actcagggtcactgtgtctggc

SEQ ID NO: 219715 - DNA, 20 bp, Mus musculus
aggtgcattgacttttttta

SEQ ID NO: 219716 - DNA, 23 bp, Mus musculus
gttttatgtatatcagataggtg

SEQ ID NO: 219717 - DNA, 21 bp, Mus musculus
tatatgcatatgtatacacgt

SEQ ID NO: 219718 - DNA, 22 bp, Mus musculus
tgttttgtgaccaattatatgg

SEQ ID NO: 219719 - DNA, 19 bp, Mus musculus
atttttattctttttctag

SEQ ID NO: 219720 - DNA, 20 bp, Mus musculus
tgttagccagcaattcttct

SEQ ID NO: 219721 - DNA, 18 bp, Mus musculus
tatactcagagaattgtg

SEQ ID NO: 219722 - DNA, 22 bp, Mus musculus
cacccgtagaaccgaccttgcg

SEQ ID NO: 219723 - DNA, 23 bp, Mus musculus
ctcgtgtctgtgggtccgtgtcg

SEQ ID NO: 219724 - DNA, 22 bp, Mus musculus
tgaggtaggaggttgtatagtt

SEQ ID NO: 219725 - DNA, 23 bp, Mus musculus
tccctgagaccctttaacctgtg

SEQ ID NO: 219726 - DNA, 20 bp, Mus musculus
tgttttgtgacctattatgt

SEQ ID NO: 219727 - DNA, 23 bp, Mus musculus
atgtatgtatgcatgtgtgtatg

SEQ ID NO: 219728 - DNA, 19 bp, Mus musculus
tctgtagtatagcttgagg

SEQ ID NO: 219729 - DNA, 22 bp, Mus musculus
tatttgtatgtctatatgtctg

SEQ ID NO: 219730 - DNA, 23 bp, Mus musculus
agtatgtatgtatgcatgtgtgt

SEQ ID NO: 219731 - DNA, 19 bp, Mus musculus
tgtaatgtttgtaaagata

SEQ ID NO: 219732 - DNA, 21 bp, Mus musculus
ttagaaaagagttagtgttgt

SEQ ID NO: 219733 - DNA, 23 bp, Mus musculus
tatgcatatgtatgcatatttgt

SEQ ID NO: 219734 - DNA, 23 bp, Mus musculus
atgtatgtatgcatgtgtgtatg

SEQ ID NO: 219735 - DNA, 23 bp, Mus musculus
atcagctgatgtatacagcctgt

SEQ ID NO: 219736 - DNA, 23 bp, Mus musculus
actgtctcactgtctgtgcggta

SEQ ID NO: 219737 - DNA, 20 bp, Mus musculus
ttgacctcctgtaaggtaac

SEQ ID NO: 219738 - DNA, 23 bp, Mus musculus
tatggcttgtaatgtactatgca

SEQ ID NO: 219739 - DNA, 18 bp, Mus musculus
attcttcattggcagctc

SEQ ID NO: 219740 - DNA, 23 bp, Mus musculus
atgaaaacaaccttgagtgtttc

SEQ ID NO: 219741 - DNA, 20 bp, Mus musculus
atgtgtgtgtgtatgtgtat

SEQ ID NO: 219742 - DNA, 23 bp, Mus musculus
atctattgagacctgttttgtga

SEQ ID NO: 219743 - DNA, 22 bp, Mus musculus
ttgaggtagatcaatttatatt

SEQ ID NO: 219744 - DNA, 23 bp, Mus musculus
acagtccttgtatattccactat

SEQ ID NO: 219745 - DNA, 23 bp, Mus musculus
gtgttacagcatctggaagtggt

SEQ ID NO: 219746 - DNA, 22 bp, Mus musculus
tgttttgtgaccaattatatgg

SEQ ID NO: 219747 - DNA, 20 bp, Mus musculus
tgtgcaggcaatggtggctg

SEQ ID NO: 219748 - DNA, 22 bp, Mus musculus
tgttttgtgaccaattatatgg

SEQ ID NO: 219749 - DNA, 23 bp, Mus musculus
actccatggtgatctgataggat

SEQ ID NO: 219750 - DNA, 23 bp, Mus musculus
ctgtgtctctgtttagtttctgt

SEQ ID NO: 219751 - DNA, 23 bp, Mus musculus
ctgtgtctctgtttagtttctgt

SEQ ID NO: 219752 - DNA, 23 bp, Mus musculus
aggatctgtccattgatgagagt

SEQ ID NO: 219753 - DNA, 22 bp, Mus musculus
tgttttgtgaccaattatatgg

SEQ ID NO: 219754 - DNA, 23 bp, Mus musculus
ctgtttctctctatctctctctg

SEQ ID NO: 219755 - DNA, 21 bp, Mus musculus
tgtgtatatttatatctgtgt

SEQ ID NO: 219756 - DNA, 22 bp, Mus musculus
tgttttgtgaccaattatatgg

SEQ ID NO: 219757 - DNA, 23 bp, Mus musculus
cattcagatgaaggagagtttct

SEQ ID NO: 219758 - DNA, 22 bp, Mus musculus
taactcttcattaattatgaat

SEQ ID NO: 219759 - DNA, 23 bp, Mus musculus
atgatgactgaggagattgatgt

SEQ ID NO: 219760 - DNA, 20 bp, Mus musculus
tagatataacatgtggttgt

SEQ ID NO: 219761 - DNA, 23 bp, Mus musculus
tgtctttcctgatgttgctgtat

SEQ ID NO: 219762 - DNA, 23 bp, Mus musculus
ctcagcctgagttctgattagga

SEQ ID NO: 219763 - DNA, 23 bp, Mus musculus
cactcagactctcagatccttgt

SEQ ID NO: 219764 - DNA, 18 bp, Mus musculus
tcagagcaaggttgagag

SEQ ID NO: 219765 - DNA, 23 bp, Mus musculus
gctattgctccaactccaacctg

SEQ ID NO: 219766 - DNA, 22 bp, Mus musculus
tcaacttggcacagtgagggtc

SEQ ID NO: 219767 - DNA, 23 bp, Mus musculus
ctgcctgtctctgcctctctagt

SEQ ID NO: 219768 - DNA, 18 bp, Mus musculus
tgccaggcctagcagtct

SEQ ID NO: 219769 - DNA, 23 bp, Mus musculus
actatcagcatatggttgaccaa

SEQ ID NO: 219770 - DNA, 23 bp, Mus musculus
tctctctctcatattctctgact

SEQ ID NO: 219771 - DNA, 23 bp, Mus musculus
tctggttgtacagtagatgatct

SEQ ID NO: 219772 - DNA, 19 bp, Mus musculus
tgtgcaagtgcatgtgtat

SEQ ID NO: 219773 - DNA, 23 bp, Mus musculus
atgtatgtatgtatgtatggtat

SEQ ID NO: 219774 - DNA, 23 bp, Mus musculus
tctgaggttccttctgtgtgttt

SEQ ID NO: 219775 - DNA, 23 bp, Mus musculus
tgtttctctgtctgacttggtag

SEQ ID NO: 219776 - DNA, 23 bp, Mus musculus
ctgtgtctctcccgctctgttta

SEQ ID NO: 219777 - DNA, 23 bp, Mus musculus
tgtgtctctgtctgtgtctctgt

SEQ ID NO: 219778 - DNA, 23 bp, Mus musculus
tgtctgcctgagtgtgtgtgtgt

SEQ ID NO: 219779 - DNA, 22 bp, Mus musculus
tgtctctaaagactgtgctgat

SEQ ID NO: 219780 - DNA, 18 bp, Mus musculus
tggctagggaagatctgt

SEQ ID NO: 219781 - DNA, 19 bp, Mus musculus
tgagtcacacattggtggg

SEQ ID NO: 219782 - DNA, 23 bp, Mus musculus
gtgcctctgcctctctcccagaa

SEQ ID NO: 219783 - DNA, 18 bp, Mus musculus
acagtggtgactgaggag

SEQ ID NO: 219784 - DNA, 18 bp, Mus musculus
ctgttgggtgtctgcaca

SEQ ID NO: 219785 - DNA, 23 bp, Mus musculus
cctgcctgcctgcctgcctgcct

SEQ ID NO: 219786 - DNA, 22 bp, Mus musculus
tggctgcctcacacagacactc

SEQ ID NO: 219787 - DNA, 19 bp, Mus musculus
tcaccccctaacttttttg

SEQ ID NO: 219788 - DNA, 22 bp, Mus musculus
aaacagagagagctagggtgga

SEQ ID NO: 219789 - DNA, 23 bp, Mus musculus
tgtcagtgtctgtctgcttctct

SEQ ID NO: 219790 - DNA, 21 bp, Mus musculus
tctgtgagcatgcttgctgtg

SEQ ID NO: 219791 - DNA, 23 bp, Mus musculus
gtactgacaacagtgtcagtgac

SEQ ID NO: 219792 - DNA, 23 bp, Mus musculus
agggtctcagatatacttgtcaa

SEQ ID NO: 219793 - DNA, 22 bp, Mus musculus
agttagacacagagtcatcagt

SEQ ID NO: 219794 - DNA, 23 bp, Mus musculus
gaggtcaagctgtctctgcctct

SEQ ID NO: 219795 - DNA, 23 bp, Mus musculus
actcagtggcagagtgtttgcct

SEQ ID NO: 219796 - DNA, 23 bp, Mus musculus
aaagagtgacctggggctggaga

SEQ ID NO: 219797 - DNA, 23 bp, Mus musculus
tgcgtcagtcagtgcctctgaga

SEQ ID NO: 219798 - DNA, 20 bp, Mus musculus
tctcagagctccctactgtg

SEQ ID NO: 219799 - DNA, 23 bp, Mus musculus
ctgtctctcactttgagactctg

SEQ ID NO: 219800 - DNA, 23 bp, Mus musculus
agcctcagtgtgtgtgtgagtgc

SEQ ID NO: 219801 - DNA, 18 bp, Mus musculus
tgtctgcttcagttcctg

SEQ ID NO: 219802 - DNA, 23 bp, Mus musculus
tggactcatagtttggtgggttt

SEQ ID NO: 219803 - DNA, 23 bp, Mus musculus
ctagcacacagtctgtctgtcac

SEQ ID NO: 219804 - DNA, 19 bp, Mus musculus
acatcctgaggctgtgcgg

SEQ ID NO: 219805 - DNA, 23 bp, Mus musculus
tgtccctgtcttcctgggtcaca

SEQ ID NO: 219806 - DNA, 19 bp, Mus musculus
agacagcagacagagggga

SEQ ID NO: 219807 - DNA, 23 bp, Mus musculus
acagcgagcagtgactctccgtg

SEQ ID NO: 219808 - DNA, 18 bp, Mus musculus
acagagagcacagagagt

SEQ ID NO: 219809 - DNA, 23 bp, Mus musculus
ggtggctctctgaggctcactga

SEQ ID NO: 219810 - DNA, 23 bp, Mus musculus
ctcagtggctcagtggctcagtg

SEQ ID NO: 219811 - DNA, 23 bp, Mus musculus
tctgacattgtcagtgtctgaga

SEQ ID NO: 219812 - DNA, 21 bp, Mus musculus
cacacgcacacactccctctc

SEQ ID NO: 219813 - DNA, 22 bp, Mus musculus
atgagagtctggtaatgttgag

SEQ ID NO: 219814 - DNA, 23 bp, Mus musculus
acatctgagtttgggtatgtaca

SEQ ID NO: 219815 - DNA, 23 bp, Mus musculus
ctccctgcctgtctgggtcactc

SEQ ID NO: 219816 - DNA, 23 bp, Mus musculus
tcgctgtgtgcctgtgtccctct

SEQ ID NO: 219817 - DNA, 23 bp, Mus musculus
tgagtgtctgtgtgtgtgtgcgc

SEQ ID NO: 219818 - DNA, 19 bp, Mus musculus
ccccgagacttagggcgtt

SEQ ID NO: 219819 - DNA, 23 bp, Mus musculus
ctctgtctctgcgtctctgtctg

SEQ ID NO: 219820 - DNA, 21 bp, Mus musculus
cagcttcgatgacatcacacc

SEQ ID NO: 219821 - DNA, 19 bp, Mus musculus
ttccgagtgcctgttctgt

SEQ ID NO: 219822 - DNA, 23 bp, Mus musculus
agacagttgtgtgacagcaggtc

SEQ ID NO: 219823 - DNA, 23 bp, Mus musculus
gtgtctctcagaccctctcagtt

SEQ ID NO: 219824 - DNA, 21 bp, Mus musculus
aagcaaggtgatgcaggaatg

SEQ ID NO: 219825 - DNA, 23 bp, Mus musculus
gtctctgtgtgtgttagtcctgt

SEQ ID NO: 219826 - DNA, 21 bp, Mus musculus
tgtatgtatgtatgtatgtat

SEQ ID NO: 219827 - DNA, 23 bp, Mus musculus
gtacatacctgatgtctgtgtag

SEQ ID NO: 219828 - DNA, 23 bp, Mus musculus
ctatgtgtctgtagtgtctgtgt

SEQ ID NO: 219829 - DNA, 23 bp, Mus musculus
ctgtctgcctgtctgcctgcctg

SEQ ID NO: 219830 - DNA, 21 bp, Mus musculus
tatacacacacatatacatgt

SEQ ID NO: 219831 - DNA, 18 bp, Mus musculus
actggagggatggtccag

SEQ ID NO: 219832 - DNA, 21 bp, Mus musculus
tccgtgggtcggtggctgcct

SEQ ID NO: 219833 - DNA, 20 bp, Mus musculus
gtctcttcttgggctggtga

SEQ ID NO: 219834 - DNA, 23 bp, Mus musculus
gagtcactgtgtgcctggctggg

SEQ ID NO: 219835 - DNA, 22 bp, Mus musculus
tgtgttcaattcccagcaatcg

SEQ ID NO: 219836 - DNA, 23 bp, Mus musculus
ctctgggtctctctgtccttgac

SEQ ID NO: 219837 - DNA, 22 bp, Mus musculus
aaagacagcttagcatggaggt

SEQ ID NO: 219838 - DNA, 18 bp, Mus musculus
tctagagatggttcagtg

SEQ ID NO: 219839 - DNA, 18 bp, Mus musculus
ggtaacaggtactgatga

SEQ ID NO: 219840 - DNA, 23 bp, Mus musculus
actcacactgtatatgatatgca

SEQ ID NO: 219841 - DNA, 23 bp, Mus musculus
tattctctgtagtaaagaactag

SEQ ID NO: 219842 - DNA, 23 bp, Mus musculus
aactcacagctatctttttctga

SEQ ID NO: 219843 - DNA, 23 bp, Mus musculus
cactgttcacaggacttgatcct

SEQ ID NO: 219844 - DNA, 20 bp, Mus musculus
gctgaagctgctctccaggt

SEQ ID NO: 219845 - DNA, 23 bp, Mus musculus
tgcatgtttgtgtgcatgttcat

SEQ ID NO: 219846 - DNA, 23 bp, Mus musculus
atgtgtgtgcatgtacatgtgca

SEQ ID NO: 219847 - DNA, 23 bp, Mus musculus
ctctgtgtgtgcctgtgtgtctg

SEQ ID NO: 219848 - DNA, 20 bp, Mus musculus
ttctctctactggaatgctt

SEQ ID NO: 219849 - DNA, 23 bp, Mus musculus
tatgtgtgtgtatatgtgtatgt

SEQ ID NO: 219850 - DNA, 18 bp, Mus musculus
atgtgtatatatatatgt

SEQ ID NO: 219851 - DNA, 23 bp, Mus musculus
agagacacagtaggcggtagcta

SEQ ID NO: 219852 - DNA, 23 bp, Mus musculus
gtctctctgtgtgtctctgccct

SEQ ID NO: 219853 - DNA, 21 bp, Mus musculus
acactcactcagaagtagcct

SEQ ID NO: 219854 - DNA, 23 bp, Mus musculus
tgtatgtgcatgtgcacgtgcat

SEQ ID NO: 219855 - DNA, 23 bp, Mus musculus
tacatgtgtgtgtatttgcatgc

SEQ ID NO: 219856 - DNA, 23 bp, Mus musculus
ctggctgactgactcactggctg

SEQ ID NO: 219857 - DNA, 23 bp, Mus musculus
atctattcatcctggtgggtgac

SEQ ID NO: 219858 - DNA, 23 bp, Mus musculus
ctgagtgatgagacatggtgttg

SEQ ID NO: 219859 - DNA, 23 bp, Mus musculus
tatatatgcatgtgtatacatat

SEQ ID NO: 219860 - DNA, 23 bp, Mus musculus
tatgcatgtatatatgtatgtgt

SEQ ID NO: 219861 - DNA, 23 bp, Mus musculus
atgcaggaccctgagtattcaag

SEQ ID NO: 219862 - DNA, 23 bp, Mus musculus
ctgctgggtcagtcagtccctgt

SEQ ID NO: 219863 - DNA, 23 bp, Mus musculus
actactctcctctctgtctgtct

SEQ ID NO: 219864 - DNA, 19 bp, Mus musculus
cactagaactgagcttgcc

SEQ ID NO: 219865 - DNA, 23 bp, Mus musculus
gtgctctgaaatgcctgtcattt

SEQ ID NO: 219866 - DNA, 18 bp, Mus musculus
tcagacccttgtgacctc

SEQ ID NO: 219867 - DNA, 23 bp, Mus musculus
gggggtcactctggctcttactg

SEQ ID NO: 219868 - DNA, 18 bp, Mus musculus
tgtcttgctctctggctg

SEQ ID NO: 219869 - DNA, 23 bp, Mus musculus
gcctgtctcactctgtcccttgt

SEQ ID NO: 219870 - DNA, 23 bp, Mus musculus
ctgctctgagacactttgagctc

SEQ ID NO: 219871 - DNA, 23 bp, Mus musculus
agtgctcagagcagtgtcaggac

SEQ ID NO: 219872 - DNA, 22 bp, Mus musculus
ttaggctatccttgaagtgact

SEQ ID NO: 219873 - DNA, 21 bp, Mus musculus
gtgactgtatctctctgggtt

SEQ ID NO: 219874 - DNA, 20 bp, Mus musculus
attcagctgcgatttcttac

SEQ ID NO: 219875 - DNA, 21 bp, Mus musculus
tagacaatacagagtgaggac

SEQ ID NO: 219876 - DNA, 19 bp, Mus musculus
ttgcatcaatgttcgtaag

SEQ ID NO: 219877 - DNA, 20 bp, Mus musculus
ttaaggacaacttctccatc

SEQ ID NO: 219878 - DNA, 22 bp, Mus musculus
ctgcattttgatctgcttgctg

SEQ ID NO: 219879 - DNA, 21 bp, Mus musculus
tacagttcagattatgatgtt

SEQ ID NO: 219880 - DNA, 23 bp, Mus musculus
atttgtttgattaatgatgtatg

SEQ ID NO: 219881 - DNA, 23 bp, Mus musculus
gtctcagaggaaggttgtctgcc

SEQ ID NO: 219882 - DNA, 23 bp, Mus musculus
tttggggattgactctcagactt

SEQ ID NO: 219883 - DNA, 23 bp, Mus musculus
agcctcagacagtagagaccgtg

SEQ ID NO: 219884 - DNA, 23 bp, Mus musculus
gcaagaggatctctttgaattct

SEQ ID NO: 219885 - DNA, 23 bp, Mus musculus
agagctactcagagactgtgtgt

SEQ ID NO: 219886 - DNA, 21 bp, Mus musculus
tggctcagtggcgggctggaa

SEQ ID NO: 219887 - DNA, 23 bp, Mus musculus
agtcactgtctctgtgcatctct

SEQ ID NO: 219888 - DNA, 23 bp, Mus musculus
tcaacccacactgtgtctcactc

SEQ ID NO: 219889 - DNA, 22 bp, Mus musculus
atgtgaatatatatatgtgtgc

SEQ ID NO: 219890 - DNA, 22 bp, Mus musculus
tatgtgagtatatatatgtgtg

SEQ ID NO: 219891 - DNA, 23 bp, Mus musculus
cagtgtggacagtgtggagactg

SEQ ID NO: 219892 - DNA, 23 bp, Mus musculus
tatgtatgtatgtatgtatgtat

SEQ ID NO: 219893 - DNA, 23 bp, Mus musculus
ctcaggacacaggcagctgtgca

SEQ ID NO: 219894 - DNA, 23 bp, Mus musculus
tgcctgactgtgtgtctgtgcgc

SEQ ID NO: 219895 - DNA, 21 bp, Mus musculus
tccggctcacactcagcctgt

SEQ ID NO: 219896 - DNA, 23 bp, Mus musculus
agattcccactctgactcactgc

SEQ ID NO: 219897 - DNA, 20 bp, Mus musculus
ctctctatctctgactccct

SEQ ID NO: 219898 - DNA, 18 bp, Mus musculus
atgccgcactgtagctca

SEQ ID NO: 219899 - DNA, 23 bp, Mus musculus
tgtgtgtgactgtgtgtgagtgt

SEQ ID NO: 219900 - DNA, 21 bp, Mus musculus
aggtagaagagagccagcaga

SEQ ID NO: 219901 - DNA, 21 bp, Mus musculus
tatacacacacacatacatat

SEQ ID NO: 219902 - DNA, 23 bp, Mus musculus
tgtatgtatgtatgtatgtatgt

SEQ ID NO: 219903 - DNA, 18 bp, Mus musculus
tggccctggtcctggtgg

SEQ ID NO: 219904 - DNA, 18 bp, Mus musculus
tcacggtgctctgctgcc

SEQ ID NO: 219905 - DNA, 18 bp, Mus musculus
tgacgggctggagagatg

SEQ ID NO: 219906 - DNA, 23 bp, Mus musculus
tcacagcctacactcctcttttt

SEQ ID NO: 219907 - DNA, 18 bp, Mus musculus
gtgggtggcactcaggct

SEQ ID NO: 219908 - DNA, 22 bp, Mus musculus
gagttgagtgtagagactgagg

SEQ ID NO: 219909 - DNA, 21 bp, Mus musculus
cactgactgctcttccagagg

SEQ ID NO: 219910 - DNA, 23 bp, Mus musculus
tgtatgaatgtgtgtgtgtgtat

SEQ ID NO: 219911 - DNA, 21 bp, Mus musculus
agcatgtgtgtatgtatgtat

SEQ ID NO: 219912 - DNA, 22 bp, Mus musculus
tgttttgtgaccaattatatgg

SEQ ID NO: 219913 - DNA, 22 bp, Mus musculus
agacttgtgattttcatcaggt

SEQ ID NO: 219914 - DNA, 23 bp, Mus musculus
tccttcatgtcctgcaactcttc

SEQ ID NO: 219915 - DNA, 22 bp, Mus musculus
aatcacagaacacattgaggtc

SEQ ID NO: 219916 - DNA, 23 bp, Mus musculus
tgtctgtgtgtctatgtgcatgt

SEQ ID NO: 219917 - DNA, 23 bp, Mus musculus
atagaatattcagctgcctgtat

SEQ ID NO: 219918 - DNA, 23 bp, Mus musculus
atagaatattcagctgcctgtat

SEQ ID NO: 219919 - DNA, 23 bp, Mus musculus
tctctgtctatttctctgtcact

SEQ ID NO: 219920 - DNA, 23 bp, Mus musculus
aagttgagagtaactgttcaggt

SEQ ID NO: 219921 - DNA, 22 bp, Mus musculus
catagcccatgctctctctcac

SEQ ID NO: 219922 - DNA, 19 bp, Mus musculus
tgttctggatgctgtgagt

SEQ ID NO: 219923 - DNA, 20 bp, Mus musculus
tgtatgtgtccatgtgtatg

SEQ ID NO: 219924 - DNA, 22 bp, Mus musculus
tgttttgtgaccaattatatgg

SEQ ID NO: 219925 - DNA, 20 bp, Mus musculus
tgtgtagaacatgtgaaggt

SEQ ID NO: 219926 - DNA, 21 bp, Mus musculus
tatgcatgtatgtgtgtatgt

SEQ ID NO: 219927 - DNA, 19 bp, Mus musculus
aacttctagataggacatt

SEQ ID NO: 219928 - DNA, 22 bp, Mus musculus
tgttttgtgaccaattatatgg

SEQ ID NO: 219929 - DNA, 23 bp, Mus musculus
atcactgaggctatggagcactg

SEQ ID NO: 219930 - DNA, 23 bp, Mus musculus
ttttttggtcttgatcatctaga

SEQ ID NO: 219931 - DNA, 23 bp, Mus musculus
ttactcagtattctcaggaactc

SEQ ID NO: 219932 - DNA, 20 bp, Mus musculus
tgaaagaagtcagtgcgcag

SEQ ID NO: 219933 - DNA, 22 bp, Mus musculus
tgtgtcagtatctgtctgagtt

SEQ ID NO: 219934 - DNA, 21 bp, Mus musculus
aacacactcactctatcccgt

SEQ ID NO: 219935 - DNA, 20 bp, Mus musculus
tgtggtgcaagagctgagtg

SEQ ID NO: 219936 - DNA, 21 bp, Mus musculus
tatgtgtatatatatatatga

SEQ ID NO: 219937 - DNA, 20 bp, Mus musculus
tataggaacatatgctatgg

SEQ ID NO: 219938 - DNA, 23 bp, Mus musculus
agagagtgtcctaagcttgttct

SEQ ID NO: 219939 - DNA, 22 bp, Mus musculus
agattagaggtgctgctcttta

SEQ ID NO: 219940 - DNA, 23 bp, Mus musculus
tgacagaacagactgagttttgg

SEQ ID NO: 219941 - DNA, 22 bp, Mus musculus
tagaggtagtagattctttttt

SEQ ID NO: 219942 - DNA, 23 bp, Mus musculus
tcacttgagcatcatagttccat

SEQ ID NO: 219943 - DNA, 23 bp, Mus musculus
tagtgcatggtgatctgatagga

SEQ ID NO: 219944 - DNA, 19 bp, Mus musculus
tttgtgacctattatgtgg

SEQ ID NO: 219945 - DNA, 21 bp, Mus musculus
tttgtcagtactcctagccaa

SEQ ID NO: 219946 - DNA, 23 bp, Mus musculus
tgtttctcagtctctctgcaacc

SEQ ID NO: 219947 - DNA, 22 bp, Mus musculus
tgttttgtgaccaattatatgg

SEQ ID NO: 219948 - DNA, 23 bp, Mus musculus
tttagtttacatacatgtgtgtg

SEQ ID NO: 219949 - DNA, 21 bp, Mus musculus
tgagagtagtcagtggtcagt

SEQ ID NO: 219950 - DNA, 19 bp, Mus musculus
tatggatatgaagctatat

SEQ ID NO: 219951 - DNA, 22 bp, Mus musculus
tatatcttcatatccatatcta

SEQ ID NO: 219952 - DNA, 23 bp, Mus musculus
aggaatgatttgtgtcataagtg

SEQ ID NO: 219953 - DNA, 22 bp, Mus musculus
tgttttgtgaccaattatatgg

SEQ ID NO: 219954 - DNA, 21 bp, Mus musculus
acaggtagaaggatgtttaga

SEQ ID NO: 219955 - DNA, 23 bp, Mus musculus
ttatatgtatttgatatgtgaaa

SEQ ID NO: 219956 - DNA, 18 bp, Mus musculus
tggagagatagtttggtg

SEQ ID NO: 219957 - DNA, 23 bp, Mus musculus
agacagcagagagtgagttcttg

SEQ ID NO: 219958 - DNA, 23 bp, Mus musculus
aggacactggatgttgcttgctc

SEQ ID NO: 219959 - DNA, 21 bp, Mus musculus
tcgttttcaataaattgactc

SEQ ID NO: 219960 - DNA, 22 bp, Mus musculus
tttgttctaggatgtatacttg

SEQ ID NO: 219961 - DNA, 22 bp, Mus musculus
atgtgtagtcattttgtagaac

SEQ ID NO: 219962 - DNA, 18 bp, Mus musculus
gaggtacagagaagaaag

SEQ ID NO: 219963 - DNA, 23 bp, Mus musculus
agtctcactcacattctctcaat

SEQ ID NO: 219964 - DNA, 19 bp, Mus musculus
tatatgtatgtatatgtgt

SEQ ID NO: 219965 - DNA, 23 bp, Mus musculus
tatatgtgtgtgtgtgtatacac

SEQ ID NO: 219966 - DNA, 23 bp, Mus musculus
gctcaatgcttgttgttagtgat

SEQ ID NO: 219967 - DNA, 22 bp, Mus musculus
tgttttgtgaccaattatatgg

SEQ ID NO: 219968 - DNA, 21 bp, Mus musculus
gtcagtgttcacagaccaggg

SEQ ID NO: 219969 - DNA, 23 bp, Mus musculus
agagtctcattcagatgacccag

SEQ ID NO: 219970 - DNA, 23 bp, Mus musculus
acacactatctcagtcctttagt

SEQ ID NO: 219971 - DNA, 23 bp, Mus musculus
tctcagaagatacatagcacatc

SEQ ID NO: 219972 - DNA, 23 bp, Mus musculus
ggcacagtcaggctttgggtgag

SEQ ID NO: 219973 - DNA, 22 bp, Mus musculus
tcaacatcttacagtctcagtc

SEQ ID NO: 219974 - DNA, 22 bp, Mus musculus
tgttttgtgaccaattatatgg

SEQ ID NO: 219975 - DNA, 22 bp, Mus musculus
tgttttgtgaccaattatatgg

SEQ ID NO: 219976 - DNA, 23 bp, Mus musculus
tgtccctgtgtctgtgtgtcccc

SEQ ID NO: 219977 - DNA, 23 bp, Mus musculus
acacactctctctatttttcaat

SEQ ID NO: 219978 - DNA, 23 bp, Mus musculus
tgtgtctctgtgtgtgagcacat

SEQ ID NO: 219979 - DNA, 23 bp, Mus musculus
ctggtctgactttctcacactct

SEQ ID NO: 219980 - DNA, 21 bp, Mus musculus
tttggagcctgtactagggaa

SEQ ID NO: 219981 - DNA, 22 bp, Mus musculus
atatgtaagtataatatggatg

SEQ ID NO: 219982 - DNA, 23 bp, Mus musculus
tatatttgcatatgtgtctgtgc

SEQ ID NO: 219983 - DNA, 23 bp, Mus musculus
gctctgtctgactcagtttgtag

SEQ ID NO: 219984 - DNA, 19 bp, Mus musculus
cagtgcatgaaactgagag

SEQ ID NO: 219985 - DNA, 18 bp, Mus musculus
tgctcctttgtttatagc

SEQ ID NO: 219986 - DNA, 19 bp, Mus musculus
agtatctgcaccagggtgt

SEQ ID NO: 219987 - DNA, 19 bp, Mus musculus
agagctaagtttgtactta

SEQ ID NO: 219988 - DNA, 23 bp, Mus musculus
atgtatgtatgtatgtatgtatg

SEQ ID NO: 219989 - DNA, 23 bp, Mus musculus
atagcttatatatagctatgtat

SEQ ID NO: 219990 - DNA, 22 bp, Mus musculus
gagcttcttcatctctgactca

SEQ ID NO: 219991 - DNA, 19 bp, Mus musculus
tggctgtgagcgttcctgc

SEQ ID NO: 219992 - DNA, 22 bp, Mus musculus
tgttttgtgaccaattatatgg

SEQ ID NO: 219993 - DNA, 18 bp, Mus musculus
ctgcatcctctgcagtct

SEQ ID NO: 219994 - DNA, 19 bp, Mus musculus
gagagatcagagagatcag

SEQ ID NO: 219995 - DNA, 20 bp, Mus musculus
agctgtcggagctatgtgat

SEQ ID NO: 219996 - DNA, 23 bp, Mus musculus
gtgcctctgtgtgtgtgtctgtc

SEQ ID NO: 219997 - DNA, 23 bp, Mus musculus
tcactttccctgtctccctccaa

SEQ ID NO: 219998 - DNA, 22 bp, Mus musculus
tggctgtggttatgtgtgtgtg

SEQ ID NO: 219999 - DNA, 19 bp, Mus musculus
acacatgctcacactcaca

SEQ ID NO: 220000 - DNA, 23 bp, Mus musculus
tgtctcagtttctctctctgctt

SEQ ID NO: 220001 - DNA, 21 bp, Mus musculus
aaagcagaagatgaaaagggt

SEQ ID NO: 220002 - DNA, 20 bp, Mus musculus
tatgtgcttgaacattctgc

SEQ ID NO: 220003 - DNA, 23 bp, Mus musculus
tatatgtgtgtatatgtatgcat

SEQ ID NO: 220004 - DNA, 20 bp, Mus musculus
tctgccttatctctgtctta

SEQ ID NO: 220005 - DNA, 22 bp, Mus musculus
tatgtacatatatatatgtctg

SEQ ID NO: 220006 - DNA, 20 bp, Mus musculus
agcccggctccctgtaagcc

SEQ ID NO: 220007 - DNA, 23 bp, Mus musculus
aggcagatgtgtgtgaggtcagg

SEQ ID NO: 220008 - DNA, 23 bp, Mus musculus
ggccctctgtgactccctgactc

SEQ ID NO: 220009 - DNA, 23 bp, Mus musculus
tctgtctgggtcactctgtggga

SEQ ID NO: 220010 - DNA, 19 bp, Mus musculus
tgaggaagtgtatcactgg

SEQ ID NO: 220011 - DNA, 23 bp, Mus musculus
gttctaaagttcagctactgctc

SEQ ID NO: 220012 - DNA, 23 bp, Mus musculus
gtatgtatgtatgtatgtatgtg

SEQ ID NO: 220013 - DNA, 22 bp, Mus musculus
tatggatggatgatgtatgcat

SEQ ID NO: 220014 - DNA, 23 bp, Mus musculus
tctcactgtctctgaggtggccc

SEQ ID NO: 220015 - DNA, 23 bp, Mus musculus
atatgtctatatgtatatgtgtg

SEQ ID NO: 220016 - DNA, 23 bp, Mus musculus
tgtttgtatgcatgtctgtaggt

SEQ ID NO: 220017 - DNA, 22 bp, Mus musculus
atggctgtatagatacacgtgt

SEQ ID NO: 220018 - DNA, 23 bp, Mus musculus
gaccagactggccttgaactctc

SEQ ID NO: 220019 - DNA, 20 bp, Mus musculus
gtctgcgtgcctggttccca

SEQ ID NO: 220020 - DNA, 21 bp, Mus musculus
tcagcaggatagtgtgaggtc

SEQ ID NO: 220021 - DNA, 22 bp, Mus musculus
tctgaccctcactcactggatc

SEQ ID NO: 220022 - DNA, 22 bp, Mus musculus
caccatctctgttggttttctt

SEQ ID NO: 220023 - DNA, 23 bp, Mus musculus
gactctgggtctctgtttcttta

SEQ ID NO: 220024 - DNA, 23 bp, Mus musculus
tcaactgtctctctctctgggtg

SEQ ID NO: 220025 - DNA, 21 bp, Mus musculus
acagcttccagaagagggccc

SEQ ID NO: 220026 - DNA, 23 bp, Mus musculus
tgtgagtctgtctgtctgtctgt

SEQ ID NO: 220027 - DNA, 23 bp, Mus musculus
ctgcctgcctgcctgcctgcctg

SEQ ID NO: 220028 - DNA, 23 bp, Mus musculus
gtgagccactgtgtgattgctgg

SEQ ID NO: 220029 - DNA, 21 bp, Mus musculus
ctcagagagcactcactgctc

SEQ ID NO: 220030 - DNA, 23 bp, Mus musculus
tatgtgcatgtatatatgtatgt

SEQ ID NO: 220031 - DNA, 21 bp, Mus musculus
tctccccctctcactgtccct

SEQ ID NO: 220032 - DNA, 23 bp, Mus musculus
ctctgtctctctgggtgcctcag

SEQ ID NO: 220033 - DNA, 22 bp, Mus musculus
atgcacatgatgacatgtgacc

SEQ ID NO: 220034 - DNA, 23 bp, Mus musculus
gtgtgtgtatgtgcatgtatatg

SEQ ID NO: 220035 - DNA, 21 bp, Mus musculus
atgtgtgtgcacatgtgcata

SEQ ID NO: 220036 - DNA, 20 bp, Mus musculus
cattctatgtgtctctctgt

SEQ ID NO: 220037 - DNA, 22 bp, Mus musculus
gtatgtatgtatgtgtgtatgt

SEQ ID NO: 220038 - DNA, 18 bp, Mus musculus
tgcagcagcaggaggaga

SEQ ID NO: 220039 - DNA, 23 bp, Mus musculus
gagaccctctgtgtgtctatgct

SEQ ID NO: 220040 - DNA, 21 bp, Mus musculus
tgattaggtcctggtctcggt

SEQ ID NO: 220041 - DNA, 18 bp, Mus musculus
catctctgtctgtctcct

SEQ ID NO: 220042 - DNA, 23 bp, Mus musculus
tcttgactctccctctcccacac

SEQ ID NO: 220043 - DNA, 23 bp, Mus musculus
tgtctgtctgtctgtctgtctat

SEQ ID NO: 220044 - DNA, 23 bp, Mus musculus
tgccacagtgcatatgtagaggt

SEQ ID NO: 220045 - DNA, 23 bp, Mus musculus
tatgtatgcatgtatatgagtat

SEQ ID NO: 220046 - DNA, 23 bp, Mus musculus
ctctctgtctgtctgtctgtctc

SEQ ID NO: 220047 - DNA, 22 bp, Mus musculus
gcacacttctgagagagctgtt

SEQ ID NO: 220048 - DNA, 23 bp, Mus musculus
cttctctgtctgtctgtctgtct

SEQ ID NO: 220049 - DNA, 21 bp, Mus musculus
tatgtatatgtatacatatct

SEQ ID NO: 220050 - DNA, 19 bp, Mus musculus
tgtatacacacatatacat

SEQ ID NO: 220051 - DNA, 23 bp, Mus musculus
tcctctgtctctcactcagccct

SEQ ID NO: 220052 - DNA, 23 bp, Mus musculus
tgactgtctctctgtctattggg

SEQ ID NO: 220053 - DNA, 22 bp, Mus musculus
tgtatgtttgtatgtgtgcttg

SEQ ID NO: 220054 - DNA, 21 bp, Mus musculus
agcctctgtgggtctctcagg

SEQ ID NO: 220055 - DNA, 23 bp, Mus musculus
atgagtgtagagtgtgtgcatgt

SEQ ID NO: 220056 - DNA, 22 bp, Mus musculus
tagctcaacatgaaaggcctgt

SEQ ID NO: 220057 - DNA, 22 bp, Mus musculus
tttcaccttgagttattcaact

SEQ ID NO: 220058 - DNA, 22 bp, Mus musculus
gtatgtatgtatgtatgtatgt

SEQ ID NO: 220059 - DNA, 20 bp, Mus musculus
tctctgagaaacctctatgt

SEQ ID NO: 220060 - DNA, 20 bp, Mus musculus
aaacagagaagagagcagca

SEQ ID NO: 220061 - DNA, 20 bp, Mus musculus
tgcatgtatatatgtgtgta

SEQ ID NO: 220062 - DNA, 21 bp, Mus musculus
taagtgcatgtgtgtatgtgt

SEQ ID NO: 220063 - DNA, 23 bp, Mus musculus
tgtgtgtgtatatatgtatgtgt

SEQ ID NO: 220064 - DNA, 22 bp, Mus musculus
ttctggtctagcacataccaag

SEQ ID NO: 220065 - DNA, 23 bp, Mus musculus
aaagggaatgggagaagagacac

SEQ ID NO: 220066 - DNA, 23 bp, Mus musculus
ctgcctgtctgtctgcctgcctg

SEQ ID NO: 220067 - DNA, 23 bp, Mus musculus
gacagaagataaggatcagcacc

SEQ ID NO: 220068 - DNA, 22 bp, Mus musculus
actctctctgtgtctctgtctg

SEQ ID NO: 220069 - DNA, 23 bp, Mus musculus
ctaaaagaacagacagtgctctt

SEQ ID NO: 220070 - DNA, 23 bp, Mus musculus
tggctctgtggctctgtggctct

SEQ ID NO: 220071 - DNA, 19 bp, Mus musculus
atacactttgaaaacctgt

SEQ ID NO: 220072 - DNA, 19 bp, Mus musculus
atctgtatatatatacatg

SEQ ID NO: 220073 - DNA, 18 bp, Mus musculus
tgtatgcatgcatgcgtg

SEQ ID NO: 220074 - DNA, 23 bp, Mus musculus
tatttcttgatcatttggatgtt

SEQ ID NO: 220075 - DNA, 20 bp, Mus musculus
caggctggctgcctgtttct

SEQ ID NO: 220076 - DNA, 23 bp, Mus musculus
ccagaacacatgcagcagaggat

SEQ ID NO: 220077 - DNA, 20 bp, Mus musculus
gcacatgtatgtatatgtgt

SEQ ID NO: 220078 - DNA, 23 bp, Mus musculus
atatgtatatatgtatgtgtgtg

SEQ ID NO: 220079 - DNA, 23 bp, Mus musculus
atatgtgtgtgtgtgtctgtctg

SEQ ID NO: 220080 - DNA, 21 bp, Mus musculus
tccctccctccctctttgtga

SEQ ID NO: 220081 - DNA, 23 bp, Mus musculus
tttgagtggttttatatacatat

SEQ ID NO: 220082 - DNA, 23 bp, Mus musculus
tgacaagtatgttttaccatcat

SEQ ID NO: 220083 - DNA, 21 bp, Mus musculus
tttgcagttctttctgataca

SEQ ID NO: 220084 - DNA, 22 bp, Mus musculus
agtgtcactggaactgaagcat

SEQ ID NO: 220085 - DNA, 23 bp, Mus musculus
tctgcatgtctctgtctctctca

SEQ ID NO: 220086 - DNA, 23 bp, Mus musculus
tacagagagagagagagagatgt

SEQ ID NO: 220087 - DNA, 23 bp, Mus musculus
ctgcctgcctgcctgcctgcctg

SEQ ID NO: 220088 - DNA, 23 bp, Mus musculus
accatgtgcaaaaacattcgctt

SEQ ID NO: 220089 - DNA, 22 bp, Mus musculus
tgttttgtgaccaattatatgg

SEQ ID NO: 220090 - DNA, 22 bp, Mus musculus
tgttttgtgaccaattatatgg

SEQ ID NO: 220091 - DNA, 22 bp, Mus musculus
agactgcctacatgatatcaca

SEQ ID NO: 220092 - DNA, 21 bp, Mus musculus
tctcagacactcagtgaggag

SEQ ID NO: 220093 - DNA, 20 bp, Mus musculus
tggatgagggtgtgtaaagt

SEQ ID NO: 220094 - DNA, 22 bp, Mus musculus
tgtgtggtttagatatcagagt

SEQ ID NO: 220095 - DNA, 23 bp, Mus musculus
tgagaacatagagagtacactgt

SEQ ID NO: 220096 - DNA, 20 bp, Mus musculus
tatttgagtgtttttcttta

SEQ ID NO: 220097 - DNA, 22 bp, Mus musculus
atagtacctacactgtatgaat

SEQ ID NO: 220098 - DNA, 23 bp, Mus musculus
tgtctgtctgtctgtctgtctgt

SEQ ID NO: 220099 - DNA, 23 bp, Mus musculus
ctctctctgactctctgtagtct

SEQ ID NO: 220100 - DNA, 18 bp, Mus musculus
atattcttgtcctagctg

SEQ ID NO: 220101 - DNA, 23 bp, Mus musculus
tttgggtggttcagatctgagat

SEQ ID NO: 220102 - DNA, 22 bp, Mus musculus
agtttcagtggtttaaatctca

SEQ ID NO: 220103 - DNA, 22 bp, Mus musculus
aggagcctgataaagctgtctc

SEQ ID NO: 220104 - DNA, 23 bp, Mus musculus
gagaggctctgtcagtgcctgac

SEQ ID NO: 220105 - DNA, 21 bp, Mus musculus
tgagcaagaaaagtctcagaa

SEQ ID NO: 220106 - DNA, 18 bp, Mus musculus
tgtgtgcttttctcatct

SEQ ID NO: 220107 - DNA, 21 bp, Mus musculus
tttgtcagaagagggtgatga

SEQ ID NO: 220108 - DNA, 23 bp, Mus musculus
actttctgtgatgttttctatta

SEQ ID NO: 220109 - DNA, 23 bp, Mus musculus
tctgtgtatatatatatgtgtgt

SEQ ID NO: 220110 - DNA, 19 bp, Mus musculus
tatgtgtatatatatatgt

SEQ ID NO: 220111 - DNA, 23 bp, Mus musculus
atttgtatatgtatgtataagtg

SEQ ID NO: 220112 - DNA, 23 bp, Mus musculus
ggtccatggtggtctgataggat

SEQ ID NO: 220113 - DNA, 23 bp, Mus musculus
tacatgtgcatatgtatatatgc

SEQ ID NO: 220114 - DNA, 23 bp, Mus musculus
atgtgtatatgtatggttgtgta

SEQ ID NO: 220115 - DNA, 23 bp, Mus musculus
aaggaatgatgattgctgttttc

SEQ ID NO: 220116 - DNA, 23 bp, Mus musculus
atgtatatgtgtaagtttatgtt

SEQ ID NO: 220117 - DNA, 21 bp, Mus musculus
tctgcatgtatgtatgtatgt

SEQ ID NO: 220118 - DNA, 20 bp, Mus musculus
tgagctggtaggatgcattg

SEQ ID NO: 220119 - DNA, 22 bp, Mus musculus
tgttttgtgaccaattatatgg

SEQ ID NO: 220120 - DNA, 23 bp, Mus musculus
acaagtcacagccagcctcatag

SEQ ID NO: 220121 - DNA, 22 bp, Mus musculus
aaattctgagtacatggtgact

SEQ ID NO: 220122 - DNA, 23 bp, Mus musculus
tcagcagtttcctgagtcagtgt

SEQ ID NO: 220123 - DNA, 23 bp, Mus musculus
tgtatgtgtggatgtgcatgtat

SEQ ID NO: 220124 - DNA, 23 bp, Mus musculus
gtgtgtctctcattctcaaatcc

SEQ ID NO: 220125 - DNA, 23 bp, Mus musculus
tgtcactctcgctgtcactgaag

SEQ ID NO: 220126 - DNA, 23 bp, Mus musculus
tgtgcatatatttgatgtgtgta

SEQ ID NO: 220127 - DNA, 18 bp, Mus musculus
taatgtgtgcatatgtgg

SEQ ID NO: 220128 - DNA, 22 bp, Mus musculus
atatatgtgtatgaatatgtgt

SEQ ID NO: 220129 - DNA, 19 bp, Mus musculus
agtgctctggagttgatgg

SEQ ID NO: 220130 - DNA, 23 bp, Mus musculus
cacacagacacatgtatgcagtc

SEQ ID NO: 220131 - DNA, 18 bp, Mus musculus
acacagaataccatccat

SEQ ID NO: 220132 - DNA, 22 bp, Mus musculus
tggctgggtctgtcagcctctg

SEQ ID NO: 220133 - DNA, 23 bp, Mus musculus
ctggtctcagagtctgtgtctgg

SEQ ID NO: 220134 - DNA, 23 bp, Mus musculus
atcagagggagcatagcttacca

SEQ ID NO: 220135 - DNA, 21 bp, Mus musculus
agtgtctttatctgtctgagt

SEQ ID NO: 220136 - DNA, 23 bp, Mus musculus
gtgagttgagtgtgttgacttct

SEQ ID NO: 220137 - DNA, 23 bp, Mus musculus
tgtctatctgtctggctctgtcc

SEQ ID NO: 220138 - DNA, 23 bp, Mus musculus
tttcagagagattttgttaaaag

SEQ ID NO: 220139 - DNA, 23 bp, Mus musculus
ttatgtgtatttatgtatatcta

SEQ ID NO: 220140 - DNA, 22 bp, Mus musculus
tttctctgaaagacaaagatgt

SEQ ID NO: 220141 - DNA, 23 bp, Mus musculus
ttctttagttgaatgtgaaagga

SEQ ID NO: 220142 - DNA, 21 bp, Mus musculus
tggaacaccttgtattctgaa

SEQ ID NO: 220143 - DNA, 23 bp, Mus musculus
aggaatgcaatgaactatgagtt

SEQ ID NO: 220144 - DNA, 23 bp, Mus musculus
agcaatggtgttcaaggatactg

SEQ ID NO: 220145 - DNA, 23 bp, Mus musculus
gagatgtcagtgaacacactggc

SEQ ID NO: 220146 - DNA, 19 bp, Mus musculus
ttgggctgttgattgccct

SEQ ID NO: 220147 - DNA, 23 bp, Mus musculus
ggacatcactcccagatatccct

SEQ ID NO: 220148 - DNA, 18 bp, Mus musculus
agagacaggataaatttt

SEQ ID NO: 220149 - DNA, 21 bp, Mus musculus
ttttcactggaaagattactg

SEQ ID NO: 220150 - DNA, 21 bp, Mus musculus
tttcatagtctttgaaaaggc

SEQ ID NO: 220151 - DNA, 22 bp, Mus musculus
tttgacacttcagtgtctgtca

SEQ ID NO: 220152 - DNA, 23 bp, Mus musculus
aagtgcatctgcatctgtattgg

SEQ ID NO: 220153 - DNA, 23 bp, Mus musculus
tcagtaggatatataatgtatat

SEQ ID NO: 220154 - DNA, 23 bp, Mus musculus
tatatgtgtatttgtatagatat

SEQ ID NO: 220155 - DNA, 23 bp, Mus musculus
aatagttccattatgttgtgtgt

SEQ ID NO: 220156 - DNA, 22 bp, Mus musculus
tgttttgtgaccaattatatgg

SEQ ID NO: 220157 - DNA, 22 bp, Mus musculus
tgttttgtgaccaattatatgg

SEQ ID NO: 220158 - DNA, 19 bp, Mus musculus
atgtatgtatatatgtatg

SEQ ID NO: 220159 - DNA, 22 bp, Mus musculus
tatgtatatatattcatatgtg

SEQ ID NO: 220160 - DNA, 23 bp, Mus musculus
tatatgagtatacatttgtgtgt

SEQ ID NO: 220161 - DNA, 23 bp, Mus musculus
tgtgtatgtgtttgcatgtatgt

SEQ ID NO: 220162 - DNA, 21 bp, Mus musculus
tatgtgtatatatatatgtgt

SEQ ID NO: 220163 - DNA, 23 bp, Mus musculus
agtgttcagacatgttgatgtgt

SEQ ID NO: 220164 - DNA, 23 bp, Mus musculus
aggtgcaaagattataggtctga

SEQ ID NO: 220165 - DNA, 23 bp, Mus musculus
ttgaaatgtgattttcatgtaga

SEQ ID NO: 220166 - DNA, 22 bp, Mus musculus
tgttttgtgaccaattatatgg

SEQ ID NO: 220167 - DNA, 22 bp, Mus musculus
tggagtgcattgatgaatgtaa

SEQ ID NO: 220168 - DNA, 23 bp, Mus musculus
atccttgttgctcagattggtga

SEQ ID NO: 220169 - DNA, 23 bp, Mus musculus
tagctcctagagactctctgact

SEQ ID NO: 220170 - DNA, 23 bp, Mus musculus
atcaattcacagcaaccgcatgt

SEQ ID NO: 220171 - DNA, 22 bp, Mus musculus
atatgtcactgcttatgctgga

SEQ ID NO: 220172 - DNA, 23 bp, Mus musculus
tgacagaacattcattgctgagg

SEQ ID NO: 220173 - DNA, 23 bp, Mus musculus
atatacatagtatatgatatgta

SEQ ID NO: 220174 - DNA, 23 bp, Mus musculus
tttgtatgtatatatgtatggtg

SEQ ID NO: 220175 - DNA, 22 bp, Mus musculus
tatgtgtatgtgtatgtgtatg

SEQ ID NO: 220176 - DNA, 21 bp, Mus musculus
tccatggtggtctgataggat

SEQ ID NO: 220177 - DNA, 23 bp, Mus musculus
tgtcaccttgtaagttgtttaga

SEQ ID NO: 220178 - DNA, 23 bp, Mus musculus
tgtgaaattatatatatgtgtgt

SEQ ID NO: 220179 - DNA, 23 bp, Mus musculus
acacagctgaattctcccatact

SEQ ID NO: 220180 - DNA, 22 bp, Mus musculus
tgggtgagttcagtgtctcctg

SEQ ID NO: 220181 - DNA, 23 bp, Mus musculus
tgtatatgtatatgtatatgtat

SEQ ID NO: 220182 - DNA, 22 bp, Mus musculus
tgaacctgggaggatgatctag

SEQ ID NO: 220183 - DNA, 23 bp, Mus musculus
gttctgagagaacactgtgacca

SEQ ID NO: 220184 - DNA, 22 bp, Mus musculus
tgttttgtgaccaattatatgg

SEQ ID NO: 220185 - DNA, 22 bp, Mus musculus
ttagtatatatgtatatatgtg

SEQ ID NO: 220186 - DNA, 23 bp, Mus musculus
tatatgatcacatttggatacta

SEQ ID NO: 220187 - DNA, 21 bp, Mus musculus
agagcagttctgtaccaacat

SEQ ID NO: 220188 - DNA, 23 bp, Mus musculus
atctctgtctatatgtctctctc

SEQ ID NO: 220189 - DNA, 22 bp, Mus musculus
ttataggttggatagcttagtt

SEQ ID NO: 220190 - DNA, 23 bp, Mus musculus
gggtggactaactctgtctgtca

SEQ ID NO: 220191 - DNA, 21 bp, Mus musculus
tgagatctgacaggtagccta

SEQ ID NO: 220192 - DNA, 20 bp, Mus musculus
aatgagtgcaattttgagtg

SEQ ID NO: 220193 - DNA, 21 bp, Mus musculus
tatgcatatatatatcaatca

SEQ ID NO: 220194 - DNA, 23 bp, Mus musculus
tatgtgtgcatgtgcatgtgtat

SEQ ID NO: 220195 - DNA, 21 bp, Mus musculus
tgtatatatgcatgcatgtgt

SEQ ID NO: 220196 - DNA, 23 bp, Mus musculus
ctctcactgtgactcctgcttat

SEQ ID NO: 220197 - DNA, 23 bp, Mus musculus
tcactggaaataacagtagtcac

SEQ ID NO: 220198 - DNA, 18 bp, Mus musculus
tatacacacatgtataca

SEQ ID NO: 220199 - DNA, 22 bp, Mus musculus
tcaaagagatccaggtgtgtta

SEQ ID NO: 220200 - DNA, 23 bp, Mus musculus
tgtgttagtcactgtcactgtgg

SEQ ID NO: 220201 - DNA, 21 bp, Mus musculus
gttcagtgtgtgttaattgtc

SEQ ID NO: 220202 - DNA, 23 bp, Mus musculus
tgtgtatctctgtgtgtgtgcag

SEQ ID NO: 220203 - DNA, 23 bp, Mus musculus
tggatctcagtgactcagactgg

SEQ ID NO: 220204 - DNA, 23 bp, Mus musculus
tccctcagtcagttaaggttttc

SEQ ID NO: 220205 - DNA, 19 bp, Mus musculus
tatatatatgtttgtgatg

SEQ ID NO: 220206 - DNA, 18 bp, Mus musculus
aaagatctcaccgtggac

SEQ ID NO: 220207 - DNA, 22 bp, Mus musculus
agtgtcccacagtgtgtccctc

SEQ ID NO: 220208 - DNA, 23 bp, Mus musculus
gtgtctgtctgtctgtctgtctt

SEQ ID NO: 220209 - DNA, 19 bp, Mus musculus
ctgtgtccctgtctactga

SEQ ID NO: 220210 - DNA, 20 bp, Mus musculus
tgcctgtggatcaggatgga

SEQ ID NO: 220211 - DNA, 23 bp, Mus musculus
ctgtgaaaggcagttcagggtag

SEQ ID NO: 220212 - DNA, 23 bp, Mus musculus
atgtatatatgtatgcatgtatg

SEQ ID NO: 220213 - DNA, 20 bp, Mus musculus
attgataggaattgttgggg

SEQ ID NO: 220214 - DNA, 23 bp, Mus musculus
gggtcagtccctgcctctctctt

SEQ ID NO: 220215 - DNA, 23 bp, Mus musculus
tgtgtgtctgtgtgtgtatatgg

SEQ ID NO: 220216 - DNA, 19 bp, Mus musculus
tatatgtgtgtatatatgt

SEQ ID NO: 220217 - DNA, 22 bp, Mus musculus
ctgttatgaaaagtaatcacgt

SEQ ID NO: 220218 - DNA, 23 bp, Mus musculus
ttaagagcactgactgctcttct

SEQ ID NO: 220219 - DNA, 23 bp, Mus musculus
acccagaagagactcagcactga

SEQ ID NO: 220220 - DNA, 23 bp, Mus musculus
tgacagtatctcttctacctgga

SEQ ID NO: 220221 - DNA, 20 bp, Mus musculus
ctcactctttgagtctccct

SEQ ID NO: 220222 - DNA, 22 bp, Mus musculus
acaggtatttaataggcatttg

SEQ ID NO: 220223 - DNA, 22 bp, Mus musculus
tctctctcttcctgtctgtaaa

SEQ ID NO: 220224 - DNA, 23 bp, Mus musculus
atatgtgagtgtgtgtacacatg

SEQ ID NO: 220225 - DNA, 23 bp, Mus musculus
atgtgtgagtgcatgtacatgta

SEQ ID NO: 220226 - DNA, 20 bp, Mus musculus
aaatgtgtatgtcatgtaca

SEQ ID NO: 220227 - DNA, 23 bp, Mus musculus
tcactgtcaggtaatcattgcct

SEQ ID NO: 220228 - DNA, 19 bp, Mus musculus
tcagaagagacactcaggg

SEQ ID NO: 220229 - DNA, 23 bp, Mus musculus
tctctgcctgtctgtctgtctgt

SEQ ID NO: 220230 - DNA, 20 bp, Mus musculus
gaggctctcactctggctca

SEQ ID NO: 220231 - DNA, 23 bp, Mus musculus
agtgacagtcagagtccttgctt

SEQ ID NO: 220232 - DNA, 22 bp, Mus musculus
tgtctgcctgcctgcctgcctg

SEQ ID NO: 220233 - DNA, 23 bp, Mus musculus
ctgtctgtctgtctgtctgtctg

SEQ ID NO: 220234 - DNA, 23 bp, Mus musculus
aacccaagtgtttttcttctagt

SEQ ID NO: 220235 - DNA, 19 bp, Mus musculus
gtgtgtcactgtgggggtg

SEQ ID NO: 220236 - DNA, 23 bp, Mus musculus
gtgtgtctgtctgtctctttctc

SEQ ID NO: 220237 - DNA, 18 bp, Mus musculus
tgaacactgacattgggg

SEQ ID NO: 220238 - DNA, 23 bp, Mus musculus
tatatacatgcatatgtatatat

SEQ ID NO: 220239 - DNA, 22 bp, Mus musculus
atgtatgtatatatatatatgt

SEQ ID NO: 220240 - DNA, 23 bp, Mus musculus
tgtatgtgtatatatgcatgtgt

SEQ ID NO: 220241 - DNA, 18 bp, Mus musculus
tatgcatgcatgtatgca

SEQ ID NO: 220242 - DNA, 23 bp, Mus musculus
acccacagaataatttatgaaca

SEQ ID NO: 220243 - DNA, 23 bp, Mus musculus
cactgtgtctgacactcactgac

SEQ ID NO: 220244 - DNA, 22 bp, Mus musculus
tgtgtgtgtgtatgatttatat

SEQ ID NO: 220245 - DNA, 23 bp, Mus musculus
atgtgcatgtatgtatgtgtgta

SEQ ID NO: 220246 - DNA, 23 bp, Mus musculus
gaggatgtgtcttggtggtgaag

SEQ ID NO: 220247 - DNA, 22 bp, Mus musculus
tgttttgtgaccaattatatgg

SEQ ID NO: 220248 - DNA, 23 bp, Mus musculus
aggttgtgtttctctacaggctt

SEQ ID NO: 220249 - DNA, 23 bp, Mus musculus
acacacacacatattcctgagta

SEQ ID NO: 220250 - DNA, 23 bp, Mus musculus
cagcaaattcaatggcagtgaat

SEQ ID NO: 220251 - DNA, 23 bp, Mus musculus
agaggtatttggatcttttgtct

SEQ ID NO: 220252 - DNA, 23 bp, Mus musculus
aaaggacatggctgagtatcatc

SEQ ID NO: 220253 - DNA, 22 bp, Mus musculus
tgttttgtgaccaattatatgg

SEQ ID NO: 220254 - DNA, 23 bp, Mus musculus
tgtatatttatgcttgtatatct

SEQ ID NO: 220255 - DNA, 22 bp, Mus musculus
atatttgtatgaatatatgtgt

SEQ ID NO: 220256 - DNA, 23 bp, Mus musculus
agctatcatatctaaggttgggt

SEQ ID NO: 220257 - DNA, 22 bp, Mus musculus
tattttcttggctgtgggtctc

SEQ ID NO: 220258 - DNA, 23 bp, Mus musculus
tgcatctctctctctgtgattct

SEQ ID NO: 220259 - DNA, 23 bp, Mus musculus
tccagccactgtgaatagtgaag

SEQ ID NO: 220260 - DNA, 23 bp, Mus musculus
tgtgtgtctgtatgtgtttgtgt

SEQ ID NO: 220261 - DNA, 23 bp, Mus musculus
aaggtagtccgtgttgacatcca

SEQ ID NO: 220262 - DNA, 23 bp, Mus musculus
tatgtatgtatgtatgtgtgtgt

SEQ ID NO: 220263 - DNA, 23 bp, Mus musculus
aaaagacagccatagatctcaga

SEQ ID NO: 220264 - DNA, 21 bp, Mus musculus
tgtaacagagcaaagggtgac

SEQ ID NO: 220265 - DNA, 20 bp, Mus musculus
actgactgctcttccagagg

SEQ ID NO: 220266 - DNA, 21 bp, Mus musculus
tacaaccatctgtaatgagat

SEQ ID NO: 220267 - DNA, 23 bp, Mus musculus
tgtgtatgtatgtatatatgtat

SEQ ID NO: 220268 - DNA, 23 bp, Mus musculus
tgtgcgtgtctgcgtgtgggtat

SEQ ID NO: 220269 - DNA, 21 bp, Mus musculus
aaagtctcaggcgatagccat

SEQ ID NO: 220270 - DNA, 22 bp, Mus musculus
taacactctcaatggagttaca

SEQ ID NO: 220271 - DNA, 23 bp, Mus musculus
ttattttgttgatgatggtggtt

SEQ ID NO: 220272 - DNA, 23 bp, Mus musculus
tgtctgtgtgtctgtgtgcatgt

SEQ ID NO: 220273 - DNA, 22 bp, Mus musculus
ggatgtcagaggataacttgca

SEQ ID NO: 220274 - DNA, 23 bp, Mus musculus
gactgagaaaacagagagcacag

SEQ ID NO: 220275 - DNA, 20 bp, Mus musculus
tgtcttctcagctgagaagt

SEQ ID NO: 220276 - DNA, 22 bp, Mus musculus
ctgtagttctgtatgtgtgtgt

SEQ ID NO: 220277 - DNA, 21 bp, Mus musculus
atgtatgtatgcatgtgtgta

SEQ ID NO: 220278 - DNA, 23 bp, Mus musculus
tgtatgtatgtgtatatgtgtgt

SEQ ID NO: 220279 - DNA, 19 bp, Mus musculus
ctcacatgtgtgggtgctg

SEQ ID NO: 220280 - DNA, 18 bp, Mus musculus
attagtagaagggagttg

SEQ ID NO: 220281 - DNA, 18 bp, Mus musculus
tcaccatgtggttcagtc

SEQ ID NO: 220282 - DNA, 18 bp, Mus musculus
ttgaggtggtgctaagca

SEQ ID NO: 220283 - DNA, 23 bp, Mus musculus
gtatctgtctgtctgtctgtgtg

SEQ ID NO: 220284 - DNA, 23 bp, Mus musculus
tgacatgtgagagtactgtgacc

SEQ ID NO: 220285 - DNA, 23 bp, Mus musculus
tatgtgtgcttgtgcatgtgtat

SEQ ID NO: 220286 - DNA, 20 bp, Mus musculus
aatcttccacaacttcaggc

SEQ ID NO: 220287 - DNA, 18 bp, Mus musculus
acccaaggaagactttcg

SEQ ID NO: 220288 - DNA, 18 bp, Mus musculus
tgtgtgtgtgtgcgcgcg

SEQ ID NO: 220289 - DNA, 23 bp, Mus musculus
ggctcagtgactctctcttgtga

SEQ ID NO: 220290 - DNA, 23 bp, Mus musculus
tctctgtctttctgtatgcctct

SEQ ID NO: 220291 - DNA, 21 bp, Mus musculus
atgtatgtatatatgtatgta

SEQ ID NO: 220292 - DNA, 22 bp, Mus musculus
ctgtcagcctgattgcctccct

SEQ ID NO: 220293 - DNA, 23 bp, Mus musculus
gggtcactctgtgattgtataga

SEQ ID NO: 220294 - DNA, 19 bp, Mus musculus
acagtgacagaatgaagcc

SEQ ID NO: 220295 - DNA, 22 bp, Mus musculus
ttgctgaggtctgtctgtctgt

SEQ ID NO: 220296 - DNA, 23 bp, Mus musculus
tctccctgtgtcactcactgaat

SEQ ID NO: 220297 - DNA, 23 bp, Mus musculus
ttgctagaaattgaactcaggat

SEQ ID NO: 220298 - DNA, 18 bp, Mus musculus
aagtgctcagtttctact

SEQ ID NO: 220299 - DNA, 22 bp, Mus musculus
tctgggtctcagtttgtacata

SEQ ID NO: 220300 - DNA, 23 bp, Mus musculus
tgactcagaggttaagagcactg

SEQ ID NO: 220301 - DNA, 21 bp, Mus musculus
ttgcttgttcatgcagtgggc

SEQ ID NO: 220302 - DNA, 22 bp, Mus musculus
acttgttggagtgtgtgctgac

SEQ ID NO: 220303 - DNA, 22 bp, Mus musculus
aagacacttttgaggggctgga

SEQ ID NO: 220304 - DNA, 23 bp, Mus musculus
tagtgcctgtttagctttctcta

SEQ ID NO: 220305 - DNA, 22 bp, Mus musculus
ttctatcactctatcttctgct

SEQ ID NO: 220306 - DNA, 21 bp, Mus musculus
aatgatctctgggtcctggag

SEQ ID NO: 220307 - DNA, 21 bp, Mus musculus
atgtatgtatacatgtgtatg

SEQ ID NO: 220308 - DNA, 22 bp, Mus musculus
tgtgtacatatgtatatatgtg

SEQ ID NO: 220309 - DNA, 23 bp, Mus musculus
acacatagagcaatgctgaatag

SEQ ID NO: 220310 - DNA, 23 bp, Mus musculus
ggtatctatacatgtatgtgaat

SEQ ID NO: 220311 - DNA, 18 bp, Mus musculus
gtatgtgcactacctgca

SEQ ID NO: 220312 - DNA, 20 bp, Mus musculus
ctgccagtctttgtgttttc

SEQ ID NO: 220313 - DNA, 20 bp, Mus musculus
tggctcagtggttaggagca

SEQ ID NO: 220314 - DNA, 23 bp, Mus musculus
aacaactggggctggaagatggc

SEQ ID NO: 220315 - DNA, 23 bp, Mus musculus
ctggtagttggttcttgagtagc

SEQ ID NO: 220316 - DNA, 23 bp, Mus musculus
tagaatgtatatatgtatgtatg

SEQ ID NO: 220317 - DNA, 23 bp, Mus musculus
tgtgactgctgacagtgtgcaga

SEQ ID NO: 220318 - DNA, 22 bp, Mus musculus
tgttttgtgaccaattatatgg

SEQ ID NO: 220319 - DNA, 23 bp, Mus musculus
ctagtctgagacagcttcccagc

SEQ ID NO: 220320 - DNA, 22 bp, Mus musculus
tcagcttgtttgtttgtttgtt

SEQ ID NO: 220321 - DNA, 23 bp, Mus musculus
gtctacctgtctgtctgtctgtt

SEQ ID NO: 220322 - DNA, 20 bp, Mus musculus
tagaatgatttacagactgt

SEQ ID NO: 220323 - DNA, 19 bp, Mus musculus
ttttcttttctcatattgg

SEQ ID NO: 220324 - DNA, 23 bp, Mus musculus
ctgatcagactgtactgtttgac

SEQ ID NO: 220325 - DNA, 20 bp, Mus musculus
tgtatgtggtatgtgtgtgt

SEQ ID NO: 220326 - DNA, 23 bp, Mus musculus
tgagaaaagaaagtcagctcagc

SEQ ID NO: 220327 - DNA, 23 bp, Mus musculus
gttattgtggattagagtctcta

SEQ ID NO: 220328 - DNA, 23 bp, Mus musculus
ttctctctagattctctgctcat

SEQ ID NO: 220329 - DNA, 23 bp, Mus musculus
tatagagattttcttgttctggt

SEQ ID NO: 220330 - DNA, 23 bp, Mus musculus
tctctcaggctgtgagtaagttg

SEQ ID NO: 220331 - DNA, 20 bp, Mus musculus
agtactgccacatagttatg

SEQ ID NO: 220332 - DNA, 23 bp, Mus musculus
ctacactagtgtatttaatgttg

SEQ ID NO: 220333 - DNA, 18 bp, Mus musculus
ttaaagtagaaatctgtt

SEQ ID NO: 220334 - DNA, 22 bp, Mus musculus
tgaatgcttgttgtttgagtca

SEQ ID NO: 220335 - DNA, 23 bp, Mus musculus
acagtgagcatctgaattccctt

SEQ ID NO: 220336 - DNA, 21 bp, Mus musculus
tatgtgtatgtgtatatgtgt

SEQ ID NO: 220337 - DNA, 23 bp, Mus musculus
ggggctgtctctgactctgttgt

SEQ ID NO: 220338 - DNA, 22 bp, Mus musculus
tgttttgtgaccaattatatgg

SEQ ID NO: 220339 - DNA, 23 bp, Mus musculus
ctaaaacagagagttattgctca

SEQ ID NO: 220340 - DNA, 22 bp, Mus musculus
tttgatgtaggtatcaaagctt

SEQ ID NO: 220341 - DNA, 19 bp, Mus musculus
ttgaatctgttgaagcctg

SEQ ID NO: 220342 - DNA, 23 bp, Mus musculus
ctgtgtctctgtttagtttctgt

SEQ ID NO: 220343 - DNA, 23 bp, Mus musculus
ttacatatatttacatatgtata

SEQ ID NO: 220344 - DNA, 22 bp, Mus musculus
tctgcctgtctctgtctctcca

SEQ ID NO: 220345 - DNA, 22 bp, Mus musculus
atctggatgttgaagaattgtg

SEQ ID NO: 220346 - DNA, 21 bp, Mus musculus
atatgtgtatgtgttcatgtg

SEQ ID NO: 220347 - DNA, 23 bp, Mus musculus
tcttcatgggagaggctgagatg

SEQ ID NO: 220348 - DNA, 23 bp, Mus musculus
agagagagtcactcagagagcca

SEQ ID NO: 220349 - DNA, 23 bp, Mus musculus
ctatattgatggagaaggaaagt

SEQ ID NO: 220350 - DNA, 20 bp, Mus musculus
tgtgtgtgtgtgtgtgtgtg

SEQ ID NO: 220351 - DNA, 23 bp, Mus musculus
atgtatgtatatgtatgcatgtg

SEQ ID NO: 220352 - DNA, 23 bp, Mus musculus
tgtgtgtacatgtatgtgtgtgt

SEQ ID NO: 220353 - DNA, 23 bp, Mus musculus
aaaagcactgactgctcttccag

SEQ ID NO: 220354 - DNA, 22 bp, Mus musculus
tgttttgtgaccaattatatgg

SEQ ID NO: 220355 - DNA, 23 bp, Mus musculus
tgaatgtatgtatgtatgtatgt

SEQ ID NO: 220356 - DNA, 23 bp, Mus musculus
tctctctccgtcacacaagggct

SEQ ID NO: 220357 - DNA, 23 bp, Mus musculus
acaaattcactctctgggactct

SEQ ID NO: 220358 - DNA, 19 bp, Mus musculus
ccctgagtgcatatgtgct

SEQ ID NO: 220359 - DNA, 22 bp, Mus musculus
atacacacacacgtatgtatgt

SEQ ID NO: 220360 - DNA, 22 bp, Mus musculus
tgttttgtgaccaattatatgg

SEQ ID NO: 220361 - DNA, 23 bp, Mus musculus
tggtgtctcaagattcagagaac

SEQ ID NO: 220362 - DNA, 23 bp, Mus musculus
tgttccaattgtattgagtctgt

SEQ ID NO: 220363 - DNA, 23 bp, Mus musculus
tgtatacacacacacacacaggt

SEQ ID NO: 220364 - DNA, 22 bp, Mus musculus
aatgtgcaaagcctttgaccta

SEQ ID NO: 220365 - DNA, 18 bp, Mus musculus
cacatgagaaagactcac

SEQ ID NO: 220366 - DNA, 23 bp, Mus musculus
aaactgagagcaaaagtagtcaa

SEQ ID NO: 220367 - DNA, 23 bp, Mus musculus
gttctcggctgtgcctctctctc

SEQ ID NO: 220368 - DNA, 19 bp, Mus musculus
gtatgcacatgtgctggcc

SEQ ID NO: 220369 - DNA, 22 bp, Mus musculus
agttcagaagacactgagctct

SEQ ID NO: 220370 - DNA, 23 bp, Mus musculus
tgtgtgtgcagtctgtggacagt

SEQ ID NO: 220371 - DNA, 23 bp, Mus musculus
tgcatgtatgtatgtatgtatgt

SEQ ID NO: 220372 - DNA, 23 bp, Mus musculus
tgtcagtctggctgtctgtctgg

SEQ ID NO: 220373 - DNA, 23 bp, Mus musculus
tctagtgtacttccttactgact

SEQ ID NO: 220374 - DNA, 23 bp, Mus musculus
tgactgagaagtgacagtgttct

SEQ ID NO: 220375 - DNA, 23 bp, Mus musculus
tcacactctgggactctatgtgg

SEQ ID NO: 220376 - DNA, 20 bp, Mus musculus
atagccaccagttcttatgt

SEQ ID NO: 220377 - DNA, 20 bp, Mus musculus
agcaccaaatgaacacagaa

SEQ ID NO: 220378 - DNA, 22 bp, Mus musculus
tgtgtatatatatatgtgtgtg

SEQ ID NO: 220379 - DNA, 22 bp, Mus musculus
atatacacacagttataaatct

SEQ ID NO: 220380 - DNA, 22 bp, Mus musculus
ggtatgtgagctgataactctg

SEQ ID NO: 220381 - DNA, 23 bp, Mus musculus
tttccattagtatccattagtat

SEQ ID NO: 220382 - DNA, 18 bp, Mus musculus
cacaggctttcttgagtg

SEQ ID NO: 220383 - DNA, 18 bp, Mus musculus
tttctacttcaattgatc

SEQ ID NO: 220384 - DNA, 23 bp, Mus musculus
tgtctgtctgtctgcctgtctgt

SEQ ID NO: 220385 - DNA, 20 bp, Mus musculus
tatacaatcaggaagacata

SEQ ID NO: 220386 - DNA, 23 bp, Mus musculus
agattttcagatggtattcaggt

SEQ ID NO: 220387 - DNA, 18 bp, Mus musculus
tgtgtgtgtgtgtgcatg

SEQ ID NO: 220388 - DNA, 23 bp, Mus musculus
atgtatgtatgcatgtgtgtgca

SEQ ID NO: 220389 - DNA, 23 bp, Mus musculus
gtgtacagtatgtgtatatgttc

SEQ ID NO: 220390 - DNA, 23 bp, Mus musculus
tacatatgtatgtaagtatgtat

SEQ ID NO: 220391 - DNA, 18 bp, Mus musculus
tttaattcttttgaaagg

SEQ ID NO: 220392 - DNA, 21 bp, Mus musculus
tgtgtgcatgcatgtatatat

SEQ ID NO: 220393 - DNA, 23 bp, Mus musculus
agcttgtatgtatgtatgtatgt

SEQ ID NO: 220394 - DNA, 18 bp, Mus musculus
atacatgtatttatgtgt

SEQ ID NO: 220395 - DNA, 22 bp, Mus musculus
tgttttgtgaccaattatatgg

SEQ ID NO: 220396 - DNA, 22 bp, Mus musculus
catagaatgagttggttagagt

SEQ ID NO: 220397 - DNA, 18 bp, Mus musculus
attcagatggaagttttc

SEQ ID NO: 220398 - DNA, 23 bp, Mus musculus
aggctgagaagtacagctgtttc

SEQ ID NO: 220399 - DNA, 23 bp, Mus musculus
actcgctctcactctcgctctca

SEQ ID NO: 220400 - DNA, 23 bp, Mus musculus
tatgtatgtgtatatgtatatgt

SEQ ID NO: 220401 - DNA, 23 bp, Mus musculus
catatatgtgtgtatatgtatgt

SEQ ID NO: 220402 - DNA, 23 bp, Mus musculus
gacagacagacaaccgttagtgt

SEQ ID NO: 220403 - DNA, 23 bp, Mus musculus
gagcctcgctctctgggtcattc

SEQ ID NO: 220404 - DNA, 23 bp, Mus musculus
gcctgcctgcctgcctgcctgcc

SEQ ID NO: 220405 - DNA, 23 bp, Mus musculus
tctgcctgcgtctgtgtctgtgt

SEQ ID NO: 220406 - DNA, 20 bp, Mus musculus
tgtatgtatgtatgtatgta

SEQ ID NO: 220407 - DNA, 23 bp, Mus musculus
tgcctgcctgcctgcctgcctgc

SEQ ID NO: 220408 - DNA, 23 bp, Mus musculus
tcagctacatggtgagtttgatg

SEQ ID NO: 220409 - DNA, 23 bp, Mus musculus
gaacaacaaaagcagcacgctga

SEQ ID NO: 220410 - DNA, 21 bp, Mus musculus
atgtctgtgtatgtgtgtgtg

SEQ ID NO: 220411 - DNA, 23 bp, Mus musculus
aatgtttttgagataggatctct

SEQ ID NO: 220412 - DNA, 22 bp, Mus musculus
ctcagcctctctcactgggaca

SEQ ID NO: 220413 - DNA, 23 bp, Mus musculus
cacactccctgccacattttcta

SEQ ID NO: 220414 - DNA, 23 bp, Mus musculus
ctatcagaggagaaagtgagctc

SEQ ID NO: 220415 - DNA, 23 bp, Mus musculus
cctctgttcttccctgtctgcct

SEQ ID NO: 220416 - DNA, 23 bp, Mus musculus
tgagagagcacactgagctaagg

SEQ ID NO: 220417 - DNA, 23 bp, Mus musculus
cagttctgaaagtttctagtttt

SEQ ID NO: 220418 - DNA, 23 bp, Mus musculus
tggtagaggtccaggtgaagcag

SEQ ID NO: 220419 - DNA, 23 bp, Mus musculus
tctgcacagaaggctgagagaag

SEQ ID NO: 220420 - DNA, 23 bp, Mus musculus
tatctgtgtggctgagatgcacg

SEQ ID NO: 220421 - DNA, 18 bp, Mus musculus
ttgtcagtaacggtttct

SEQ ID NO: 220422 - DNA, 23 bp, Mus musculus
tgtgcacacagaccagagtctgg

SEQ ID NO: 220423 - DNA, 23 bp, Mus musculus
gctctgacaggctgagtccctgc

SEQ ID NO: 220424 - DNA, 20 bp, Mus musculus
atgcagaaggactggagaga

SEQ ID NO: 220425 - DNA, 19 bp, Mus musculus
tgaggcagcctgactaggc

SEQ ID NO: 220426 - DNA, 21 bp, Mus musculus
gtgtgcctgtctctgcctccc

SEQ ID NO: 220427 - DNA, 23 bp, Mus musculus
gtttgtgcatgtgcatgtgtctg

SEQ ID NO: 220428 - DNA, 23 bp, Mus musculus
tatagactgtccatgtatacagt

SEQ ID NO: 220429 - DNA, 23 bp, Mus musculus
gggtctcactctgtggctcaggt

SEQ ID NO: 220430 - DNA, 19 bp, Mus musculus
tgtatgtatgtatgtatgt

SEQ ID NO: 220431 - DNA, 18 bp, Mus musculus
ctatgtatctatgtatgt

SEQ ID NO: 220432 - DNA, 23 bp, Mus musculus
tgtgtgtggatgtggatgtgcga

SEQ ID NO: 220433 - DNA, 22 bp, Mus musculus
ctgtgtgcctcactgagtgtag

SEQ ID NO: 220434 - DNA, 22 bp, Mus musculus
tgtcacactgggtatgtgagtc

SEQ ID NO: 220435 - DNA, 23 bp, Mus musculus
tctctctttctctcccctaagga

SEQ ID NO: 220436 - DNA, 19 bp, Mus musculus
ctgaagttttccctgacta

SEQ ID NO: 220437 - DNA, 23 bp, Mus musculus
taaagtcagggtcttctatgtcg

SEQ ID NO: 220438 - DNA, 23 bp, Mus musculus
tgtatgtatgtatgtatgtatgt

SEQ ID NO: 220439 - DNA, 20 bp, Mus musculus
tatgtcacagactcttactc

SEQ ID NO: 220440 - DNA, 21 bp, Mus musculus
cggatgaacctgtcagtctta

SEQ ID NO: 220441 - DNA, 19 bp, Mus musculus
tggtttgctcttcattctg

SEQ ID NO: 220442 - DNA, 18 bp, Mus musculus
tacacatagagaaagtat

SEQ ID NO: 220443 - DNA, 23 bp, Mus musculus
cctctgtgtgagtacagtgtatg

SEQ ID NO: 220444 - DNA, 23 bp, Mus musculus
agagcaggtagtatacagaatgg

SEQ ID NO: 220445 - DNA, 23 bp, Mus musculus
gcctgaagacactgagctctgca

SEQ ID NO: 220446 - DNA, 18 bp, Mus musculus
atgtgcagtcagaggagg

SEQ ID NO: 220447 - DNA, 23 bp, Mus musculus
gcctctgtgtctctgaggccctg

SEQ ID NO: 220448 - DNA, 20 bp, Mus musculus
gacagccagaggggctgcag

SEQ ID NO: 220449 - DNA, 22 bp, Mus musculus
gctctggtagatgcttgttcag

SEQ ID NO: 220450 - DNA, 23 bp, Mus musculus
agtgctgactgctcttccagagg

SEQ ID NO: 220451 - DNA, 23 bp, Mus musculus
tgactctcagactcacatcttcc

SEQ ID NO: 220452 - DNA, 21 bp, Mus musculus
tgagtactgccaagagacaga

SEQ ID NO: 220453 - DNA, 23 bp, Mus musculus
atgtgtgtgtgtccatgtgcatg

SEQ ID NO: 220454 - DNA, 23 bp, Mus musculus
agagtgacagttgtgagtcacca

SEQ ID NO: 220455 - DNA, 22 bp, Mus musculus
acacagaaaaatgtcagcagag

SEQ ID NO: 220456 - DNA, 23 bp, Mus musculus
aaaatctcaggttttgtttgttt

SEQ ID NO: 220457 - DNA, 23 bp, Mus musculus
tgcatcatgtatgcatgtatgtc

SEQ ID NO: 220458 - DNA, 22 bp, Mus musculus
tatgtgtgtacatatatgtatg

SEQ ID NO: 220459 - DNA, 22 bp, Mus musculus
aaagagagagagctcagaggtc

SEQ ID NO: 220460 - DNA, 23 bp, Mus musculus
taaaatctgtgacatctatgcag

SEQ ID NO: 220461 - DNA, 23 bp, Mus musculus
tgcacttgaatgatttaaatagt

SEQ ID NO: 220462 - DNA, 23 bp, Mus musculus
tgatgtctatttcttcatctgtg

SEQ ID NO: 220463 - DNA, 23 bp, Mus musculus
caagcacttgatggtaggacatc

SEQ ID NO: 220464 - DNA, 22 bp, Mus musculus
gtgagtggctccctggatggct

SEQ ID NO: 220465 - DNA, 22 bp, Mus musculus
ctctatgttattgtattgtgtt

SEQ ID NO: 220466 - DNA, 23 bp, Mus musculus
tgtgtgactgcatgtacatgtgc

SEQ ID NO: 220467 - DNA, 22 bp, Mus musculus
tatgtgtatatatgtatatgtg

SEQ ID NO: 220468 - DNA, 23 bp, Mus musculus
tatatgcatatatacatatatgt

SEQ ID NO: 220469 - DNA, 21 bp, Mus musculus
tatgactcagtctatcatctg

SEQ ID NO: 220470 - DNA, 21 bp, Mus musculus
ctgagagtctctgtcagagtc

SEQ ID NO: 220471 - DNA, 23 bp, Mus musculus
tcactgcttcttcataactgtca

SEQ ID NO: 220472 - DNA, 23 bp, Mus musculus
tgctactgttatgaaatgtaatg

SEQ ID NO: 220473 - DNA, 23 bp, Mus musculus
gtacactgtggcattacagtatg

SEQ ID NO: 220474 - DNA, 23 bp, Mus musculus
tctctctccctcagttacctctg

SEQ ID NO: 220475 - DNA, 23 bp, Mus musculus
aaagctgtgtgtctaactcactc

SEQ ID NO: 220476 - DNA, 23 bp, Mus musculus
gactctgtaactcactggtaccc

SEQ ID NO: 220477 - DNA, 23 bp, Mus musculus
gagttactctctctctccctgtt

SEQ ID NO: 220478 - DNA, 23 bp, Mus musculus
tatgtatatgtatatgtatatgt

SEQ ID NO: 220479 - DNA, 23 bp, Mus musculus
tgtatctgcatgtacatgtatac

SEQ ID NO: 220480 - DNA, 23 bp, Mus musculus
tttagtgtgcaaattatctgttt

SEQ ID NO: 220481 - DNA, 22 bp, Mus musculus
tttttatatgtaaaggcacact

SEQ ID NO: 220482 - DNA, 23 bp, Mus musculus
gcgagacagagtgagacagtgac

SEQ ID NO: 220483 - DNA, 22 bp, Mus musculus
agacagagaacagagagcgatc

SEQ ID NO: 220484 - DNA, 23 bp, Mus musculus
ttttttggactaggtcactcata

SEQ ID NO: 220485 - DNA, 21 bp, Mus musculus
agcatcataagaagccacaga

SEQ ID NO: 220486 - DNA, 18 bp, Mus musculus
taggatgtgtgcatgtgc

SEQ ID NO: 220487 - DNA, 22 bp, Mus musculus
gtatgaatgcatgtatgtatgt

SEQ ID NO: 220488 - DNA, 23 bp, Mus musculus
agttcacagatagtattggtttg

SEQ ID NO: 220489 - DNA, 21 bp, Mus musculus
tatgataagtggaagacattt

SEQ ID NO: 220490 - DNA, 22 bp, Mus musculus
ctcactgtcactgtctatttgg

SEQ ID NO: 220491 - DNA, 23 bp, Mus musculus
ttatgtatgtatgtatatgtata

SEQ ID NO: 220492 - DNA, 21 bp, Mus musculus
tacacaggtgagagtgtggac

SEQ ID NO: 220493 - DNA, 22 bp, Mus musculus
tgttttgtgaccaattatatgg

SEQ ID NO: 220494 - DNA, 20 bp, Mus musculus
tggtattagcatcagattgt

SEQ ID NO: 220495 - DNA, 21 bp, Mus musculus
gactctctctctctctctata

SEQ ID NO: 220496 - DNA, 23 bp, Mus musculus
ttaatctatgtatttttattggg

SEQ ID NO: 220497 - DNA, 23 bp, Mus musculus
tgagtccatagatgttaagagat

SEQ ID NO: 220498 - DNA, 23 bp, Mus musculus
ttgtctagtgatcttgatgttct

SEQ ID NO: 220499 - DNA, 22 bp, Mus musculus
ttaggtccccttcctccacctg

SEQ ID NO: 220500 - DNA, 22 bp, Mus musculus
tgttttgtgaccaattatatgg

SEQ ID NO: 220501 - DNA, 23 bp, Mus musculus
ttctttgtgttgaagttttcctt

SEQ ID NO: 220502 - DNA, 21 bp, Mus musculus
actgtgtcagtgacagaagac

SEQ ID NO: 220503 - DNA, 22 bp, Mus musculus
tccctgtttcactgtctccctg

SEQ ID NO: 220504 - DNA, 22 bp, Mus musculus
tgaataagcatgtgcatgtgca

SEQ ID NO: 220505 - DNA, 23 bp, Mus musculus
gtatgtatatatttgtatctcta

SEQ ID NO: 220506 - DNA, 22 bp, Mus musculus
tttcagagtggttgtactatct

SEQ ID NO: 220507 - DNA, 19 bp, Mus musculus
aagagattcagcaatgaat

SEQ ID NO: 220508 - DNA, 23 bp, Mus musculus
tatagacatttagttgtttactt

SEQ ID NO: 220509 - DNA, 21 bp, Mus musculus
tatatgcatatgaagctgatt

SEQ ID NO: 220510 - DNA, 20 bp, Mus musculus
tgtatgtatgtatgtatgta

SEQ ID NO: 220511 - DNA, 21 bp, Mus musculus
tagtatgtactagtttctgct

SEQ ID NO: 220512 - DNA, 22 bp, Mus musculus
tgttttgtgaccaattatatgg

SEQ ID NO: 220513 - DNA, 23 bp, Mus musculus
gagagatagacttttctttctcc

SEQ ID NO: 220514 - DNA, 22 bp, Mus musculus
gaacatgtacagtatatgtata

SEQ ID NO: 220515 - DNA, 23 bp, Mus musculus
tgtgtgtgtgtatgtgcgtgtgt

SEQ ID NO: 220516 - DNA, 20 bp, Mus musculus
tgtatatatgtatgttaaca

SEQ ID NO: 220517 - DNA, 21 bp, Mus musculus
ggtcagataggttgaatggac

SEQ ID NO: 220518 - DNA, 22 bp, Mus musculus
tgttttgtgaccaattatatgg

SEQ ID NO: 220519 - DNA, 19 bp, Mus musculus
gtcagataggcatacatct

SEQ ID NO: 220520 - DNA, 21 bp, Mus musculus
agttgtgtccatataatgtga

SEQ ID NO: 220521 - DNA, 21 bp, Mus musculus
ttgagcattttctatttatgt

SEQ ID NO: 220522 - DNA, 18 bp, Mus musculus
atggtgatctaataggat

SEQ ID NO: 220523 - DNA, 21 bp, Mus musculus
ttttgtgacccattatgtggt

SEQ ID NO: 220524 - DNA, 23 bp, Mus musculus
tatctcagtatttctctcaagaa

SEQ ID NO: 220525 - DNA, 22 bp, Mus musculus
tactctgccacagtccatgcca

SEQ ID NO: 220526 - DNA, 23 bp, Mus musculus
atgacactctacaaataggtttg

SEQ ID NO: 220527 - DNA, 23 bp, Mus musculus
tgtcagactctgtttttctagtc

SEQ ID NO: 220528 - DNA, 23 bp, Mus musculus
tagttacctatacaaaacagtat

SEQ ID NO: 220529 - DNA, 22 bp, Mus musculus
tataaggtaatttaatgtgata

SEQ ID NO: 220530 - DNA, 23 bp, Mus musculus
tctgctaagtatttgttgagctt

SEQ ID NO: 220531 - DNA, 23 bp, Mus musculus
caatatttttgtatctgttgagg

SEQ ID NO: 220532 - DNA, 23 bp, Mus musculus
tgactgtgtgtgtgtgtgtgtga

SEQ ID NO: 220533 - DNA, 23 bp, Mus musculus
acctagatggttctattgttctg

SEQ ID NO: 220534 - DNA, 23 bp, Mus musculus
tccctctgagtctgtctgtcacc

SEQ ID NO: 220535 - DNA, 23 bp, Mus musculus
tctctgtcttattctctgtctct

SEQ ID NO: 220536 - DNA, 23 bp, Mus musculus
gctcagactgtttaggctttctg

SEQ ID NO: 220537 - DNA, 23 bp, Mus musculus
tgtatttggaaatctaggtgaac

SEQ ID NO: 220538 - DNA, 20 bp, Mus musculus
ctttgctctggtaggctgtt

SEQ ID NO: 220539 - DNA, 23 bp, Mus musculus
actccctcagtgtttatcttatg

SEQ ID NO: 220540 - DNA, 21 bp, Mus musculus
agacagcagagtgtgaactca

SEQ ID NO: 220541 - DNA, 23 bp, Mus musculus
cagtctctgagtgtatgtctctg

SEQ ID NO: 220542 - DNA, 21 bp, Mus musculus
cttgccagaagtagagtttgc

SEQ ID NO: 220543 - DNA, 18 bp, Mus musculus
gcatgtgagatgtggtgg

SEQ ID NO: 220544 - DNA, 21 bp, Mus musculus
aactttggaagtaagtaactc

SEQ ID NO: 220545 - DNA, 21 bp, Mus musculus
tccatggtggtctgataggat

SEQ ID NO: 220546 - DNA, 22 bp, Mus musculus
tgttttgtgaccaattatatgg

SEQ ID NO: 220547 - DNA, 18 bp, Mus musculus
agcacactcactctgtcc

SEQ ID NO: 220548 - DNA, 22 bp, Mus musculus
tctcagctagaagatagatgtc

SEQ ID NO: 220549 - DNA, 18 bp, Mus musculus
ttgtatgtcaattcagtt

SEQ ID NO: 220550 - DNA, 23 bp, Mus musculus
tatgggaagagaaagaggttgga

SEQ ID NO: 220551 - DNA, 23 bp, Mus musculus
taaatatttaactgcagtgaagg

SEQ ID NO: 220552 - DNA, 18 bp, Mus musculus
tctcagtaatattatttc

SEQ ID NO: 220553 - DNA, 22 bp, Mus musculus
tgttttgtgaccaattatatgg

SEQ ID NO: 220554 - DNA, 23 bp, Mus musculus
tatgtgcatatatatatgtgtgt

SEQ ID NO: 220555 - DNA, 19 bp, Mus musculus
ccaagtagagactggcaaa

SEQ ID NO: 220556 - DNA, 23 bp, Mus musculus
agtaaacttgctagtttgtaact

SEQ ID NO: 220557 - DNA, 21 bp, Mus musculus
tgcacagagaattgtggattg

SEQ ID NO: 220558 - DNA, 23 bp, Mus musculus
cctctctgactctcacaatctgc

SEQ ID NO: 220559 - DNA, 19 bp, Mus musculus
tgcattgaactggcttagc

SEQ ID NO: 220560 - DNA, 23 bp, Mus musculus
atcagacctgctggagctcagtg

SEQ ID NO: 220561 - DNA, 23 bp, Mus musculus
gtcacctacttaacttttgtagt

SEQ ID NO: 220562 - DNA, 21 bp, Mus musculus
tgtctctatctgttccagtca

SEQ ID NO: 220563 - DNA, 23 bp, Mus musculus
acatacaatgtatatgtatatat

SEQ ID NO: 220564 - DNA, 23 bp, Mus musculus
tgtgtgtgtctgtgtgtctgcct

SEQ ID NO: 220565 - DNA, 23 bp, Mus musculus
caaatactgtgttgtaatgatct

SEQ ID NO: 220566 - DNA, 23 bp, Mus musculus
aatgtctgggaattgctaccttt

SEQ ID NO: 220567 - DNA, 23 bp, Mus musculus
tttgcctgcctgcctgcctgcct

SEQ ID NO: 220568 - DNA, 20 bp, Mus musculus
aaggcactgtctgaggtcac

SEQ ID NO: 220569 - DNA, 21 bp, Mus musculus
gcatatgtatgtatatgtcta

SEQ ID NO: 220570 - DNA, 22 bp, Mus musculus
atgtgtatatatatatgtgtgt

SEQ ID NO: 220571 - DNA, 23 bp, Mus musculus
acaagtgagtgtttgatgtatgt

SEQ ID NO: 220572 - DNA, 23 bp, Mus musculus
gtgtgtgcgtgtgtctgtggcag

SEQ ID NO: 220573 - DNA, 22 bp, Mus musculus
gtgtatatgtatgtgtgtgaga

SEQ ID NO: 220574 - DNA, 23 bp, Mus musculus
ttatatgtacatatgtatgtatg

SEQ ID NO: 220575 - DNA, 22 bp, Mus musculus
tttgccaatggttgatctgaga

SEQ ID NO: 220576 - DNA, 23 bp, Mus musculus
gtcaggctccctgcctgcctgca

SEQ ID NO: 220577 - DNA, 19 bp, Mus musculus
tccagcattaattcagaaa

SEQ ID NO: 220578 - DNA, 23 bp, Mus musculus
tttcttttattggaaaagagtgg

SEQ ID NO: 220579 - DNA, 23 bp, Mus musculus
tgtccctgtcttcagatggagcc

SEQ ID NO: 220580 - DNA, 19 bp, Mus musculus
tgaaagaactcagtgggga

SEQ ID NO: 220581 - DNA, 23 bp, Mus musculus
tgaacagagtggtagtcttacca

SEQ ID NO: 220582 - DNA, 22 bp, Mus musculus
agacgagctcgtttctggtggt

SEQ ID NO: 220583 - DNA, 19 bp, Mus musculus
tgagacagacagggtctct

SEQ ID NO: 220584 - DNA, 23 bp, Mus musculus
tcactctctggctgcctgacctc

SEQ ID NO: 220585 - DNA, 22 bp, Mus musculus
acacttaggattctgtgttcat

SEQ ID NO: 220586 - DNA, 23 bp, Mus musculus
tggagacagtctttctcactggc

SEQ ID NO: 220587 - DNA, 18 bp, Mus musculus
aaggggacttgaagattt

SEQ ID NO: 220588 - DNA, 23 bp, Mus musculus
tgtggtatgatgtgtgtgagaat

SEQ ID NO: 220589 - DNA, 18 bp, Mus musculus
ctgaggttacattgagtg

SEQ ID NO: 220590 - DNA, 22 bp, Mus musculus
accctcagctctgctgcagcag

SEQ ID NO: 220591 - DNA, 23 bp, Mus musculus
tatatagatggatatatatagat

SEQ ID NO: 220592 - DNA, 22 bp, Mus musculus
tgtatatatatgtatatgtata

SEQ ID NO: 220593 - DNA, 22 bp, Mus musculus
tgtgtctgtggaatatatgtgt

SEQ ID NO: 220594 - DNA, 23 bp, Mus musculus
tctgtgtgtgtctgtgtgtatat

SEQ ID NO: 220595 - DNA, 19 bp, Mus musculus
tgtatacatgtttgtattg

SEQ ID NO: 220596 - DNA, 23 bp, Mus musculus
ctgtctgtctgtatttctctctg

SEQ ID NO: 220597 - DNA, 23 bp, Mus musculus
catgtacgcagtcacactgtgtg

SEQ ID NO: 220598 - DNA, 23 bp, Mus musculus
tggaatgttaagatgttagtatg

SEQ ID NO: 220599 - DNA, 22 bp, Mus musculus
catctaactgaaccaactctgc

SEQ ID NO: 220600 - DNA, 23 bp, Mus musculus
tctgtgtgtctgtctgtcaccca

SEQ ID NO: 220601 - DNA, 23 bp, Mus musculus
gtctgtctgtctgtctgtctgtg

SEQ ID NO: 220602 - DNA, 23 bp, Mus musculus
ttaagagcacagactgctcttcc

SEQ ID NO: 220603 - DNA, 23 bp, Mus musculus
gctctccctctgagcctgtctgg

SEQ ID NO: 220604 - DNA, 23 bp, Mus musculus
tataggcttttgtagtaggatct

SEQ ID NO: 220605 - DNA, 23 bp, Mus musculus
tttctgcagattctgttatgtct

SEQ ID NO: 220606 - DNA, 21 bp, Mus musculus
agtgagaactcagtaagcact

SEQ ID NO: 220607 - DNA, 23 bp, Mus musculus
cattactgtcactcagtaagcac

SEQ ID NO: 220608 - DNA, 23 bp, Mus musculus
tgtgtgtgtgtgcatgtgcactc

SEQ ID NO: 220609 - DNA, 22 bp, Mus musculus
tatgagtgtgcgtgtgtgcatg

SEQ ID NO: 220610 - DNA, 20 bp, Mus musculus
tctgtctctgtttctgagca

SEQ ID NO: 220611 - DNA, 18 bp, Mus musculus
actgagtcaaatgtcatt

SEQ ID NO: 220612 - DNA, 22 bp, Mus musculus
aatgagacaaaacttaaggctg

SEQ ID NO: 220613 - DNA, 22 bp, Mus musculus
aaattgcatctgtattcagtga

SEQ ID NO: 220614 - DNA, 18 bp, Mus musculus
aggctagagagagagctc

SEQ ID NO: 220615 - DNA, 18 bp, Mus musculus
tctcaccagccttcattc

SEQ ID NO: 220616 - DNA, 23 bp, Mus musculus
ctatgtccttgcattcctagtgt

SEQ ID NO: 220617 - DNA, 22 bp, Mus musculus
ttacatagttttacataagggg

SEQ ID NO: 220618 - DNA, 21 bp, Mus musculus
aatggggttactcttagagat

SEQ ID NO: 220619 - DNA, 21 bp, Mus musculus
aagtgcttttaaatcaaagtc

SEQ ID NO: 220620 - DNA, 21 bp, Mus musculus
tgtgtatgtataggtatgtga

SEQ ID NO: 220621 - DNA, 20 bp, Mus musculus
gtatgtgtgtgagcatgagt

SEQ ID NO: 220622 - DNA, 23 bp, Mus musculus
agtgggtatgtataggtatgtga

SEQ ID NO: 220623 - DNA, 23 bp, Mus musculus
tgtcagttgtgagagtgcacttg

SEQ ID NO: 220624 - DNA, 20 bp, Mus musculus
agtcagttgtgagagtgcac

SEQ ID NO: 220625 - DNA, 18 bp, Mus musculus
tcagttctgagagtgcac

SEQ ID NO: 220626 - DNA, 21 bp, Mus musculus
tgactggttgtagacagctca

SEQ ID NO: 220627 - DNA, 19 bp, Mus musculus
gtctctatctctgtttccc

SEQ ID NO: 220628 - DNA, 23 bp, Mus musculus
tctcaagcacctacactctgtgt

SEQ ID NO: 220629 - DNA, 23 bp, Mus musculus
atgtatgtgtatatgcatgtgtt

SEQ ID NO: 220630 - DNA, 23 bp, Mus musculus
aagatcacagactgctcttccag

SEQ ID NO: 220631 - DNA, 23 bp, Mus musculus
actcagactgtcagtgatgaggc

SEQ ID NO: 220632 - DNA, 23 bp, Mus musculus
tgtctgtctgtctgggtgtgggt

SEQ ID NO: 220633 - DNA, 23 bp, Mus musculus
tgcatctgtctgtctgtctctct

SEQ ID NO: 220634 - DNA, 22 bp, Mus musculus
tgttttaccggtgcatatgtac

SEQ ID NO: 220635 - DNA, 23 bp, Mus musculus
tgtatgtatgtatgtatgtattt

SEQ ID NO: 220636 - DNA, 18 bp, Mus musculus
agctttcggtatctgtgt

SEQ ID NO: 220637 - DNA, 23 bp, Mus musculus
ctctctctgtctgcgaaggaagt

SEQ ID NO: 220638 - DNA, 22 bp, Mus musculus
tgacagctgtctgtgagcacag

SEQ ID NO: 220639 - DNA, 23 bp, Mus musculus
tcatctgtcagcttgtaggtgtg

SEQ ID NO: 220640 - DNA, 23 bp, Mus musculus
ctgtgtgtatgtgttgcctgtat

SEQ ID NO: 220641 - DNA, 19 bp, Mus musculus
tattcatgcaacacacata

SEQ ID NO: 220642 - DNA, 21 bp, Mus musculus
tgtgtcagtgcatctgtgtgg

SEQ ID NO: 220643 - DNA, 23 bp, Mus musculus
tgtctgtctgtctgtctcagagg

SEQ ID NO: 220644 - DNA, 23 bp, Mus musculus
atgtatgtatttatgtatgtgtg

SEQ ID NO: 220645 - DNA, 22 bp, Mus musculus
ggtatatatgcatgagtgtgtg

SEQ ID NO: 220646 - DNA, 19 bp, Mus musculus
gatgagcaggctctggacc

SEQ ID NO: 220647 - DNA, 22 bp, Mus musculus
actctgtgtcactttgtcttta

SEQ ID NO: 220648 - DNA, 23 bp, Mus musculus
agctttggaaagaagactgaaga

SEQ ID NO: 220649 - DNA, 21 bp, Mus musculus
tggcatgtagtacctgtggtc

SEQ ID NO: 220650 - DNA, 19 bp, Mus musculus
acattgctagaactctctg

SEQ ID NO: 220651 - DNA, 22 bp, Mus musculus
tgttttgtgaccaattatatgg

SEQ ID NO: 220652 - DNA, 23 bp, Mus musculus
tctctgtctctgtttgagtttct

SEQ ID NO: 220653 - DNA, 22 bp, Mus musculus
agagtgatgtaggtgcagtttt

SEQ ID NO: 220654 - DNA, 23 bp, Mus musculus
aaatgaggagtatggaattctgt

SEQ ID NO: 220655 - DNA, 22 bp, Mus musculus
tgttttgtgaccaattatatgg

SEQ ID NO: 220656 - DNA, 23 bp, Mus musculus
tgtatgtatgtgtgcatatgtgt

SEQ ID NO: 220657 - DNA, 20 bp, Mus musculus
tatttggttgttctcattgg

SEQ ID NO: 220658 - DNA, 23 bp, Mus musculus
tgtctgtccgtctgtctgtctgt

SEQ ID NO: 220659 - DNA, 22 bp, Mus musculus
tgcatgcatatgtatatgtata

SEQ ID NO: 220660 - DNA, 20 bp, Mus musculus
atatgcatatatatacatat

SEQ ID NO: 220661 - DNA, 21 bp, Mus musculus
tatgtatgtgtatgtgtatgc

SEQ ID NO: 220662 - DNA, 23 bp, Mus musculus
tgtaatgtatgtatatatgtgtg

SEQ ID NO: 220663 - DNA, 19 bp, Mus musculus
tcactggctggagagatgg

SEQ ID NO: 220664 - DNA, 23 bp, Mus musculus
tgtgcgtgcgtgcctgtgtgcct

SEQ ID NO: 220665 - DNA, 23 bp, Mus musculus
gatgtgtcgctccctgattggct

SEQ ID NO: 220666 - DNA, 21 bp, Mus musculus
tatgtgtatttgattatgtat

SEQ ID NO: 220667 - DNA, 23 bp, Mus musculus
tgtatatatgtgtgtgtgtgata

SEQ ID NO: 220668 - DNA, 18 bp, Mus musculus
tagagcttgtggagctgt

SEQ ID NO: 220669 - DNA, 21 bp, Mus musculus
agtggaaagttgtttgcttct

SEQ ID NO: 220670 - DNA, 20 bp, Mus musculus
tgagtagagacatcctatcc

SEQ ID NO: 220671 - DNA, 23 bp, Mus musculus
tctattcacccttcacagagcac

SEQ ID NO: 220672 - DNA, 23 bp, Mus musculus
agacaatccatgagaaaggatat

SEQ ID NO: 220673 - DNA, 22 bp, Mus musculus
caatggattacttaaagatgaa

SEQ ID NO: 220674 - DNA, 23 bp, Mus musculus
tctggcccagtgggtgcgtggct

SEQ ID NO: 220675 - DNA, 20 bp, Mus musculus
caagacttgttttcttgcag

SEQ ID NO: 220676 - DNA, 22 bp, Mus musculus
tttctgtgtctttaagcagtca

SEQ ID NO: 220677 - DNA, 21 bp, Mus musculus
ttaagagcactgactgctctt

SEQ ID NO: 220678 - DNA, 23 bp, Mus musculus
ggcactctctccctgtgtctgcc

SEQ ID NO: 220679 - DNA, 22 bp, Mus musculus
tctactgtctccaaatcctctc

SEQ ID NO: 220680 - DNA, 23 bp, Mus musculus
atatgtgtgtgcatgtgttcatg

SEQ ID NO: 220681 - DNA, 23 bp, Mus musculus
ggtagagagagttagttcactgt

SEQ ID NO: 220682 - DNA, 21 bp, Mus musculus
tcacacctcagagacactcac

SEQ ID NO: 220683 - DNA, 20 bp, Mus musculus
agtgcagtaagtggaatcag

SEQ ID NO: 220684 - DNA, 20 bp, Mus musculus
acactgtctgtgtctgactc

SEQ ID NO: 220685 - DNA, 23 bp, Mus musculus
ggctcagtggttaagagcactgg

SEQ ID NO: 220686 - DNA, 23 bp, Mus musculus
ttttagcttgtgtcaccctgtgc

SEQ ID NO: 220687 - DNA, 23 bp, Mus musculus
tgagcaagtcaaaactgcagggt

SEQ ID NO: 220688 - DNA, 18 bp, Mus musculus
aggcaggctctgttgctg

SEQ ID NO: 220689 - DNA, 21 bp, Mus musculus
tgctagatctggtggtgcagg

SEQ ID NO: 220690 - DNA, 20 bp, Mus musculus
tgagttcctccaagcctcag

SEQ ID NO: 220691 - DNA, 20 bp, Mus musculus
agagagagcagagttagggt

SEQ ID NO: 220692 - DNA, 23 bp, Mus musculus
tagtttgtttttttctaaatgtc

SEQ ID NO: 220693 - DNA, 22 bp, Mus musculus
tgttttgtgaccaattatatgg

SEQ ID NO: 220694 - DNA, 22 bp, Mus musculus
atagagctgtctcttgtgagac

SEQ ID NO: 220695 - DNA, 23 bp, Mus musculus
tctcacaagacagtcagctattg

SEQ ID NO: 220696 - DNA, 23 bp, Mus musculus
tttgctgatccctcagtctctgc

SEQ ID NO: 220697 - DNA, 18 bp, Mus musculus
gtatgtatgtatgtatgt

SEQ ID NO: 220698 - DNA, 22 bp, Mus musculus
tatgtatgtatgtatatgtgtg

SEQ ID NO: 220699 - DNA, 22 bp, Mus musculus
gtgatgtggtaggtatttttgt

SEQ ID NO: 220700 - DNA, 20 bp, Mus musculus
tatgtgtatgtattttcgtt

SEQ ID NO: 220701 - DNA, 23 bp, Mus musculus
ctgtgcctccttgcactgagtca

SEQ ID NO: 220702 - DNA, 23 bp, Mus musculus
agagaagacagtgaggagtgctt

SEQ ID NO: 220703 - DNA, 19 bp, Mus musculus
tatgtgtttataatgtgct

SEQ ID NO: 220704 - DNA, 19 bp, Mus musculus
atgtgtatgtatatgatat

SEQ ID NO: 220705 - DNA, 23 bp, Mus musculus
gtatataaatatgtgtatatgta

SEQ ID NO: 220706 - DNA, 22 bp, Mus musculus
tgttttgtgaccaattatatgg

SEQ ID NO: 220707 - DNA, 23 bp, Mus musculus
atgtctctctttctcaatctgca

SEQ ID NO: 220708 - DNA, 22 bp, Mus musculus
atgtatgtatgtatgtgtgtgc

SEQ ID NO: 220709 - DNA, 22 bp, Mus musculus
tgttttgtgaccaattatatgg

SEQ ID NO: 220710 - DNA, 20 bp, Mus musculus
tgtcactccatctcacactc

SEQ ID NO: 220711 - DNA, 20 bp, Mus musculus
tgtcaggtgagagtgtggac

SEQ ID NO: 220712 - DNA, 23 bp, Mus musculus
tgggatgttgtactcagttcttc

SEQ ID NO: 220713 - DNA, 22 bp, Mus musculus
ttatgaccaattatatggtcta

SEQ ID NO: 220714 - DNA, 21 bp, Mus musculus
tgtatatatgcatgtatgcat

SEQ ID NO: 220715 - DNA, 21 bp, Mus musculus
tatatgtgtgtatatgtatgt

SEQ ID NO: 220716 - DNA, 22 bp, Mus musculus
tgtctgacaggcagatatttca

SEQ ID NO: 220717 - DNA, 23 bp, Mus musculus
aagaacactgactgctcttccag

SEQ ID NO: 220718 - DNA, 23 bp, Mus musculus
ctgtgtctctgtttagtttctgt

SEQ ID NO: 220719 - DNA, 22 bp, Mus musculus
atctgtccattgatgagagtgg

SEQ ID NO: 220720 - DNA, 20 bp, Mus musculus
acaagatctctctgtgtagc

SEQ ID NO: 220721 - DNA, 23 bp, Mus musculus
tgtgtatgtatgtatatatatgt

SEQ ID NO: 220722 - DNA, 23 bp, Mus musculus
ttgacagagagcactgttgacag

SEQ ID NO: 220723 - DNA, 23 bp, Mus musculus
tctctgtgtctatgtatgtgtgt

SEQ ID NO: 220724 - DNA, 21 bp, Mus musculus
agcagtgtgtgtgtatgtgtg

SEQ ID NO: 220725 - DNA, 20 bp, Mus musculus
accttgtctgcatgtgtatg

SEQ ID NO: 220726 - DNA, 23 bp, Mus musculus
gtatgcatgtatgtatgtatgta

SEQ ID NO: 220727 - DNA, 22 bp, Mus musculus
tatgtatgtatgtatgtatgtg

SEQ ID NO: 220728 - DNA, 23 bp, Mus musculus
tagtccgtggtgatcagatagga

SEQ ID NO: 220729 - DNA, 23 bp, Mus musculus
tctgttgagacctgttttgtgac

SEQ ID NO: 220730 - DNA, 23 bp, Mus musculus
attgtgcttcacctgcaggatca

SEQ ID NO: 220731 - DNA, 23 bp, Mus musculus
gacagatgacagtgagcagtgtt

SEQ ID NO: 220732 - DNA, 21 bp, Mus musculus
tacacacacatatatgtgtgt

SEQ ID NO: 220733 - DNA, 20 bp, Mus musculus
tatgtgtgtgtatatatata

SEQ ID NO: 220734 - DNA, 18 bp, Mus musculus
agataattggatcacatt

SEQ ID NO: 220735 - DNA, 23 bp, Mus musculus
gaggaagagagatgatggtggat

SEQ ID NO: 220736 - DNA, 23 bp, Mus musculus
ttcagctgacctacctgcagtag

SEQ ID NO: 220737 - DNA, 22 bp, Mus musculus
tatgtatatatatatatgtgtg

SEQ ID NO: 220738 - DNA, 21 bp, Mus musculus
tttgtacatacatatgtgtgt

SEQ ID NO: 220739 - DNA, 20 bp, Mus musculus
tgtatatatgtgtgtatact

SEQ ID NO: 220740 - DNA, 23 bp, Mus musculus
aaagaacaggtagacgtgctatg

SEQ ID NO: 220741 - DNA, 19 bp, Mus musculus
ttttggagatgtgttcctt

SEQ ID NO: 220742 - DNA, 20 bp, Mus musculus
atatacatagtatatgtata

SEQ ID NO: 220743 - DNA, 20 bp, Mus musculus
gtgtgtgtctgagtcactgc

SEQ ID NO: 220744 - DNA, 20 bp, Mus musculus
cacacatgtgtgtgtgcaca

SEQ ID NO: 220745 - DNA, 23 bp, Mus musculus
aaccctttctgagaatactctca

SEQ ID NO: 220746 - DNA, 22 bp, Mus musculus
aaaggtagagattgggagtttt

SEQ ID NO: 220747 - DNA, 21 bp, Mus musculus
acaggagggacccagagggac

SEQ ID NO: 220748 - DNA, 21 bp, Mus musculus
tgtgtctctcttagtgaagtg

SEQ ID NO: 220749 - DNA, 22 bp, Mus musculus
agaagtcagcagatggatgatc

SEQ ID NO: 220750 - DNA, 23 bp, Mus musculus
tatgtgtatatatgtatatgtat

SEQ ID NO: 220751 - DNA, 18 bp, Mus musculus
gtacatatgtttgcgtat

SEQ ID NO: 220752 - DNA, 23 bp, Mus musculus
tgtgtgtctctgtgtgtccatgt

SEQ ID NO: 220753 - DNA, 23 bp, Mus musculus
ttcttgatttctctttttggata

SEQ ID NO: 220754 - DNA, 23 bp, Mus musculus
ctctccagaagaaactgagcaca

SEQ ID NO: 220755 - DNA, 23 bp, Mus musculus
acactcactgtgtcttataatcc

SEQ ID NO: 220756 - DNA, 23 bp, Mus musculus
tctgtgtgtgtgtgtgtgcgcgc

SEQ ID NO: 220757 - DNA, 23 bp, Mus musculus
tctgtgtgtctctgactatcctg

SEQ ID NO: 220758 - DNA, 20 bp, Mus musculus
caggctggcattgaactcac

SEQ ID NO: 220759 - DNA, 19 bp, Mus musculus
aggtgaattctgagccctt

SEQ ID NO: 220760 - DNA, 23 bp, Mus musculus
tcagatcacacagtccctgagac

SEQ ID NO: 220761 - DNA, 22 bp, Mus musculus
ttaggtttagttgctgtatgtg

SEQ ID NO: 220762 - DNA, 21 bp, Mus musculus
atgtgtgtgcatgtgcatttg

SEQ ID NO: 220763 - DNA, 19 bp, Mus musculus
acacatgtatatgcattca

SEQ ID NO: 220764 - DNA, 23 bp, Mus musculus
tctctgtgtgtctgtgtatttta

SEQ ID NO: 220765 - DNA, 22 bp, Mus musculus
tgttttgtgaccaattatatgg

SEQ ID NO: 220766 - DNA, 23 bp, Mus musculus
tctgcttctgtctgtctgagtct

SEQ ID NO: 220767 - DNA, 21 bp, Mus musculus
aagcatgtacatgagccacag

SEQ ID NO: 220768 - DNA, 23 bp, Mus musculus
caagaagcagatgaagatatagt

SEQ ID NO: 220769 - DNA, 23 bp, Mus musculus
tcagggtctctctgtgtgtctgc

SEQ ID NO: 220770 - DNA, 22 bp, Mus musculus
tgtgtttgtatgtatatatgta

SEQ ID NO: 220771 - DNA, 23 bp, Mus musculus
atgtgtgtatatgtatatgtgtg

SEQ ID NO: 220772 - DNA, 20 bp, Mus musculus
tggtatcaagaatggggttg

SEQ ID NO: 220773 - DNA, 23 bp, Mus musculus
tctgtctctgtctatgcttatga

SEQ ID NO: 220774 - DNA, 21 bp, Mus musculus
tatcaggtagatagatggatg

SEQ ID NO: 220775 - DNA, 23 bp, Mus musculus
tgtgtgtgcatgtacatgtgttc

SEQ ID NO: 220776 - DNA, 21 bp, Mus musculus
acgtgtgcgtgtgtgtgcgcg

SEQ ID NO: 220777 - DNA, 23 bp, Mus musculus
ccatgtactggggctggaaagat

SEQ ID NO: 220778 - DNA, 20 bp, Mus musculus
aatgcatgtatgtatgtatg

SEQ ID NO: 220779 - DNA, 23 bp, Mus musculus
tgtgtctctctgtgtgtacggac

SEQ ID NO: 220780 - DNA, 20 bp, Mus musculus
tgtgtcacaatgtgttatag

SEQ ID NO: 220781 - DNA, 23 bp, Mus musculus
cactggctctctctgtctatgcc

SEQ ID NO: 220782 - DNA, 23 bp, Mus musculus
atttaacaggttcttctttatgg

SEQ ID NO: 220783 - DNA, 23 bp, Mus musculus
ggtgacagactgtagggagtctg

SEQ ID NO: 220784 - DNA, 23 bp, Mus musculus
gaagacagtcagcatcagatcac

SEQ ID NO: 220785 - DNA, 23 bp, Mus musculus
caatatttttgtatctgttgagg

SEQ ID NO: 220786 - DNA, 20 bp, Mus musculus
gtgtgcattgtataaatgtg

SEQ ID NO: 220787 - DNA, 23 bp, Mus musculus
aagtatgtgtgcatatgtatgtg

SEQ ID NO: 220788 - DNA, 23 bp, Mus musculus
tatatgtatatatgcatgtgagt

SEQ ID NO: 220789 - DNA, 23 bp, Mus musculus
gtctgattctctctctgcctgtg

SEQ ID NO: 220790 - DNA, 20 bp, Mus musculus
tttgtctgagtattcacttc

SEQ ID NO: 220791 - DNA, 23 bp, Mus musculus
ctctatgagtgagactcttgtga

SEQ ID NO: 220792 - DNA, 23 bp, Mus musculus
tgtgtgtgtctgtgtgtatgtat

SEQ ID NO: 220793 - DNA, 22 bp, Mus musculus
tatgtctatatgtatatgtgtg

SEQ ID NO: 220794 - DNA, 21 bp, Mus musculus
tatgtatgtatgtctatatgt

SEQ ID NO: 220795 - DNA, 20 bp, Mus musculus
tatatgcatataaatgcatg

SEQ ID NO: 220796 - DNA, 23 bp, Mus musculus
ctcactcagactggcaaagtcca

SEQ ID NO: 220797 - DNA, 22 bp, Mus musculus
acacagggtccttcacagagaa

SEQ ID NO: 220798 - DNA, 22 bp, Mus musculus
ttactgtgtgtgactctgtgtc

SEQ ID NO: 220799 - DNA, 23 bp, Mus musculus
tgtgtacagtagtgtgtacaaag

SEQ ID NO: 220800 - DNA, 22 bp, Mus musculus
aaagacacttcactctctgtgt

SEQ ID NO: 220801 - DNA, 22 bp, Mus musculus
ttacaagttgatcaaagtagga

SEQ ID NO: 220802 - DNA, 23 bp, Mus musculus
tgtgtctccatctctgtctctct

SEQ ID NO: 220803 - DNA, 22 bp, Mus musculus
actgagaggagagtctgagcag

SEQ ID NO: 220804 - DNA, 23 bp, Mus musculus
gacagagagagagagagattttc

SEQ ID NO: 220805 - DNA, 23 bp, Mus musculus
ggagtcttgaatctcagtcattt

SEQ ID NO: 220806 - DNA, 23 bp, Mus musculus
cttcatctctctgtgtgttcatt

SEQ ID NO: 220807 - DNA, 20 bp, Mus musculus
tgagaggacacagtgtggag

SEQ ID NO: 220808 - DNA, 22 bp, Mus musculus
tgttttgtgaccaattatatgg

SEQ ID NO: 220809 - DNA, 22 bp, Mus musculus
atacagagtactgtagactgtg

SEQ ID NO: 220810 - DNA, 23 bp, Mus musculus
acacacacacagaagacagacag

SEQ ID NO: 220811 - DNA, 20 bp, Mus musculus
tctgtctctgtgattgtttt

SEQ ID NO: 220812 - DNA, 21 bp, Mus musculus
gagctctgcatttaagtcaca

SEQ ID NO: 220813 - DNA, 21 bp, Mus musculus
gttatgtagatctgtgagctg

SEQ ID NO: 220814 - DNA, 21 bp, Mus musculus
tgtgcatgcatgtatgtgtgt

SEQ ID NO: 220815 - DNA, 23 bp, Mus musculus
atgtgtgtatatatatgtgtgtg

SEQ ID NO: 220816 - DNA, 21 bp, Mus musculus
gtgtgcattatgtatgcatgt

SEQ ID NO: 220817 - DNA, 23 bp, Mus musculus
gcatgtatgcatgtgtgtatgaa

SEQ ID NO: 220818 - DNA, 23 bp, Mus musculus
atacacacatatgtacatgacat

SEQ ID NO: 220819 - DNA, 23 bp, Mus musculus
tgtatatatgtacgcatatgtgt

SEQ ID NO: 220820 - DNA, 22 bp, Mus musculus
tatgtgtatatatgtatatatg

SEQ ID NO: 220821 - DNA, 19 bp, Mus musculus
tgactcgaaccaatacttt

SEQ ID NO: 220822 - DNA, 23 bp, Mus musculus
agtgtttaagagcacttgctgct

SEQ ID NO: 220823 - DNA, 23 bp, Mus musculus
gtatatatccctctgtgtgagta

SEQ ID NO: 220824 - DNA, 23 bp, Mus musculus
aatatatgtgcatgtgtttacat

SEQ ID NO: 220825 - DNA, 23 bp, Mus musculus
gtctgtctgtctgtctgcctgcc

SEQ ID NO: 220826 - DNA, 22 bp, Mus musculus
gtgtctctgtgtgcctctgtgt

SEQ ID NO: 220827 - DNA, 23 bp, Mus musculus
atgtatgtatacatatgaatata

SEQ ID NO: 220828 - DNA, 23 bp, Mus musculus
tatctctgtgtctgtatgtgtgt

SEQ ID NO: 220829 - DNA, 22 bp, Mus musculus
atgctgtggagagtctgtctga

SEQ ID NO: 220830 - DNA, 23 bp, Mus musculus
gtttatgtctgctgatcttccca

SEQ ID NO: 220831 - DNA, 22 bp, Mus musculus
aagaatgtagatgaagggggat

SEQ ID NO: 220832 - DNA, 23 bp, Mus musculus
cattggtctacttgtctgtcact

SEQ ID NO: 220833 - DNA, 23 bp, Mus musculus
ggtgagagcatcttctttttctt

SEQ ID NO: 220834 - DNA, 22 bp, Mus musculus
ttaagaggagagtgtgaggtct

SEQ ID NO: 220835 - DNA, 23 bp, Mus musculus
gatctgagtaacactgtctccct

SEQ ID NO: 220836 - DNA, 23 bp, Mus musculus
tcaattctcagcaaccacatggt

SEQ ID NO: 220837 - DNA, 23 bp, Mus musculus
tcactttcactgtgtgtgtcttg

SEQ ID NO: 220838 - DNA, 19 bp, Mus musculus
tgtattgtttctatgctca

SEQ ID NO: 220839 - DNA, 23 bp, Mus musculus
gtgtccgtgtgtgcctctgagtg

SEQ ID NO: 220840 - DNA, 22 bp, Mus musculus
aagaaacttcctgttcgctgag

SEQ ID NO: 220841 - DNA, 19 bp, Mus musculus
tctttagttctgtgaaagg

SEQ ID NO: 220842 - DNA, 19 bp, Mus musculus
aagagcactgtctgctctt

SEQ ID NO: 220843 - DNA, 18 bp, Mus musculus
cagaggttctgagttcaa

SEQ ID NO: 220844 - DNA, 23 bp, Mus musculus
taagagcactgactgctcttcca

SEQ ID NO: 220845 - DNA, 22 bp, Mus musculus
tgtgtctgactctgtttctttt

SEQ ID NO: 220846 - DNA, 21 bp, Mus musculus
tctgtgtctttgtgactctct

SEQ ID NO: 220847 - DNA, 23 bp, Mus musculus
attaagtgcattttgttgagttt

SEQ ID NO: 220848 - DNA, 23 bp, Mus musculus
tacactatggatggataagtgca

SEQ ID NO: 220849 - DNA, 18 bp, Mus musculus
acaggaagatttatttat

SEQ ID NO: 220850 - DNA, 23 bp, Mus musculus
tctggctcttacactctttctgt

SEQ ID NO: 220851 - DNA, 22 bp, Mus musculus
tgttttgtgaccaattatatgg

SEQ ID NO: 220852 - DNA, 21 bp, Mus musculus
atatatgtatatgtgtatgtg

SEQ ID NO: 220853 - DNA, 23 bp, Mus musculus
atgtgtgcatatgtgtatatgtg

SEQ ID NO: 220854 - DNA, 23 bp, Mus musculus
ctgtctgtctgtctgtctgccac

SEQ ID NO: 220855 - DNA, 21 bp, Mus musculus
tgcctgagggggtgacaagag

SEQ ID NO: 220856 - DNA, 23 bp, Mus musculus
gctctgtgtgttcagagtcatca

SEQ ID NO: 220857 - DNA, 19 bp, Mus musculus
caagatacctgagcatcca

SEQ ID NO: 220858 - DNA, 23 bp, Mus musculus
acctcactgtctgtcactgatca

SEQ ID NO: 220859 - DNA, 23 bp, Mus musculus
tttctgtgtctcactgcttccga

SEQ ID NO: 220860 - DNA, 21 bp, Mus musculus
caggggctgtctctgactctg

SEQ ID NO: 220861 - DNA, 21 bp, Mus musculus
tttgtacatgtgtggctctgc

SEQ ID NO: 220862 - DNA, 23 bp, Mus musculus
caggagcagcagctgcacagtgg

SEQ ID NO: 220863 - DNA, 23 bp, Mus musculus
acacttgtttccatttatatata

SEQ ID NO: 220864 - DNA, 21 bp, Mus musculus
agtctatatatatgtatgtca

SEQ ID NO: 220865 - DNA, 23 bp, Mus musculus
acagcgtctgtaagtctctgcct

SEQ ID NO: 220866 - DNA, 21 bp, Mus musculus
atgtgtatgtgtatatatgtg

SEQ ID NO: 220867 - DNA, 23 bp, Mus musculus
gtatatatacaaaccacatgtat

SEQ ID NO: 220868 - DNA, 22 bp, Mus musculus
tatctatgagagattttgttgt

SEQ ID NO: 220869 - DNA, 23 bp, Mus musculus
taaaactctctcctattctagag

SEQ ID NO: 220870 - DNA, 20 bp, Mus musculus
acatacatcctgtaaacatt

SEQ ID NO: 220871 - DNA, 23 bp, Mus musculus
tagtctgtccatttctatactac

SEQ ID NO: 220872 - DNA, 21 bp, Mus musculus
tcactctccctctctccggag

SEQ ID NO: 220873 - DNA, 18 bp, Mus musculus
acttccgagtctttctgt

SEQ ID NO: 220874 - DNA, 21 bp, Mus musculus
gaacacagtcaggagacgttc

SEQ ID NO: 220875 - DNA, 23 bp, Mus musculus
cgctggctgcctgtttcctagta

SEQ ID NO: 220876 - DNA, 22 bp, Mus musculus
aacagagatgtgactgagctga

SEQ ID NO: 220877 - DNA, 19 bp, Mus musculus
tgtcatcttctggtggtag

SEQ ID NO: 220878 - DNA, 18 bp, Mus musculus
agccttttaatcagtttg

SEQ ID NO: 220879 - DNA, 23 bp, Mus musculus
acacatatatgtacatgtatatg

SEQ ID NO: 220880 - DNA, 23 bp, Mus musculus
ctctccttctcagtatctgtgat

SEQ ID NO: 220881 - DNA, 19 bp, Mus musculus
atcaagaggtgatgcttat

SEQ ID NO: 220882 - DNA, 23 bp, Mus musculus
ggctggctgtttgcctctgtcta

SEQ ID NO: 220883 - DNA, 23 bp, Mus musculus
atgtgaggtaacttgtgtgcttt

SEQ ID NO: 220884 - DNA, 23 bp, Mus musculus
tgtgtgcatgctaaagtgatctt

SEQ ID NO: 220885 - DNA, 18 bp, Mus musculus
agctaactgacagttgag

SEQ ID NO: 220886 - DNA, 22 bp, Mus musculus
tatatgtgcatatagatatgca

SEQ ID NO: 220887 - DNA, 22 bp, Mus musculus
ctatacttcctggatggtctga

SEQ ID NO: 220888 - DNA, 22 bp, Mus musculus
tatatgcatatatatactcaca

SEQ ID NO: 220889 - DNA, 22 bp, Mus musculus
tttggaaatataaacgtttctc

SEQ ID NO: 220890 - DNA, 22 bp, Mus musculus
ttttcacagagtcagcacttgc

SEQ ID NO: 220891 - DNA, 23 bp, Mus musculus
ttccgttttcattaagttctcag

SEQ ID NO: 220892 - DNA, 22 bp, Mus musculus
atatgtccagtgataacagtag

SEQ ID NO: 220893 - DNA, 22 bp, Mus musculus
tgtgtgtacattcacatgcaca

SEQ ID NO: 220894 - DNA, 23 bp, Mus musculus
attatgcatacagtgatgggtga

SEQ ID NO: 220895 - DNA, 20 bp, Mus musculus
agtgtaaacaagaatagcta

SEQ ID NO: 220896 - DNA, 23 bp, Mus musculus
atctcagagaggctgatcttatt

SEQ ID NO: 220897 - DNA, 19 bp, Mus musculus
ttttagaaaggatctgaat

SEQ ID NO: 220898 - DNA, 23 bp, Mus musculus
aagagacttgatggagacattcc

SEQ ID NO: 220899 - DNA, 23 bp, Mus musculus
gtctctcagtctgcatctgatct

SEQ ID NO: 220900 - DNA, 22 bp, Mus musculus
tcagaacatagagagtttttaa

SEQ ID NO: 220901 - DNA, 19 bp, Mus musculus
tgaattctatcttctgaga

SEQ ID NO: 220902 - DNA, 22 bp, Mus musculus
tgttttgtgaccaattatatgg

SEQ ID NO: 220903 - DNA, 19 bp, Mus musculus
atgtagtggcctttggtag

SEQ ID NO: 220904 - DNA, 22 bp, Mus musculus
tgacattgtttatctttgtgta

SEQ ID NO: 220905 - DNA, 23 bp, Mus musculus
ctatatctatatctatagctata

SEQ ID NO: 220906 - DNA, 23 bp, Mus musculus
gcatagatgtgattatgtagatg

SEQ ID NO: 220907 - DNA, 23 bp, Mus musculus
tatgtatatatgtatgtatgtgt

SEQ ID NO: 220908 - DNA, 22 bp, Mus musculus
cctgtgtctgtctgtctgtctg

SEQ ID NO: 220909 - DNA, 21 bp, Mus musculus
aacttaattacaaatagtgaa

SEQ ID NO: 220910 - DNA, 23 bp, Mus musculus
agtgtgtttggttttcatcttgt

SEQ ID NO: 220911 - DNA, 22 bp, Mus musculus
tgttttgtgaccaattatatgg

SEQ ID NO: 220912 - DNA, 20 bp, Mus musculus
gtacatgcatgtatatgtat

SEQ ID NO: 220913 - DNA, 23 bp, Mus musculus
ggttcaatcagagtctctgtctc

SEQ ID NO: 220914 - DNA, 23 bp, Mus musculus
aaaatgtttatatatatgtgtgt

SEQ ID NO: 220915 - DNA, 21 bp, Mus musculus
tagacgtatatgtatgtgtat

SEQ ID NO: 220916 - DNA, 23 bp, Mus musculus
gtgagatgagagtgagcagggag

SEQ ID NO: 220917 - DNA, 18 bp, Mus musculus
agacctttccatatctct

SEQ ID NO: 220918 - DNA, 23 bp, Mus musculus
agcatgtatgtatgtatgtatgt

SEQ ID NO: 220919 - DNA, 23 bp, Mus musculus
gtatgtggatatattatatgtat

SEQ ID NO: 220920 - DNA, 23 bp, Mus musculus
ttatgtatatatgcatgtgtgtg

SEQ ID NO: 220921 - DNA, 22 bp, Mus musculus
tgttttgtgaccaattatatgg

SEQ ID NO: 220922 - DNA, 21 bp, Mus musculus
ctccagttcctctctcactga

SEQ ID NO: 220923 - DNA, 22 bp, Mus musculus
tgagcatatatgtgtgatccaa

SEQ ID NO: 220924 - DNA, 23 bp, Mus musculus
tcaacctccctgagaccctttaa

SEQ ID NO: 220925 - DNA, 23 bp, Mus musculus
ccacagtcattctctctcacccc

SEQ ID NO: 220926 - DNA, 23 bp, Mus musculus
cctgactgtgtgcctgggtctgt

SEQ ID NO: 220927 - DNA, 23 bp, Mus musculus
ccctgtctctctgtgtccctgtc

SEQ ID NO: 220928 - DNA, 23 bp, Mus musculus
gggtctctctgtgtggctgtcca

SEQ ID NO: 220929 - DNA, 23 bp, Mus musculus
actcacagagatcctcctgcctc

SEQ ID NO: 220930 - DNA, 23 bp, Mus musculus
atgtgtctgtctgtctcattgca

SEQ ID NO: 220931 - DNA, 23 bp, Mus musculus
gaaagaaagaagtgagagcgctg

SEQ ID NO: 220932 - DNA, 23 bp, Mus musculus
cagtctatctgtctgtctgtcta

SEQ ID NO: 220933 - DNA, 21 bp, Mus musculus
tccatggtggtctgataggat

SEQ ID NO: 220934 - DNA, 22 bp, Mus musculus
tgttttgtgaccaattatatgg

SEQ ID NO: 220935 - DNA, 23 bp, Mus musculus
gagtgtctctgtgtccctctggt

SEQ ID NO: 220936 - DNA, 20 bp, Mus musculus
atatgtatatttatatatgt

SEQ ID NO: 220937 - DNA, 22 bp, Mus musculus
tgttttgtgaccaattatatgg

SEQ ID NO: 220938 - DNA, 22 bp, Mus musculus
tgttttgtgaccaattatatgg

SEQ ID NO: 220939 - DNA, 18 bp, Mus musculus
ttttgtatctgttgagtc

SEQ ID NO: 220940 - DNA, 23 bp, Mus musculus
ctctctgtatgtgtttgtgtgtg

SEQ ID NO: 220941 - DNA, 20 bp, Mus musculus
atacctatatgtatatgtga

SEQ ID NO: 220942 - DNA, 22 bp, Mus musculus
tctccgagggtcactggctcca

SEQ ID NO: 220943 - DNA, 23 bp, Mus musculus
agagagaacagagtcaggggtgg

SEQ ID NO: 220944 - DNA, 18 bp, Mus musculus
cccttgattaaccactct

SEQ ID NO: 220945 - DNA, 22 bp, Mus musculus
actttgtgcaagtccaagtgga

SEQ ID NO: 220946 - DNA, 22 bp, Mus musculus
tgttttgtgtccaattatatgg

SEQ ID NO: 220947 - DNA, 22 bp, Mus musculus
tgattctgtctgtgtttttgtc

SEQ ID NO: 220948 - DNA, 22 bp, Mus musculus
ataaaggaggatattggaatga

SEQ ID NO: 220949 - DNA, 18 bp, Mus musculus
actctagagtgtttcttg

SEQ ID NO: 220950 - DNA, 23 bp, Mus musculus
agtactacatcttgatctgcagg

SEQ ID NO: 220951 - DNA, 23 bp, Mus musculus
tgtgtgtgtatatctatatctat

SEQ ID NO: 220952 - DNA, 23 bp, Mus musculus
tgtggcaccctgtgatcacaagt

SEQ ID NO: 220953 - DNA, 21 bp, Mus musculus
atgtatgtgtgtatatgtgta

SEQ ID NO: 220954 - DNA, 22 bp, Mus musculus
tttgggtggtttagatctgaga

SEQ ID NO: 220955 - DNA, 21 bp, Mus musculus
agtttcagtggtttaaatctc

SEQ ID NO: 220956 - DNA, 23 bp, Mus musculus
tttctgtatgcacatacagtgtg

SEQ ID NO: 220957 - DNA, 23 bp, Mus musculus
ggcccagtctctctccctctgcc

SEQ ID NO: 220958 - DNA, 23 bp, Mus musculus
tgcatgcatgtatgtatgtatct

SEQ ID NO: 220959 - DNA, 21 bp, Mus musculus
tgcataagtatgtatatgtgt

SEQ ID NO: 220960 - DNA, 18 bp, Mus musculus
acactcagatgtcttgtg

SEQ ID NO: 220961 - DNA, 23 bp, Mus musculus
ccctgtgcatgctgtctcagtct

SEQ ID NO: 220962 - DNA, 23 bp, Mus musculus
tcaagagctattttaaaatgtat

SEQ ID NO: 220963 - DNA, 18 bp, Mus musculus
taagaaggtgtgcggcag

SEQ ID NO: 220964 - DNA, 22 bp, Mus musculus
tgttttgtgaccaattatatgg

SEQ ID NO: 220965 - DNA, 19 bp, Mus musculus
ttgttaatctatgtctttt

SEQ ID NO: 220966 - DNA, 18 bp, Mus musculus
tgttgttgtggtggtgag

SEQ ID NO: 220967 - DNA, 19 bp, Mus musculus
ttttccactgcagacagcc

SEQ ID NO: 220968 - DNA, 23 bp, Mus musculus
ttagtgtatgtatatatatgtgt

SEQ ID NO: 220969 - DNA, 23 bp, Mus musculus
atatgtgtgtatatatatgtgtg

SEQ ID NO: 220970 - DNA, 22 bp, Mus musculus
tgactgtatatggaatggctaa

SEQ ID NO: 220971 - DNA, 20 bp, Mus musculus
agtgcatactgtgtttgttc

SEQ ID NO: 220972 - DNA, 23 bp, Mus musculus
ttagcagacttgtcagagttcag

SEQ ID NO: 220973 - DNA, 22 bp, Mus musculus
ttacagtgtggaagagtagtta

SEQ ID NO: 220974 - DNA, 20 bp, Mus musculus
atatgtacatgtaaaagtat

SEQ ID NO: 220975 - DNA, 20 bp, Mus musculus
tctgttgctcactttctctt

SEQ ID NO: 220976 - DNA, 23 bp, Mus musculus
aagttagtggtataggtgcaggt

SEQ ID NO: 220977 - DNA, 21 bp, Mus musculus
ttcagagaacacagagagaac

SEQ ID NO: 220978 - DNA, 22 bp, Mus musculus
gttcagtctctgtgagtcttgt

SEQ ID NO: 220979 - DNA, 22 bp, Mus musculus
ctggattttaattgctgtgtgt

SEQ ID NO: 220980 - DNA, 23 bp, Mus musculus
attgtatatgtgtgaacatgttg

SEQ ID NO: 220981 - DNA, 23 bp, Mus musculus
tgtatgtgtgattgtatatgtgt

SEQ ID NO: 220982 - DNA, 22 bp, Mus musculus
tgtgcatgtgatatgatatgat

SEQ ID NO: 220983 - DNA, 18 bp, Mus musculus
tggtatgtatgcatgtaa

SEQ ID NO: 220984 - DNA, 22 bp, Mus musculus
tgcctggctgcctgcttgcctg

SEQ ID NO: 220985 - DNA, 23 bp, Mus musculus
actgtgagcatctgcatctgtat

SEQ ID NO: 220986 - DNA, 19 bp, Mus musculus
tgcgttgatctttgccctt

SEQ ID NO: 220987 - DNA, 23 bp, Mus musculus
ctctggctctgacacagtcacag

SEQ ID NO: 220988 - DNA, 23 bp, Mus musculus
ctctgtctctccttatcttcaca

SEQ ID NO: 220989 - DNA, 23 bp, Mus musculus
attgtcattttctatttctctga

SEQ ID NO: 220990 - DNA, 20 bp, Mus musculus
tatagaacactgtgatcagc

SEQ ID NO: 220991 - DNA, 22 bp, Mus musculus
tcactcagtttctgtttgacat

SEQ ID NO: 220992 - DNA, 22 bp, Mus musculus
tgtaagcatttcagagagagag

SEQ ID NO: 220993 - DNA, 18 bp, Mus musculus
ggtgatgatcatggactc

SEQ ID NO: 220994 - DNA, 18 bp, Mus musculus
atgtatattacgtgtgtg

SEQ ID NO: 220995 - DNA, 23 bp, Mus musculus
gtgtgttttcatcctgtggtagt

SEQ ID NO: 220996 - DNA, 23 bp, Mus musculus
tctctgtctgtgtatgtattatg

SEQ ID NO: 220997 - DNA, 22 bp, Mus musculus
gtatgagcatatgcatgtgtgt

SEQ ID NO: 220998 - DNA, 23 bp, Mus musculus
ctgtgcatgtgtgtggtataact

SEQ ID NO: 220999 - DNA, 18 bp, Mus musculus
tgtgtgcatgttcatgtg

SEQ ID NO: 221000 - DNA, 23 bp, Mus musculus
tccctgtcttaaactctctgtcc

SEQ ID NO: 221001 - DNA, 23 bp, Mus musculus
tgtctctgaatagagtgtgccca

SEQ ID NO: 221002 - DNA, 23 bp, Mus musculus
gagaactctgcatccactttcct

SEQ ID NO: 221003 - DNA, 21 bp, Mus musculus
tgagtgatgtaagtgtgcaga

SEQ ID NO: 221004 - DNA, 23 bp, Mus musculus
atatacatgtatatgtatacata

SEQ ID NO: 221005 - DNA, 23 bp, Mus musculus
gatcttgactgtggttgtgatgt

SEQ ID NO: 221006 - DNA, 18 bp, Mus musculus
tgctaaccattcagatgt

SEQ ID NO: 221007 - DNA, 22 bp, Mus musculus
acactgagagtagacatagcct

SEQ ID NO: 221008 - DNA, 23 bp, Mus musculus
tacacagtacagtgtgacctcag

SEQ ID NO: 221009 - DNA, 19 bp, Mus musculus
ttccacaatggggctggag

SEQ ID NO: 221010 - DNA, 23 bp, Mus musculus
agtcagtctgtctgtctgtccca

SEQ ID NO: 221011 - DNA, 19 bp, Mus musculus
ctgtgtgttgagagtccag

SEQ ID NO: 221012 - DNA, 23 bp, Mus musculus
cttgtctatccttgaactctgtg

SEQ ID NO: 221013 - DNA, 23 bp, Mus musculus
gtctgtctgtctgtctgtctaca

SEQ ID NO: 221014 - DNA, 22 bp, Mus musculus
tatgctggcctggaactagctg

SEQ ID NO: 221015 - DNA, 22 bp, Mus musculus
agagggcgtctctctctcactc

SEQ ID NO: 221016 - DNA, 23 bp, Mus musculus
acacacaacagagtgtgcatgta

SEQ ID NO: 221017 - DNA, 23 bp, Mus musculus
tatgtccatcctgtttctgtctc

SEQ ID NO: 221018 - DNA, 23 bp, Mus musculus
ctaagactgtctggttttcacga

SEQ ID NO: 221019 - DNA, 22 bp, Mus musculus
aactcaccgagcttagaaggtg

SEQ ID NO: 221020 - DNA, 22 bp, Mus musculus
tgtaagcttttgaaacctctaa

SEQ ID NO: 221021 - DNA, 22 bp, Mus musculus
atgtatgtatctgtgtgtgtat

SEQ ID NO: 221022 - DNA, 23 bp, Mus musculus
ctgtctgtctgtctgccttcctg

SEQ ID NO: 221023 - DNA, 23 bp, Mus musculus
tgtctgtctgtctgtctgcctgt

SEQ ID NO: 221024 - DNA, 23 bp, Mus musculus
gacatccaggttctctgtgagtc

SEQ ID NO: 221025 - DNA, 23 bp, Mus musculus
ggctgtcactgtctcggtctgag

SEQ ID NO: 221026 - DNA, 23 bp, Mus musculus
tccctgagagatgagtatcaggt

SEQ ID NO: 221027 - DNA, 23 bp, Mus musculus
tgtgtgtatatgtatgtgtatgt

SEQ ID NO: 221028 - DNA, 23 bp, Mus musculus
caatgtctctgtctgtctgtgtc

SEQ ID NO: 221029 - DNA, 23 bp, Mus musculus
tgggtagtagattctgtggacca

SEQ ID NO: 221030 - DNA, 23 bp, Mus musculus
tgtctatctgtctgtctgtctgt

SEQ ID NO: 221031 - DNA, 23 bp, Mus musculus
tgtctctctgcctgcctgagaca

SEQ ID NO: 221032 - DNA, 23 bp, Mus musculus
cacactgcctgactgtgaggaaa

SEQ ID NO: 221033 - DNA, 23 bp, Mus musculus
catgagagtgtgtgcatgtgcac

SEQ ID NO: 221034 - DNA, 23 bp, Mus musculus
atgtatgtatgtacgtatgtatg

SEQ ID NO: 221035 - DNA, 22 bp, Mus musculus
tgagaccttgcacacacggtca

SEQ ID NO: 221036 - DNA, 22 bp, Mus musculus
tctcaccgtctctctggccact

SEQ ID NO: 221037 - DNA, 21 bp, Mus musculus
tgactggagagactgagcaaa

SEQ ID NO: 221038 - DNA, 22 bp, Mus musculus
ttttttggtcttaaacaaggtg

SEQ ID NO: 221039 - DNA, 23 bp, Mus musculus
agaagacatcaagggattcagtg

SEQ ID NO: 221040 - DNA, 21 bp, Mus musculus
tcagagtagagagcgaccaca

SEQ ID NO: 221041 - DNA, 23 bp, Mus musculus
atttaccctcagtctctgcttgg

SEQ ID NO: 221042 - DNA, 23 bp, Mus musculus
tgtatgtgtgcatgtgcatgtgt

SEQ ID NO: 221043 - DNA, 23 bp, Mus musculus
tgtgtgtgcatgtacatacatgt

SEQ ID NO: 221044 - DNA, 23 bp, Mus musculus
gggctctctgtgtgtgtccctct

SEQ ID NO: 221045 - DNA, 20 bp, Mus musculus
tgtgtgcatgtgtatgtgca

SEQ ID NO: 221046 - DNA, 18 bp, Mus musculus
tctctgcctcagtcactg

SEQ ID NO: 221047 - DNA, 23 bp, Mus musculus
gatgtcagacagtgtctccctca

SEQ ID NO: 221048 - DNA, 23 bp, Mus musculus
tctgagtctctccctgcctctcc

SEQ ID NO: 221049 - DNA, 23 bp, Mus musculus
actgtcactgagtgataactagc

SEQ ID NO: 221050 - DNA, 23 bp, Mus musculus
ttaagagcactgactgctcttcc

SEQ ID NO: 221051 - DNA, 23 bp, Mus musculus
tctggaactgtcagagggtgtca

SEQ ID NO: 221052 - DNA, 18 bp, Mus musculus
ttggtgagatgactcagc

SEQ ID NO: 221053 - DNA, 23 bp, Mus musculus
tatgattatcatcatcatcatca

SEQ ID NO: 221054 - DNA, 23 bp, Mus musculus
acagtctgtctctgtcccagcct

SEQ ID NO: 221055 - DNA, 23 bp, Mus musculus
tatgtatgtatgtatgtatgtat

SEQ ID NO: 221056 - DNA, 18 bp, Mus musculus
aatgtgtgtgtgtgtgca

SEQ ID NO: 221057 - DNA, 20 bp, Mus musculus
actgcagataattttatgtg

SEQ ID NO: 221058 - DNA, 23 bp, Mus musculus
ctcacactcactttgtagctgca

SEQ ID NO: 221059 - DNA, 21 bp, Mus musculus
actctgtgtccatgtgtgtct

SEQ ID NO: 221060 - DNA, 23 bp, Mus musculus
agtgtctcactcagataaaactg

SEQ ID NO: 221061 - DNA, 23 bp, Mus musculus
aagtatatgtgcaggattgtaca

SEQ ID NO: 221062 - DNA, 19 bp, Mus musculus
tgtgtgtgtgagatgttgg

SEQ ID NO: 221063 - DNA, 23 bp, Mus musculus
atgtccttcatctagtgtcctgt

SEQ ID NO: 221064 - DNA, 23 bp, Mus musculus
ctcagaacacagagaggactcaa

SEQ ID NO: 221065 - DNA, 23 bp, Mus musculus
gtctctctctctctctctcagag

SEQ ID NO: 221066 - DNA, 20 bp, Mus musculus
atagcagtagaagcatgcag

SEQ ID NO: 221067 - DNA, 23 bp, Mus musculus
tgatttgtagggtttctcatttc

SEQ ID NO: 221068 - DNA, 23 bp, Mus musculus
atatgtgtatatatgtatatatg

SEQ ID NO: 221069 - DNA, 18 bp, Mus musculus
ctgtgcatagatatatgt

SEQ ID NO: 221070 - DNA, 23 bp, Mus musculus
aggcccagtctcactctctgcct

SEQ ID NO: 221071 - DNA, 21 bp, Mus musculus
taggcacaagagtgtgtgcag

SEQ ID NO: 221072 - DNA, 22 bp, Mus musculus
cactgggtttagaatctcatgt

SEQ ID NO: 221073 - DNA, 23 bp, Mus musculus
gtgagcaggagtgtttgtgctca

SEQ ID NO: 221074 - DNA, 23 bp, Mus musculus
tgtgtctgtcagtcaattcttgc

SEQ ID NO: 221075 - DNA, 21 bp, Mus musculus
tatgtgtgtatatacatatat

SEQ ID NO: 221076 - DNA, 18 bp, Mus musculus
tgtgtctagtatatgtct

SEQ ID NO: 221077 - DNA, 19 bp, Mus musculus
gtgagtgggatatttgtgt

SEQ ID NO: 221078 - DNA, 23 bp, Mus musculus
gtctgtctgtccaccatgtgcac

SEQ ID NO: 221079 - DNA, 19 bp, Mus musculus
gaggctagaagagggcaga

SEQ ID NO: 221080 - DNA, 23 bp, Mus musculus
caatatttttgtatctgttgagg

SEQ ID NO: 221081 - DNA, 23 bp, Mus musculus
ttcccactctctgaaaacaggct

SEQ ID NO: 221082 - DNA, 21 bp, Mus musculus
tgtgtatatctatgtgtgagt

SEQ ID NO: 221083 - DNA, 23 bp, Mus musculus
tatctgtgcatgcatgtgtgtga

SEQ ID NO: 221084 - DNA, 23 bp, Mus musculus
atgtatgtatatatgtttccagg

SEQ ID NO: 221085 - DNA, 20 bp, Mus musculus
tgagagtcacaaagattttt

SEQ ID NO: 221086 - DNA, 22 bp, Mus musculus
tgttttgtgaccaattatatgg

SEQ ID NO: 221087 - DNA, 22 bp, Mus musculus
tgttttgtgaccaattatatgg

SEQ ID NO: 221088 - DNA, 23 bp, Mus musculus
caagtcagaatagtgtcagaaga

SEQ ID NO: 221089 - DNA, 22 bp, Mus musculus
tgttttgtgaccaattatatgg

SEQ ID NO: 221090 - DNA, 22 bp, Mus musculus
tgttttgtgaccaattatatgg

SEQ ID NO: 221091 - DNA, 22 bp, Mus musculus
tgttttgtgaccaattatatgg

SEQ ID NO: 221092 - DNA, 23 bp, Mus musculus
tagattctcacatacatttcaga

SEQ ID NO: 221093 - DNA, 21 bp, Mus musculus
aaagagcatccaagaactgat

SEQ ID NO: 221094 - DNA, 20 bp, Mus musculus
attgtttactacttcctgga

SEQ ID NO: 221095 - DNA, 20 bp, Mus musculus
tttttctctattaatagagc

SEQ ID NO: 221096 - DNA, 20 bp, Mus musculus
taagattatttcattttgtg

SEQ ID NO: 221097 - DNA, 21 bp, Mus musculus
aagctctttttgttttactga

SEQ ID NO: 221098 - DNA, 22 bp, Mus musculus
ataactcagtgaccaaaagagg

SEQ ID NO: 221099 - DNA, 22 bp, Mus musculus
ttgctgaggtggtggactccag

SEQ ID NO: 221100 - DNA, 23 bp, Mus musculus
tgtgagtgtcactgtcaaacaac

SEQ ID NO: 221101 - DNA, 23 bp, Mus musculus
atctctttttgttgttgaattgc

SEQ ID NO: 221102 - DNA, 22 bp, Mus musculus
tgttttgtgaccaattatatgg

SEQ ID NO: 221103 - DNA, 23 bp, Mus musculus
tgtatatgtatatgtatatgtac

SEQ ID NO: 221104 - DNA, 19 bp, Mus musculus
tgcctgagtctcaggtgtg

SEQ ID NO: 221105 - DNA, 23 bp, Mus musculus
tgagtctctgggtctcaacctgc

SEQ ID NO: 221106 - DNA, 20 bp, Mus musculus
tgtgtgtgtgtgtgtgtgtg

SEQ ID NO: 221107 - DNA, 21 bp, Mus musculus
tatggttatgtagcttgatgt

SEQ ID NO: 221108 - DNA, 23 bp, Mus musculus
attagtctgtctttatctctgtg

SEQ ID NO: 221109 - DNA, 23 bp, Mus musculus
actgtgagcctgtctgtttgcct

SEQ ID NO: 221110 - DNA, 22 bp, Mus musculus
gtatgtatgtatgtatgtgtgt

SEQ ID NO: 221111 - DNA, 23 bp, Mus musculus
acctagctctggaagctctcaga

SEQ ID NO: 221112 - DNA, 23 bp, Mus musculus
gtatgtatatatatatgtgtgtg

SEQ ID NO: 221113 - DNA, 20 bp, Mus musculus
ccatggtgatctgataggat

SEQ ID NO: 221114 - DNA, 21 bp, Mus musculus
atatgttgaagcttgttttgt

SEQ ID NO: 221115 - DNA, 22 bp, Mus musculus
gtactagcatcatttcaagact

SEQ ID NO: 221116 - DNA, 20 bp, Mus musculus
tgttttgtgagcaattatgt

SEQ ID NO: 221117 - DNA, 22 bp, Mus musculus
tgttttgtgaccaattatatgg

SEQ ID NO: 221118 - DNA, 22 bp, Mus musculus
tatgagtgtgtatgtatactgt

SEQ ID NO: 221119 - DNA, 19 bp, Mus musculus
tgtgcatatatatgagtat

SEQ ID NO: 221120 - DNA, 21 bp, Mus musculus
tacatacatatgtatgcatat

SEQ ID NO: 221121 - DNA, 23 bp, Mus musculus
agtactgagagtggagatagagg

SEQ ID NO: 221122 - DNA, 23 bp, Mus musculus
ttacatgatatatatgtgtgtgt

SEQ ID NO: 221123 - DNA, 23 bp, Mus musculus
acttcactctggaagaatagact

SEQ ID NO: 221124 - DNA, 23 bp, Mus musculus
acagaagagtctctacagagatg

SEQ ID NO: 221125 - DNA, 23 bp, Mus musculus
acactgtgagttcagactgtgga

SEQ ID NO: 221126 - DNA, 23 bp, Mus musculus
tggctctcttgctctcacactct

SEQ ID NO: 221127 - DNA, 23 bp, Mus musculus
tagtccatggtgaactgatagga

SEQ ID NO: 221128 - DNA, 23 bp, Mus musculus
ttactgcttttaatattctgact

SEQ ID NO: 221129 - DNA, 22 bp, Mus musculus
tgttttgtgaccaattatatgg

SEQ ID NO: 221130 - DNA, 22 bp, Mus musculus
agagtctctctgtgtccctgcc

SEQ ID NO: 221131 - DNA, 23 bp, Mus musculus
atttgttcatttggtatggtgat

SEQ ID NO: 221132 - DNA, 20 bp, Mus musculus
ccatggtgatctgataggat

SEQ ID NO: 221133 - DNA, 21 bp, Mus musculus
atatgttgaagcttgttttgt

SEQ ID NO: 221134 - DNA, 20 bp, Mus musculus
gggtgagatatgagaatctg

SEQ ID NO: 221135 - DNA, 19 bp, Mus musculus
gtctcagtctgtgacaggg

SEQ ID NO: 221136 - DNA, 22 bp, Mus musculus
taagagcactgactgctcttct

SEQ ID NO: 221137 - DNA, 23 bp, Mus musculus
gtatgtgcttcatatgtgctagt

SEQ ID NO: 221138 - DNA, 23 bp, Mus musculus
atgtttctgtagcataaaccaag

SEQ ID NO: 221139 - DNA, 23 bp, Mus musculus
tgtgtgtgtctgtttgtcaattt

SEQ ID NO: 221140 - DNA, 23 bp, Mus musculus
tgatcagagatgatagagatgtg

SEQ ID NO: 221141 - DNA, 23 bp, Mus musculus
gtcagactctcactgtcttttca

SEQ ID NO: 221142 - DNA, 23 bp, Mus musculus
atttttgtatctgttgagtcctg

SEQ ID NO: 221143 - DNA, 20 bp, Mus musculus
tagaatattcagatacatgt

SEQ ID NO: 221144 - DNA, 23 bp, Mus musculus
aggctcacagactcacacttgct

SEQ ID NO: 221145 - DNA, 19 bp, Mus musculus
acaggaagaaggttgtggt

SEQ ID NO: 221146 - DNA, 23 bp, Mus musculus
gtatatgtgtgtgtatacgtatg

SEQ ID NO: 221147 - DNA, 20 bp, Mus musculus
tgtatgtgcgtgtgtatgtt

SEQ ID NO: 221148 - DNA, 22 bp, Mus musculus
tcttgcatcagatagcatcttg

SEQ ID NO: 221149 - DNA, 23 bp, Mus musculus
tgtgactgcctcgctgtgtgcct

SEQ ID NO: 221150 - DNA, 23 bp, Mus musculus
tctcagaagagtcagaggatgca

SEQ ID NO: 221151 - DNA, 23 bp, Mus musculus
atagaatgtttatcagatgggct

SEQ ID NO: 221152 - DNA, 21 bp, Mus musculus
atgtgtatatttgtatatgaa

SEQ ID NO: 221153 - DNA, 20 bp, Mus musculus
tgtgtatatgtgtatgtgtg

SEQ ID NO: 221154 - DNA, 23 bp, Mus musculus
atgtatgtgtgtatgtgcatatg

SEQ ID NO: 221155 - DNA, 23 bp, Mus musculus
taacactgactgctcttccagag

SEQ ID NO: 221156 - DNA, 23 bp, Mus musculus
cttctcactctctctctgacttc

SEQ ID NO: 221157 - DNA, 23 bp, Mus musculus
tgagggacatgaatgtcacagct

SEQ ID NO: 221158 - DNA, 21 bp, Mus musculus
ttcaattctcagcaaccacat

SEQ ID NO: 221159 - DNA, 23 bp, Mus musculus
cacagtgagctcacagggtgtgt

SEQ ID NO: 221160 - DNA, 23 bp, Mus musculus
aagagcactgtctgctcttccag

SEQ ID NO: 221161 - DNA, 23 bp, Mus musculus
tgcgtgcctgtgtgcgtgcgtga

SEQ ID NO: 221162 - DNA, 23 bp, Mus musculus
atcccagttctctgtgaagtctc

SEQ ID NO: 221163 - DNA, 23 bp, Mus musculus
cctcactccctctgtctgcctct

SEQ ID NO: 221164 - DNA, 22 bp, Mus musculus
tattagactgaagagatggctc

SEQ ID NO: 221165 - DNA, 21 bp, Mus musculus
tcacatctgacactgagagct

SEQ ID NO: 221166 - DNA, 18 bp, Mus musculus
tcatgttggctttatttg

SEQ ID NO: 221167 - DNA, 19 bp, Mus musculus
cagaggtttaattttctta

SEQ ID NO: 221168 - DNA, 23 bp, Mus musculus
gtattgtgtatgttatgcgtgtg

SEQ ID NO: 221169 - DNA, 23 bp, Mus musculus
cattactgtctctctgtctgggc

SEQ ID NO: 221170 - DNA, 20 bp, Mus musculus
atgtatgtgtgtatattcat

SEQ ID NO: 221171 - DNA, 22 bp, Mus musculus
tctctctgtctctaagtgtctg

SEQ ID NO: 221172 - DNA, 23 bp, Mus musculus
ctgtctgtctgtctgtctgtctg

SEQ ID NO: 221173 - DNA, 23 bp, Mus musculus
agtgtcacagtatgctctccctg

SEQ ID NO: 221174 - DNA, 23 bp, Mus musculus
tagactgtgcactctggggacag

SEQ ID NO: 221175 - DNA, 19 bp, Mus musculus
tatatatatgcatgtatac

SEQ ID NO: 221176 - DNA, 21 bp, Mus musculus
agtggaagtattctgtctcag

SEQ ID NO: 221177 - DNA, 22 bp, Mus musculus
tgtggaagttggttctttccct

SEQ ID NO: 221178 - DNA, 20 bp, Mus musculus
agggattgaactcaggtctt

SEQ ID NO: 221179 - DNA, 18 bp, Mus musculus
ggggtgtgtctgatgtgt

SEQ ID NO: 221180 - DNA, 23 bp, Mus musculus
tgtccttctctgtcactctctgc

SEQ ID NO: 221181 - DNA, 21 bp, Mus musculus
ttaagtgcagcaccaggagct

SEQ ID NO: 221182 - DNA, 18 bp, Mus musculus
tatctacaagtgggccag

SEQ ID NO: 221183 - DNA, 18 bp, Mus musculus
agagtgttattggccttg

SEQ ID NO: 221184 - DNA, 22 bp, Mus musculus
tctatcagagactccatgtgca

SEQ ID NO: 221185 - DNA, 23 bp, Mus musculus
tctattactgtgaggctctctct

SEQ ID NO: 221186 - DNA, 21 bp, Mus musculus
tgcctggctgcctgactgcct

SEQ ID NO: 221187 - DNA, 23 bp, Mus musculus
gtctgtctgtctgtctgtcttcc

SEQ ID NO: 221188 - DNA, 23 bp, Mus musculus
gtctccagttctgtgtctctctc

SEQ ID NO: 221189 - DNA, 23 bp, Mus musculus
tctggctggctgagtgcttggga

SEQ ID NO: 221190 - DNA, 23 bp, Mus musculus
tcacagcatgtggaagcagagat

SEQ ID NO: 221191 - DNA, 23 bp, Mus musculus
tcttccttttcagtctgtgtgtc

SEQ ID NO: 221192 - DNA, 23 bp, Mus musculus
atcagagacaagagacagacctc

SEQ ID NO: 221193 - DNA, 23 bp, Mus musculus
atgtatgtgtgcatgtgtatatg

SEQ ID NO: 221194 - DNA, 21 bp, Mus musculus
tccatagtgatctgataggat

SEQ ID NO: 221195 - DNA, 23 bp, Mus musculus
tttgtgaccaattgtatggtcat

SEQ ID NO: 221196 - DNA, 22 bp, Mus musculus
aaccagcacctcatgcattcta

SEQ ID NO: 221197 - DNA, 23 bp, Mus musculus
gtgctgtgtctgtctggttggga

SEQ ID NO: 221198 - DNA, 22 bp, Mus musculus
agatgcacatttgtgtgtatgc

SEQ ID NO: 221199 - DNA, 23 bp, Mus musculus
acagtgacactgagtctcttgac

SEQ ID NO: 221200 - DNA, 23 bp, Mus musculus
taggtccttgaagaggtggaggg

SEQ ID NO: 221201 - DNA, 23 bp, Mus musculus
atggtctccgtctgtctctctca

SEQ ID NO: 221202 - DNA, 23 bp, Mus musculus
gagctctcagtgtctgactgcga

SEQ ID NO: 221203 - DNA, 20 bp, Mus musculus
aaacacatttactttatgtg

SEQ ID NO: 221204 - DNA, 23 bp, Mus musculus
tgcatgtatgtatgtatgtatgt

SEQ ID NO: 221205 - DNA, 22 bp, Mus musculus
cacaggctaagtgaggtcttgg

SEQ ID NO: 221206 - DNA, 23 bp, Mus musculus
tcccagcctcactgagtgtctgt

SEQ ID NO: 221207 - DNA, 18 bp, Mus musculus
tgatgtactctttgtctc

SEQ ID NO: 221208 - DNA, 23 bp, Mus musculus
aagaaacactcaaatgtgttgag

SEQ ID NO: 221209 - DNA, 21 bp, Mus musculus
atatgcatattgtatatatgt

SEQ ID NO: 221210 - DNA, 19 bp, Mus musculus
tatgtgtgtgtatacgtat

SEQ ID NO: 221211 - DNA, 23 bp, Mus musculus
tctgtctctgtctctgcctcctc

SEQ ID NO: 221212 - DNA, 23 bp, Mus musculus
gaatgaagagagagacctgaaga

SEQ ID NO: 221213 - DNA, 23 bp, Mus musculus
ctctgactgtggatgtgttgtga

SEQ ID NO: 221214 - DNA, 23 bp, Mus musculus
gtgtttctatctgtacgcgtatg

SEQ ID NO: 221215 - DNA, 21 bp, Mus musculus
tatgtctaagtgtatatgtgt

SEQ ID NO: 221216 - DNA, 21 bp, Mus musculus
gacactctctggctctgctcc

SEQ ID NO: 221217 - DNA, 23 bp, Mus musculus
tgtatatatgcatgtctatgtgc

SEQ ID NO: 221218 - DNA, 20 bp, Mus musculus
tacatgcatatatatgcata

SEQ ID NO: 221219 - DNA, 23 bp, Mus musculus
gtcagtgggtcagtgggtcagtg

SEQ ID NO: 221220 - DNA, 23 bp, Mus musculus
tgtgtgtatgtatatgtgtgtat

SEQ ID NO: 221221 - DNA, 21 bp, Mus musculus
tatgtgtatatatatatatgt

SEQ ID NO: 221222 - DNA, 21 bp, Mus musculus
atgtgtgatgtaaatgtgtgc

SEQ ID NO: 221223 - DNA, 22 bp, Mus musculus
atgtgtgtatgtgtatatgtgt

SEQ ID NO: 221224 - DNA, 20 bp, Mus musculus
taatgatagatataagtggt

SEQ ID NO: 221225 - DNA, 22 bp, Mus musculus
aggattcaaaagaagtttgcgc

SEQ ID NO: 221226 - DNA, 23 bp, Mus musculus
tggcactcagtcagtgatggagc

SEQ ID NO: 221227 - DNA, 23 bp, Mus musculus
ctgtccgtctgtcgttcgctgtc

SEQ ID NO: 221228 - DNA, 21 bp, Mus musculus
gtaacagcttgtggtggtcca

SEQ ID NO: 221229 - DNA, 23 bp, Mus musculus
tgtctgcttgctactgagtaaga

SEQ ID NO: 221230 - DNA, 19 bp, Mus musculus
atcttgttctgaactgtgt

SEQ ID NO: 221231 - DNA, 18 bp, Mus musculus
tgaggaacttaaaggttg

SEQ ID NO: 221232 - DNA, 23 bp, Mus musculus
tttgaggttatgaatgtctttga

SEQ ID NO: 221233 - DNA, 23 bp, Mus musculus
gcgcctcacagtccctgtgtctg

SEQ ID NO: 221234 - DNA, 23 bp, Mus musculus
aagtatacaggggctggagagat

SEQ ID NO: 221235 - DNA, 23 bp, Mus musculus
tgtgtgtatgtatatatatgtgt

SEQ ID NO: 221236 - DNA, 23 bp, Mus musculus
taagctcctcatcatgccacagc

SEQ ID NO: 221237 - DNA, 22 bp, Mus musculus
tggctcagtggttaagagcagt

SEQ ID NO: 221238 - DNA, 21 bp, Mus musculus
aactgactgctcttccagagg

SEQ ID NO: 221239 - DNA, 20 bp, Mus musculus
atctatgtgtgtatgtgcat

SEQ ID NO: 221240 - DNA, 22 bp, Mus musculus
tgtgtatatttctatatgtgta

SEQ ID NO: 221241 - DNA, 21 bp, Mus musculus
tgtatctgtgtgcatatgtgt

SEQ ID NO: 221242 - DNA, 19 bp, Mus musculus
gatgtatgtatatatgatt

SEQ ID NO: 221243 - DNA, 23 bp, Mus musculus
tgtgtatgagtatatgatgtatg

SEQ ID NO: 221244 - DNA, 21 bp, Mus musculus
ttatgtgtatatgattatgtg

SEQ ID NO: 221245 - DNA, 20 bp, Mus musculus
tctgtctgtctctgcctccc

SEQ ID NO: 221246 - DNA, 23 bp, Mus musculus
gtctctcactctctgagggtctc

SEQ ID NO: 221247 - DNA, 21 bp, Mus musculus
tgagactctgcctcaagattc

SEQ ID NO: 221248 - DNA, 19 bp, Mus musculus
ctgactgctcttccagagg

SEQ ID NO: 221249 - DNA, 22 bp, Mus musculus
tagctgtcttgagatgcaccag

SEQ ID NO: 221250 - DNA, 23 bp, Mus musculus
gtgtgtgtgtgtgcaagtgcatg

SEQ ID NO: 221251 - DNA, 22 bp, Mus musculus
atgagcatgtatgtgtgtgtgt

SEQ ID NO: 221252 - DNA, 21 bp, Mus musculus
atatatgtatgtatatgtgtg

SEQ ID NO: 221253 - DNA, 22 bp, Mus musculus
atatgtgtgcatatatatttgt

SEQ ID NO: 221254 - DNA, 23 bp, Mus musculus
tgtgtcactgtgtgccagctttg

SEQ ID NO: 221255 - DNA, 23 bp, Mus musculus
tcaaggttgtgactcgcataggt

SEQ ID NO: 221256 - DNA, 22 bp, Mus musculus
tatgtgtatatgtatatatgag

SEQ ID NO: 221257 - DNA, 23 bp, Mus musculus
tatatgcatgtgtacatgtaatg

SEQ ID NO: 221258 - DNA, 22 bp, Mus musculus
tctatgtgtgtatatgtatgtg

SEQ ID NO: 221259 - DNA, 23 bp, Mus musculus
agagctagttgaatgtaatgttg

SEQ ID NO: 221260 - DNA, 19 bp, Mus musculus
agccccactagattagggt

SEQ ID NO: 221261 - DNA, 23 bp, Mus musculus
tttgagcattagaattgtgggtc

SEQ ID NO: 221262 - DNA, 20 bp, Mus musculus
gcctggctctttgctgctgt

SEQ ID NO: 221263 - DNA, 23 bp, Mus musculus
ttctgtgtctgtgtgcatggtgt

SEQ ID NO: 221264 - DNA, 21 bp, Mus musculus
agttctgtgcaacctctgtgt

SEQ ID NO: 221265 - DNA, 20 bp, Mus musculus
atacactggggctggagaga

SEQ ID NO: 221266 - DNA, 18 bp, Mus musculus
tgacccggaatagccatg

SEQ ID NO: 221267 - DNA, 23 bp, Mus musculus
agttttgaagttgctctgtgtgt

SEQ ID NO: 221268 - DNA, 22 bp, Mus musculus
ttaagagcactgactgctcttc

SEQ ID NO: 221269 - DNA, 18 bp, Mus musculus
gtgagtgtgtgtgtgcgc

SEQ ID NO: 221270 - DNA, 23 bp, Mus musculus
acagctgtctgtctgtctggccc

SEQ ID NO: 221271 - DNA, 23 bp, Mus musculus
ctgtctgtgtctgtcagtctgtg

SEQ ID NO: 221272 - DNA, 23 bp, Mus musculus
gctgtgtgtctatctgactgctt

SEQ ID NO: 221273 - DNA, 23 bp, Mus musculus
ttctggctgagttctgcaccaag

SEQ ID NO: 221274 - DNA, 23 bp, Mus musculus
gtgtgccaccatgcctagctgtt

SEQ ID NO: 221275 - DNA, 18 bp, Mus musculus
actcttgagccttgtcac

SEQ ID NO: 221276 - DNA, 23 bp, Mus musculus
atgtgtgtgtacatgtgttcttg

SEQ ID NO: 221277 - DNA, 23 bp, Mus musculus
tatatgtgtgtgcatatgtatgg

SEQ ID NO: 221278 - DNA, 18 bp, Mus musculus
tggcacagtgtatgtgtg

SEQ ID NO: 221279 - DNA, 23 bp, Mus musculus
cctagtccagctgctgctgtgag

SEQ ID NO: 221280 - DNA, 23 bp, Mus musculus
atgtgtgtgatgtatgtatgtat

SEQ ID NO: 221281 - DNA, 23 bp, Mus musculus
tctgtccctgtgtccctctgtcc

SEQ ID NO: 221282 - DNA, 23 bp, Mus musculus
ggctcactcacagtctggctcac

SEQ ID NO: 221283 - DNA, 23 bp, Mus musculus
ttgtctctctctaatgtcaagga

SEQ ID NO: 221284 - DNA, 23 bp, Mus musculus
ttccatcttgttgctcctttggt

SEQ ID NO: 221285 - DNA, 23 bp, Mus musculus
tctggctcactctgtctctccct

SEQ ID NO: 221286 - DNA, 23 bp, Mus musculus
gactctgtgttgttagggcagtg

SEQ ID NO: 221287 - DNA, 18 bp, Mus musculus
tggcacctagtggactct

SEQ ID NO: 221288 - DNA, 18 bp, Mus musculus
ctggccctggtgttgctg

SEQ ID NO: 221289 - DNA, 23 bp, Mus musculus
actctgtctgtctgtgtttctgg

SEQ ID NO: 221290 - DNA, 23 bp, Mus musculus
cactgtggctgtgacaaacacct

SEQ ID NO: 221291 - DNA, 23 bp, Mus musculus
caccctgtctgtgtctgtccgac

SEQ ID NO: 221292 - DNA, 23 bp, Mus musculus
aagtctctctatgtctcactcca

SEQ ID NO: 221293 - DNA, 23 bp, Mus musculus
aaacactgactgctcttccagag

SEQ ID NO: 221294 - DNA, 23 bp, Mus musculus
gtgtgtatctgtgtgtgggtctg

SEQ ID NO: 221295 - DNA, 23 bp, Mus musculus
tatgtacatgcatatgaatatgc

SEQ ID NO: 221296 - DNA, 22 bp, Mus musculus
atgtatgtatgcatgtgtgtac

SEQ ID NO: 221297 - DNA, 22 bp, Mus musculus
tgtatgtacatgtgcatgttca

SEQ ID NO: 221298 - DNA, 23 bp, Mus musculus
agtcaccctcacagtcacaatgt

SEQ ID NO: 221299 - DNA, 23 bp, Mus musculus
tcactctctctgtttctatggag

SEQ ID NO: 221300 - DNA, 23 bp, Mus musculus
tgtatatgtgtatgtatatgtat

SEQ ID NO: 221301 - DNA, 23 bp, Mus musculus
tgacctgagttctctctctgaga

SEQ ID NO: 221302 - DNA, 20 bp, Mus musculus
aagagtggtgtctgtcccca

SEQ ID NO: 221303 - DNA, 23 bp, Mus musculus
tgcgtgtgtgtatatatatatgc

SEQ ID NO: 221304 - DNA, 18 bp, Mus musculus
tgggcttacagtgtctgt

SEQ ID NO: 221305 - DNA, 18 bp, Mus musculus
gcttgtttctcagtctga

SEQ ID NO: 221306 - DNA, 23 bp, Mus musculus
tctctatatctcactgtctgatt

SEQ ID NO: 221307 - DNA, 19 bp, Mus musculus
tgcttagcacagggctctg

SEQ ID NO: 221308 - DNA, 23 bp, Mus musculus
gtctctgtctcgctgtctccttg

SEQ ID NO: 221309 - DNA, 20 bp, Mus musculus
agagggcttggtctatgtct

SEQ ID NO: 221310 - DNA, 18 bp, Mus musculus
catatccatcccctctct

SEQ ID NO: 221311 - DNA, 23 bp, Mus musculus
ggctgcctgggtccctgtaagca

SEQ ID NO: 221312 - DNA, 23 bp, Mus musculus
ctcccactgtctgtgcctgtgag

SEQ ID NO: 221313 - DNA, 23 bp, Mus musculus
gaggctgtctggctgagtggctc

SEQ ID NO: 221314 - DNA, 23 bp, Mus musculus
atgtgtatatatatatatgtctc

SEQ ID NO: 221315 - DNA, 23 bp, Mus musculus
tatgtgtgtatatacatgtgtgt

SEQ ID NO: 221316 - DNA, 23 bp, Mus musculus
ctctctgtgtgtgtctcagtcca

SEQ ID NO: 221317 - DNA, 23 bp, Mus musculus
agggactggagagatggctcagc

SEQ ID NO: 221318 - DNA, 23 bp, Mus musculus
tcagagcgcactgtgagtctctc

SEQ ID NO: 221319 - DNA, 21 bp, Mus musculus
actgtcacagactaacagggg

SEQ ID NO: 221320 - DNA, 22 bp, Mus musculus
tgacaggctttgtgactgacct

SEQ ID NO: 221321 - DNA, 23 bp, Mus musculus
taatggatcttgagctaagaggt

SEQ ID NO: 221322 - DNA, 22 bp, Mus musculus
acaggtctggggcttctagaag

SEQ ID NO: 221323 - DNA, 23 bp, Mus musculus
ctctctcagacaccccaactcct

SEQ ID NO: 221324 - DNA, 23 bp, Mus musculus
tgcagacagttgagtgctagcag

SEQ ID NO: 221325 - DNA, 20 bp, Mus musculus
tcttactgcaacttgttatg

SEQ ID NO: 221326 - DNA, 22 bp, Mus musculus
ctgtcacactgtgtgcctgtcc

SEQ ID NO: 221327 - DNA, 23 bp, Mus musculus
tgcattaggtggtatatacatga

SEQ ID NO: 221328 - DNA, 23 bp, Mus musculus
gagcctgcctgcctgcctgggtg

SEQ ID NO: 221329 - DNA, 23 bp, Mus musculus
ggatggcagaagagacagggctg

SEQ ID NO: 221330 - DNA, 21 bp, Mus musculus
tatcgctctcctggttcttac

SEQ ID NO: 221331 - DNA, 23 bp, Mus musculus
ttaagcctcagcctttcaggagt

SEQ ID NO: 221332 - DNA, 21 bp, Mus musculus
atggctccttttgaagacttg

SEQ ID NO: 221333 - DNA, 18 bp, Mus musculus
tcaaggtctcaaagagtc

SEQ ID NO: 221334 - DNA, 22 bp, Mus musculus
atgcctggctctttgcttggtt

SEQ ID NO: 221335 - DNA, 23 bp, Mus musculus
atgtatgtatgtatgtatgtaca

SEQ ID NO: 221336 - DNA, 18 bp, Mus musculus
actggcactctgtgagtc

SEQ ID NO: 221337 - DNA, 22 bp, Mus musculus
gatgaatctcactcacagtatc

SEQ ID NO: 221338 - DNA, 19 bp, Mus musculus
cagtggggatcctggtact

SEQ ID NO: 221339 - DNA, 23 bp, Mus musculus
ctgtcttgtgttccagacactgg

SEQ ID NO: 221340 - DNA, 22 bp, Mus musculus
tgttttgtgaccaattatatgg

SEQ ID NO: 221341 - DNA, 18 bp, Mus musculus
tcagagaagtgactgtgg

SEQ ID NO: 221342 - DNA, 23 bp, Mus musculus
tctgtatgtatatctatatctat

SEQ ID NO: 221343 - DNA, 19 bp, Mus musculus
atatacacacagatataca

SEQ ID NO: 221344 - DNA, 23 bp, Mus musculus
tgtgtgtatatttatatctgtgt

SEQ ID NO: 221345 - DNA, 23 bp, Mus musculus
gctttgtgaagatctccatgtct

SEQ ID NO: 221346 - DNA, 18 bp, Mus musculus
tgactggtcatactgagg

SEQ ID NO: 221347 - DNA, 22 bp, Mus musculus
tgttttgtgaccaattatatgg

SEQ ID NO: 221348 - DNA, 22 bp, Mus musculus
tgttttgtgaccaattatatgg

SEQ ID NO: 221349 - DNA, 22 bp, Mus musculus
tgttttgtgaccaattatatgg

SEQ ID NO: 221350 - DNA, 23 bp, Mus musculus
actccatgaacatgcccttttct

SEQ ID NO: 221351 - DNA, 23 bp, Mus musculus
gatatcacactctttttctgtct

SEQ ID NO: 221352 - DNA, 22 bp, Mus musculus
tgttttgtgaccaattatatgg

SEQ ID NO: 221353 - DNA, 23 bp, Mus musculus
gcagagcctgtctctgactctgt

SEQ ID NO: 221354 - DNA, 20 bp, Mus musculus
tgttttgaatacctgatgta

SEQ ID NO: 221355 - DNA, 22 bp, Mus musculus
aataaccatccagaagcattga

SEQ ID NO: 221356 - DNA, 23 bp, Mus musculus
tgtgaggctctgtcagtgcctga

SEQ ID NO: 221357 - DNA, 23 bp, Mus musculus
gtgatcagataggatccatgaga

SEQ ID NO: 221358 - DNA, 22 bp, Mus musculus
tgttttgtgagcaattatatgg

SEQ ID NO: 221359 - DNA, 23 bp, Mus musculus
tcacagtctgtggctcagagcct

SEQ ID NO: 221360 - DNA, 18 bp, Mus musculus
tgtgaagatcaaaatgtt

SEQ ID NO: 221361 - DNA, 22 bp, Mus musculus
tgttttgtgaccaattatatgg

SEQ ID NO: 221362 - DNA, 23 bp, Mus musculus
agacattggacatttttgctgat

SEQ ID NO: 221363 - DNA, 23 bp, Mus musculus
attaatttttcttcagccaggga

SEQ ID NO: 221364 - DNA, 23 bp, Mus musculus
tttgtgtgagcatatgtatatgt

SEQ ID NO: 221365 - DNA, 23 bp, Mus musculus
ttagatatacattttcttctggt

SEQ ID NO: 221366 - DNA, 19 bp, Mus musculus
tcctggagggcaatgctgt

SEQ ID NO: 221367 - DNA, 21 bp, Mus musculus
tgtaggaagagagtgagcagt

SEQ ID NO: 221368 - DNA, 23 bp, Mus musculus
tgtagtgggattgcttcaagttt

SEQ ID NO: 221369 - DNA, 22 bp, Mus musculus
tgttttgtgaccaattatatgg

SEQ ID NO: 221370 - DNA, 23 bp, Mus musculus
taagtactgggagagctgtctct

SEQ ID NO: 221371 - DNA, 22 bp, Mus musculus
tgttttgtgaccaattatatgg

SEQ ID NO: 221372 - DNA, 22 bp, Mus musculus
tgttttgtgaccaattatatgg

SEQ ID NO: 221373 - DNA, 23 bp, Mus musculus
acacagttatcatttacagtgat

SEQ ID NO: 221374 - DNA, 21 bp, Mus musculus
ttcatgaggaaaattgatctg

SEQ ID NO: 221375 - DNA, 21 bp, Mus musculus
ttgagtctggttttcttcttc

SEQ ID NO: 221376 - DNA, 22 bp, Mus musculus
tatgcatgtatgtatatatgta

SEQ ID NO: 221377 - DNA, 23 bp, Mus musculus
tcagtgctatagcagctgatgga

SEQ ID NO: 221378 - DNA, 23 bp, Mus musculus
ttcatccaagtctctctgcctca

SEQ ID NO: 221379 - DNA, 23 bp, Mus musculus
tcagggtgtctgtctgtgtgttc

SEQ ID NO: 221380 - DNA, 23 bp, Mus musculus
attctctcataatttattctgtt

SEQ ID NO: 221381 - DNA, 20 bp, Mus musculus
aatggctcagggtgtcagga

SEQ ID NO: 221382 - DNA, 23 bp, Mus musculus
tctgactgctattgaaatcactg

SEQ ID NO: 221383 - DNA, 22 bp, Mus musculus
tgttttgtgaccaattatatgg

SEQ ID NO: 221384 - DNA, 23 bp, Mus musculus
gtgtgtgcatgtgtgtgtgtatg

SEQ ID NO: 221385 - DNA, 23 bp, Mus musculus
tatgtgaatgtcatattgcagct

SEQ ID NO: 221386 - DNA, 22 bp, Mus musculus
tgttttgtgaccaattatatgg

SEQ ID NO: 221387 - DNA, 19 bp, Mus musculus
tgtatatatgtatatgtgt

SEQ ID NO: 221388 - DNA, 23 bp, Mus musculus
tatgtatgtgttatgtatgtgta

SEQ ID NO: 221389 - DNA, 23 bp, Mus musculus
taaagttctgaatttcatgttct

SEQ ID NO: 221390 - DNA, 23 bp, Mus musculus
aggaaatgacagaaaactactga

SEQ ID NO: 221391 - DNA, 23 bp, Mus musculus
aaatcaatatttcttcttttgaa

SEQ ID NO: 221392 - DNA, 23 bp, Mus musculus
tgactgtgtctgtctatcttgtc

SEQ ID NO: 221393 - DNA, 23 bp, Mus musculus
atttacatactatttgaaatgtc

SEQ ID NO: 221394 - DNA, 23 bp, Mus musculus
tgtagaacagcttgtggtgtgga

SEQ ID NO: 221395 - DNA, 23 bp, Mus musculus
ctgagtggctgagtgggtggctc

SEQ ID NO: 221396 - DNA, 23 bp, Mus musculus
aggctgagtgagaagactgtgcc

SEQ ID NO: 221397 - DNA, 20 bp, Mus musculus
tagctctgcctagtgactgt

SEQ ID NO: 221398 - DNA, 23 bp, Mus musculus
gacatgatcctgcaggcagtttt

SEQ ID NO: 221399 - DNA, 23 bp, Mus musculus
gagactctgtctgtctgtctgtc

SEQ ID NO: 221400 - DNA, 18 bp, Mus musculus
gcgtgtgtgtgtgggtgt

SEQ ID NO: 221401 - DNA, 23 bp, Mus musculus
acccagacaggcttacatgtgtg

SEQ ID NO: 221402 - DNA, 23 bp, Mus musculus
tatgtctgtgtgtgactgtgtgt

SEQ ID NO: 221403 - DNA, 22 bp, Mus musculus
cttttgatcctcctgtctctga

SEQ ID NO: 221404 - DNA, 23 bp, Mus musculus
tcactgcctgtcagcctcactgg

SEQ ID NO: 221405 - DNA, 22 bp, Mus musculus
agtgacagctactccatgaggt

SEQ ID NO: 221406 - DNA, 22 bp, Mus musculus
gagagttagttcagggcctggt

SEQ ID NO: 221407 - DNA, 19 bp, Mus musculus
agacttcagtgagagcaga

SEQ ID NO: 221408 - DNA, 19 bp, Mus musculus
agtcaccgtctctgagtgt

SEQ ID NO: 221409 - DNA, 19 bp, Mus musculus
tcatgactggtctttggat

SEQ ID NO: 221410 - DNA, 20 bp, Mus musculus
tctctccctccatctcacag

SEQ ID NO: 221411 - DNA, 23 bp, Mus musculus
tgtctgtctctgtgactcctcta

SEQ ID NO: 221412 - DNA, 18 bp, Mus musculus
tgggtgtggctgtggaca

SEQ ID NO: 221413 - DNA, 23 bp, Mus musculus
tctctgagtcactgagtaaggcc

SEQ ID NO: 221414 - DNA, 21 bp, Mus musculus
tgcagagctagagagaactat

SEQ ID NO: 221415 - DNA, 23 bp, Mus musculus
tccctgtccctgtccactcacag

SEQ ID NO: 221416 - DNA, 23 bp, Mus musculus
tatagtgtgtatatgtatatcta

SEQ ID NO: 221417 - DNA, 22 bp, Mus musculus
tgtgtgtacatgtatatgtatg

SEQ ID NO: 221418 - DNA, 21 bp, Mus musculus
agtctctcagtcagcctgtgt

SEQ ID NO: 221419 - DNA, 19 bp, Mus musculus
acagagtggtgactgtcca

SEQ ID NO: 221420 - DNA, 23 bp, Mus musculus
cactcaagacagtgtccacagga

SEQ ID NO: 221421 - DNA, 23 bp, Mus musculus
acagagcttccagaatgctgtga

SEQ ID NO: 221422 - DNA, 22 bp, Mus musculus
cttctctgtgtgattgctgcct

SEQ ID NO: 221423 - DNA, 19 bp, Mus musculus
gagtactgagtgtattgag

SEQ ID NO: 221424 - DNA, 23 bp, Mus musculus
cactctgggtgtgtcagcccttg

SEQ ID NO: 221425 - DNA, 23 bp, Mus musculus
tcctgagtgtggctatcttaggc

SEQ ID NO: 221426 - DNA, 20 bp, Mus musculus
attctggttgctgtgggcgc

SEQ ID NO: 221427 - DNA, 20 bp, Mus musculus
aagagcactgactgctcttc

SEQ ID NO: 221428 - DNA, 19 bp, Mus musculus
gcatgtatgtatgtatgta

SEQ ID NO: 221429 - DNA, 23 bp, Mus musculus
gtatgcatgcatgcatgtatgtg

SEQ ID NO: 221430 - DNA, 23 bp, Mus musculus
cttctgtctcagtcagctgcttg

SEQ ID NO: 221431 - DNA, 23 bp, Mus musculus
tttcactgtctggatcttgtttt

SEQ ID NO: 221432 - DNA, 23 bp, Mus musculus
ctctctgcctctgaaaatggact

SEQ ID NO: 221433 - DNA, 20 bp, Mus musculus
tgtgtggacttgagaaccta

SEQ ID NO: 221434 - DNA, 21 bp, Mus musculus
attaagcctgtgccagctttg

SEQ ID NO: 221435 - DNA, 21 bp, Mus musculus
tatgtgtatatatatgaatgt

SEQ ID NO: 221436 - DNA, 22 bp, Mus musculus
tgcattatatatatgtatgcat

SEQ ID NO: 221437 - DNA, 22 bp, Mus musculus
tggcatgctatgggcatagcag

SEQ ID NO: 221438 - DNA, 23 bp, Mus musculus
tatatgcatatatacacacgtgt

SEQ ID NO: 221439 - DNA, 22 bp, Mus musculus
ccctgggtcactggctctttct

SEQ ID NO: 221440 - DNA, 23 bp, Mus musculus
acattgctagaactttctgggat

SEQ ID NO: 221441 - DNA, 21 bp, Mus musculus
tggcactggtaaatctctctg

SEQ ID NO: 221442 - DNA, 21 bp, Mus musculus
atatatgtgtatatctatatc

SEQ ID NO: 221443 - DNA, 22 bp, Mus musculus
cacagaagtgactgttcacagg

SEQ ID NO: 221444 - DNA, 22 bp, Mus musculus
ggtgaactgcattctctgagtg

SEQ ID NO: 221445 - DNA, 19 bp, Mus musculus
tcaggtagatcccagtgct

SEQ ID NO: 221446 - DNA, 23 bp, Mus musculus
gaatgtggatgtaataagaccaa

SEQ ID NO: 221447 - DNA, 23 bp, Mus musculus
gatggtgagcttcatggtgctgt

SEQ ID NO: 221448 - DNA, 23 bp, Mus musculus
agagacatgaaactcagcacacc

SEQ ID NO: 221449 - DNA, 23 bp, Mus musculus
gtaagtaagtatgtatgtgagtg

SEQ ID NO: 221450 - DNA, 23 bp, Mus musculus
catatttacatgtatatgttagg

SEQ ID NO: 221451 - DNA, 23 bp, Mus musculus
gtatatgtatatgtatatgtgtg

SEQ ID NO: 221452 - DNA, 22 bp, Mus musculus
attgtgtgtgcatgtgcatgtg

SEQ ID NO: 221453 - DNA, 23 bp, Mus musculus
cagtcagtcagtgcatgtgcttt

SEQ ID NO: 221454 - DNA, 23 bp, Mus musculus
tgactacatacaatgtgtatgta

SEQ ID NO: 221455 - DNA, 22 bp, Mus musculus
tctctcagtacagcgaccagct

SEQ ID NO: 221456 - DNA, 23 bp, Mus musculus
tctgtcttcaggcatctgtctag

SEQ ID NO: 221457 - DNA, 18 bp, Mus musculus
acagtctgtgctatagtt

SEQ ID NO: 221458 - DNA, 22 bp, Mus musculus
tggaggcttgtgttacagctgt

SEQ ID NO: 221459 - DNA, 23 bp, Mus musculus
caattcaccctttgccacactat

SEQ ID NO: 221460 - DNA, 23 bp, Mus musculus
tctctgcctgtctctgtggttgg

SEQ ID NO: 221461 - DNA, 23 bp, Mus musculus
tttctggtggtattttttgggat

SEQ ID NO: 221462 - DNA, 23 bp, Mus musculus
tcagtatgtatgtatatatgtat

SEQ ID NO: 221463 - DNA, 23 bp, Mus musculus
gtctgtcgctcagtgtctcatct

SEQ ID NO: 221464 - DNA, 23 bp, Mus musculus
tgtctgtctgtctgtctatttgc

SEQ ID NO: 221465 - DNA, 23 bp, Mus musculus
gaattgagaggagaaagtgagct

SEQ ID NO: 221466 - DNA, 23 bp, Mus musculus
tgtctgtgtctgtgtctgtgtct

SEQ ID NO: 221467 - DNA, 23 bp, Mus musculus
tgtatatgtgcatgtgtatatgt

SEQ ID NO: 221468 - DNA, 23 bp, Mus musculus
atgtatgtgtatgtatgttgtgt

SEQ ID NO: 221469 - DNA, 23 bp, Mus musculus
atgtgtgtgtctttatgtctgtc

SEQ ID NO: 221470 - DNA, 18 bp, Mus musculus
tgtgtgtgtgtgtgtgtg

SEQ ID NO: 221471 - DNA, 23 bp, Mus musculus
gtctctgtgtgtccgactctgtc

SEQ ID NO: 221472 - DNA, 22 bp, Mus musculus
atatatgtgtgattatgtatac

SEQ ID NO: 221473 - DNA, 22 bp, Mus musculus
tgttttgtgaccaattatatgg

SEQ ID NO: 221474 - DNA, 22 bp, Mus musculus
atatatgtatatatgtataagt

SEQ ID NO: 221475 - DNA, 23 bp, Mus musculus
agtttctgcatctccctgtgcct

SEQ ID NO: 221476 - DNA, 22 bp, Mus musculus
tgttttgtgaccaattatatgg

SEQ ID NO: 221477 - DNA, 22 bp, Mus musculus
tgttttgtgaccaattatatgg

SEQ ID NO: 221478 - DNA, 23 bp, Mus musculus
gtgaggcagatgtgtgtgaccac

SEQ ID NO: 221479 - DNA, 23 bp, Mus musculus
agatgtgtgtgttctgtatgtgt

SEQ ID NO: 221480 - DNA, 23 bp, Mus musculus
tataaggcagtatatgattttat

SEQ ID NO: 221481 - DNA, 21 bp, Mus musculus
caagttatctctgattggtga

SEQ ID NO: 221482 - DNA, 23 bp, Mus musculus
tctagagacttgactcggacaga

SEQ ID NO: 221483 - DNA, 22 bp, Mus musculus
atggcaatatatatgtatgtgt

SEQ ID NO: 221484 - DNA, 23 bp, Mus musculus
tctgtgtctgtcagtgtctgtct

SEQ ID NO: 221485 - DNA, 18 bp, Mus musculus
tatatgtatgtatatgta

SEQ ID NO: 221486 - DNA, 21 bp, Mus musculus
tatgtgtgtatatatgtgtgt

SEQ ID NO: 221487 - DNA, 23 bp, Mus musculus
tatgtatatatatatatgtgtac

SEQ ID NO: 221488 - DNA, 23 bp, Mus musculus
tctctggctgtcctagaactcac

SEQ ID NO: 221489 - DNA, 23 bp, Mus musculus
tctgtctgtctatctgtctgtga

SEQ ID NO: 221490 - DNA, 23 bp, Mus musculus
gtaaatgtatatgtatatgtctg

SEQ ID NO: 221491 - DNA, 23 bp, Mus musculus
tatgtgtatgtatatgtatgtca

SEQ ID NO: 221492 - DNA, 23 bp, Mus musculus
gcactgactgctcttccagaggt

SEQ ID NO: 221493 - DNA, 18 bp, Mus musculus
tcagtgaagactaagctc

SEQ ID NO: 221494 - DNA, 23 bp, Mus musculus
tggcagagagattagtgtgtgtg

SEQ ID NO: 221495 - DNA, 19 bp, Mus musculus
tattctcttccttctccct

SEQ ID NO: 221496 - DNA, 23 bp, Mus musculus
tgaagacagaacacacttagcac

SEQ ID NO: 221497 - DNA, 23 bp, Mus musculus
ctgtctgtgtcactgtccccaaa

SEQ ID NO: 221498 - DNA, 22 bp, Mus musculus
tcagggggagaagtattagtta

SEQ ID NO: 221499 - DNA, 23 bp, Mus musculus
aaactgcaacacacactctgtct

SEQ ID NO: 221500 - DNA, 20 bp, Mus musculus
atctgctgtggctccaggct

SEQ ID NO: 221501 - DNA, 23 bp, Mus musculus
atgtatatgagcatgtgtacgtg

SEQ ID NO: 221502 - DNA, 23 bp, Mus musculus
agtatgtgtatatgtatatgagt

SEQ ID NO: 221503 - DNA, 23 bp, Mus musculus
attctgcctgtctctgtctgact

SEQ ID NO: 221504 - DNA, 23 bp, Mus musculus
attctgcctgtctctgtctgact

SEQ ID NO: 221505 - DNA, 23 bp, Mus musculus
ccctgactctgtctctgacttgg

SEQ ID NO: 221506 - DNA, 23 bp, Mus musculus
ctgaagtgtgagagctcaggtag

SEQ ID NO: 221507 - DNA, 21 bp, Mus musculus
tctctttgtctgttattggta

SEQ ID NO: 221508 - DNA, 23 bp, Mus musculus
gactgactgtctgtctgctctgt

SEQ ID NO: 221509 - DNA, 22 bp, Mus musculus
aagaaaagtctgttttctcaag

SEQ ID NO: 221510 - DNA, 23 bp, Mus musculus
tgtcaacagtctctgtcaggaac

SEQ ID NO: 221511 - DNA, 19 bp, Mus musculus
cttgtgtctggacaggctg

SEQ ID NO: 221512 - DNA, 23 bp, Mus musculus
tgcctgcctgcctgcctgcctgc

SEQ ID NO: 221513 - DNA, 23 bp, Mus musculus
tatgtatatatatatgtgtgtgt

SEQ ID NO: 221514 - DNA, 23 bp, Mus musculus
tgagtgtgagtgactctaaaacg

SEQ ID NO: 221515 - DNA, 23 bp, Mus musculus
gtcctcacagtcagtcactgtta

SEQ ID NO: 221516 - DNA, 23 bp, Mus musculus
ctctctctttcccactggtttct

SEQ ID NO: 221517 - DNA, 23 bp, Mus musculus
agctgcctctgagaccctgagac

SEQ ID NO: 221518 - DNA, 22 bp, Mus musculus
gcactgactgctcttccagagg

SEQ ID NO: 221519 - DNA, 23 bp, Mus musculus
gagacaagagagtctgcacatgg

SEQ ID NO: 221520 - DNA, 23 bp, Mus musculus
tgttactctcagacttttccaat

SEQ ID NO: 221521 - DNA, 23 bp, Mus musculus
tggtgactgaaggcagtagctga

SEQ ID NO: 221522 - DNA, 19 bp, Mus musculus
tctgcctgtgattggggca

SEQ ID NO: 221523 - DNA, 23 bp, Mus musculus
taagggtgatgactgggggaact

SEQ ID NO: 221524 - DNA, 23 bp, Mus musculus
tcactcacactgcctctctgaag

SEQ ID NO: 221525 - DNA, 18 bp, Mus musculus
tgtgtgtgtatacacatg

SEQ ID NO: 221526 - DNA, 19 bp, Mus musculus
cacatgtatgtatgtgtgt

SEQ ID NO: 221527 - DNA, 23 bp, Mus musculus
gacagacacactggctgagctct

SEQ ID NO: 221528 - DNA, 23 bp, Mus musculus
caactgtctgccattctgggttg

SEQ ID NO: 221529 - DNA, 23 bp, Mus musculus
taacagacagcagagtgagcaca

SEQ ID NO: 221530 - DNA, 23 bp, Mus musculus
taaatgtgtgtggaagagatctg

SEQ ID NO: 221531 - DNA, 19 bp, Mus musculus
acacccacagagacatctt

SEQ ID NO: 221532 - DNA, 20 bp, Mus musculus
agactgaagtgactggggac

SEQ ID NO: 221533 - DNA, 20 bp, Mus musculus
tcactcacctttacttcaca

SEQ ID NO: 221534 - DNA, 21 bp, Mus musculus
acagcttcttcaatgagatat

SEQ ID NO: 221535 - DNA, 23 bp, Mus musculus
ctattgtcatattgttgtagtct

SEQ ID NO: 221536 - DNA, 22 bp, Mus musculus
gaatgtctgtctgtctgtctgt

SEQ ID NO: 221537 - DNA, 22 bp, Mus musculus
tccatatctatatatgtatatg

SEQ ID NO: 221538 - DNA, 22 bp, Mus musculus
tcaaagggacatgtagggctct

SEQ ID NO: 221539 - DNA, 23 bp, Mus musculus
atgcagctcagtgaggatggagt

SEQ ID NO: 221540 - DNA, 23 bp, Mus musculus
catctgtccgtctgtctgtccgt

SEQ ID NO: 221541 - DNA, 20 bp, Mus musculus
tgtctctgcgtttgtctctc

SEQ ID NO: 221542 - DNA, 22 bp, Mus musculus
agtaattcggctaggtattcag

SEQ ID NO: 221543 - DNA, 22 bp, Mus musculus
tgttttgtgaccaattatatgg

SEQ ID NO: 221544 - DNA, 22 bp, Mus musculus
tgttttgtgaccaattatatgg

SEQ ID NO: 221545 - DNA, 23 bp, Mus musculus
ttcagacaggtacaattatgggt

SEQ ID NO: 221546 - DNA, 18 bp, Mus musculus
ctctccctcatttgatgc

SEQ ID NO: 221547 - DNA, 19 bp, Mus musculus
tatgtgtgcatgttcatgt

SEQ ID NO: 221548 - DNA, 23 bp, Mus musculus
tgtatatatgtagcagaagtaca

SEQ ID NO: 221549 - DNA, 18 bp, Mus musculus
acagaactgtctcatgtg

SEQ ID NO: 221550 - DNA, 22 bp, Mus musculus
tatgtgtatatgtatatatgtg

SEQ ID NO: 221551 - DNA, 21 bp, Mus musculus
tatgtgtatatgtatatatgt

SEQ ID NO: 221552 - DNA, 20 bp, Mus musculus
tatgtgtgtgtatatgtata

SEQ ID NO: 221553 - DNA, 23 bp, Mus musculus
tgtgtgtgtgtgtgtgtgtacat

SEQ ID NO: 221554 - DNA, 22 bp, Mus musculus
tagtgaactctaatagctgact

SEQ ID NO: 221555 - DNA, 18 bp, Mus musculus
ctgaagagacagctcagt

SEQ ID NO: 221556 - DNA, 18 bp, Mus musculus
agagcactgactgctctt

SEQ ID NO: 221557 - DNA, 23 bp, Mus musculus
ggagagaagtgagcctgcacaca

SEQ ID NO: 221558 - DNA, 20 bp, Mus musculus
tgtgacatcacagtgtgcac

SEQ ID NO: 221559 - DNA, 23 bp, Mus musculus
acagtggagtagtgtgacaccac

SEQ ID NO: 221560 - DNA, 21 bp, Mus musculus
ctatgactgtacagtggagca

SEQ ID NO: 221561 - DNA, 18 bp, Mus musculus
acagagcagaactgtgac

SEQ ID NO: 221562 - DNA, 23 bp, Mus musculus
caatgtgacacaacagtggagca

SEQ ID NO: 221563 - DNA, 18 bp, Mus musculus
atgatggtctgataggat

SEQ ID NO: 221564 - DNA, 22 bp, Mus musculus
tgttttgtgaccaattatatgg

SEQ ID NO: 221565 - DNA, 22 bp, Mus musculus
attgtgagaagtgagtcagctg

SEQ ID NO: 221566 - DNA, 22 bp, Mus musculus
tgttttgtgaccaattatatgg

SEQ ID NO: 221567 - DNA, 22 bp, Mus musculus
tgttttgtgaccaattatatgg

SEQ ID NO: 221568 - DNA, 20 bp, Mus musculus
tgggagatgtttctgaattg

SEQ ID NO: 221569 - DNA, 19 bp, Mus musculus
acagtgcttttacttttca

SEQ ID NO: 221570 - DNA, 23 bp, Mus musculus
gtcactatctctctctctctcac

SEQ ID NO: 221571 - DNA, 20 bp, Mus musculus
agctgctgttatttgtttat

SEQ ID NO: 221572 - DNA, 22 bp, Mus musculus
actctgtccctgtgtcagcctg

SEQ ID NO: 221573 - DNA, 20 bp, Mus musculus
tctgtctgtttctctcaggt

SEQ ID NO: 221574 - DNA, 19 bp, Mus musculus
tcagtgtgtgtctgttact

SEQ ID NO: 221575 - DNA, 22 bp, Mus musculus
aggttttgatagcaagtacttt

SEQ ID NO: 221576 - DNA, 23 bp, Mus musculus
tcatatctcaggcagattacagg

SEQ ID NO: 221577 - DNA, 23 bp, Mus musculus
ctcagcctgactgtcaccctcag

SEQ ID NO: 221578 - DNA, 22 bp, Mus musculus
tgttttgtgaccaattatatgg

SEQ ID NO: 221579 - DNA, 23 bp, Mus musculus
tgactagactcagaatcaccatg

SEQ ID NO: 221580 - DNA, 19 bp, Mus musculus
gggaggctctgtgaagcag

SEQ ID NO: 221581 - DNA, 23 bp, Mus musculus
caaactgcatgtgtatgtgtgtg

SEQ ID NO: 221582 - DNA, 19 bp, Mus musculus
gtgtgtatgcatgtgtggt

SEQ ID NO: 221583 - DNA, 23 bp, Mus musculus
atgtgtgtgcatatgtatgcatg

SEQ ID NO: 221584 - DNA, 23 bp, Mus musculus
aggcttccatatgctctgtttgt

SEQ ID NO: 221585 - DNA, 22 bp, Mus musculus
ttattttgatcttctgatagct

SEQ ID NO: 221586 - DNA, 23 bp, Mus musculus
atgtatgtatgtatgtatgtatg

SEQ ID NO: 221587 - DNA, 23 bp, Mus musculus
ctgtatgtgtctgtgtctgtgtg

SEQ ID NO: 221588 - DNA, 18 bp, Mus musculus
acacctatacaaaggcta

SEQ ID NO: 221589 - DNA, 19 bp, Mus musculus
tgtgcaattttttttttgt

SEQ ID NO: 221590 - DNA, 23 bp, Mus musculus
tgtctgtctgtctgtctgtgatt

SEQ ID NO: 221591 - DNA, 23 bp, Mus musculus
tgtatatatgtgtgcatatgcat

SEQ ID NO: 221592 - DNA, 23 bp, Mus musculus
tttaaaggtctgatagaattctg

SEQ ID NO: 221593 - DNA, 23 bp, Mus musculus
atgtatatgtatatgtatatgta

SEQ ID NO: 221594 - DNA, 22 bp, Mus musculus
atctatgcatatatatgttatg

SEQ ID NO: 221595 - DNA, 21 bp, Mus musculus
tgcatcaggccattgctgtgc

SEQ ID NO: 221596 - DNA, 23 bp, Mus musculus
ccagtgccactctgtttgtctca

SEQ ID NO: 221597 - DNA, 20 bp, Mus musculus
aagagcactgactgctcttc

SEQ ID NO: 221598 - DNA, 23 bp, Mus musculus
ctgtgtctgtgtctgtgcctgtg

SEQ ID NO: 221599 - DNA, 18 bp, Mus musculus
tctctgtgtatgtgtctg

SEQ ID NO: 221600 - DNA, 21 bp, Mus musculus
atggagtgagcttaaattttc

SEQ ID NO: 221601 - DNA, 23 bp, Mus musculus
ccactcacagacaggcagtctct

SEQ ID NO: 221602 - DNA, 18 bp, Mus musculus
gtgctgctggggctggag

SEQ ID NO: 221603 - DNA, 18 bp, Mus musculus
ttagagctatatgcaaaa

SEQ ID NO: 221604 - DNA, 23 bp, Mus musculus
agtgattcttcatgttcatgtat

SEQ ID NO: 221605 - DNA, 23 bp, Mus musculus
ctacccagtgaacagacaaggaa

SEQ ID NO: 221606 - DNA, 23 bp, Mus musculus
tctctgtgactggatgacatctg

SEQ ID NO: 221607 - DNA, 19 bp, Mus musculus
agcttggacttcatgtggg

SEQ ID NO: 221608 - DNA, 21 bp, Mus musculus
ttctcctacctatactgcctg

SEQ ID NO: 221609 - DNA, 23 bp, Mus musculus
tttctcaggctctgtctgcctcc

SEQ ID NO: 221610 - DNA, 23 bp, Mus musculus
tagtccatgatgatctgatagga

SEQ ID NO: 221611 - DNA, 23 bp, Mus musculus
aatatttatgtatctgttgaggc

SEQ ID NO: 221612 - DNA, 21 bp, Mus musculus
atgtatatataaatgtgtata

SEQ ID NO: 221613 - DNA, 23 bp, Mus musculus
gtgtgtgcctctgtgtgtgtgca

SEQ ID NO: 221614 - DNA, 22 bp, Mus musculus
tgtgagacaactcagtgtccag

SEQ ID NO: 221615 - DNA, 19 bp, Mus musculus
tagtaaagattcttatgtg

SEQ ID NO: 221616 - DNA, 23 bp, Mus musculus
tgtatgtatgtgcatgtacatgt

SEQ ID NO: 221617 - DNA, 18 bp, Mus musculus
tgtatgtgcatgtacatg

SEQ ID NO: 221618 - DNA, 23 bp, Mus musculus
ggactgggtaatttttgagatga

SEQ ID NO: 221619 - DNA, 23 bp, Mus musculus
ttgaagatcagaagatttggtga

SEQ ID NO: 221620 - DNA, 23 bp, Mus musculus
agagaacaatctcagctgtcatt

SEQ ID NO: 221621 - DNA, 23 bp, Mus musculus
tgacaagagacatggttttttgg

SEQ ID NO: 221622 - DNA, 21 bp, Mus musculus
tcactgtcctaccctaagtct

SEQ ID NO: 221623 - DNA, 23 bp, Mus musculus
tgtgtctcagtgagaaatctttg

SEQ ID NO: 221624 - DNA, 22 bp, Mus musculus
tcgatttctctctgtctctggg

SEQ ID NO: 221625 - DNA, 22 bp, Mus musculus
agtatccataatgtatgttcta

SEQ ID NO: 221626 - DNA, 22 bp, Mus musculus
cttctcagtgaccagacattgt

SEQ ID NO: 221627 - DNA, 22 bp, Mus musculus
tgttttgtgaccaattatatgg

SEQ ID NO: 221628 - DNA, 23 bp, Mus musculus
tgcctgccaccctcttagctatc

SEQ ID NO: 221629 - DNA, 23 bp, Mus musculus
ctgactgcttcatgaatgtatta

SEQ ID NO: 221630 - DNA, 20 bp, Mus musculus
tatactttcctaggagagtc

SEQ ID NO: 221631 - DNA, 20 bp, Mus musculus
tgctggctgaactgtgtctg

SEQ ID NO: 221632 - DNA, 23 bp, Mus musculus
tagtccatggtgatctgatagga

SEQ ID NO: 221633 - DNA, 21 bp, Mus musculus
tccatggtgatctgataggat

SEQ ID NO: 221634 - DNA, 18 bp, Mus musculus
acactgtatgtttttttt

SEQ ID NO: 221635 - DNA, 23 bp, Mus musculus
tttgcagaggaagaggaggtgca

SEQ ID NO: 221636 - DNA, 20 bp, Mus musculus
agtgtacaaatcaggctgga

SEQ ID NO: 221637 - DNA, 19 bp, Mus musculus
ttaagtgcactgactgctc

SEQ ID NO: 221638 - DNA, 23 bp, Mus musculus
tgtgatcctggttgtgtcagaac

SEQ ID NO: 221639 - DNA, 23 bp, Mus musculus
tctgtgaccctgtgattctggga

SEQ ID NO: 221640 - DNA, 23 bp, Mus musculus
agtgagaggtgtactgtgtgaca

SEQ ID NO: 221641 - DNA, 19 bp, Mus musculus
gatgaatgtgtacctgtat

SEQ ID NO: 221642 - DNA, 23 bp, Mus musculus
ctgtgtgtatgtgtgactgtgtg

SEQ ID NO: 221643 - DNA, 21 bp, Mus musculus
atatgaatgatacctcatact

SEQ ID NO: 221644 - DNA, 22 bp, Mus musculus
tggtctcagtctatgtactggg

SEQ ID NO: 221645 - DNA, 23 bp, Mus musculus
ttacacagtacacttgcagtgac

SEQ ID NO: 221646 - DNA, 23 bp, Mus musculus
atgtatgtatatgtattgctgga

SEQ ID NO: 221647 - DNA, 21 bp, Mus musculus
atgtgtttgtatatgtggtgt

SEQ ID NO: 221648 - DNA, 22 bp, Mus musculus
tttgtatgtgtgcaagtgcatg

SEQ ID NO: 221649 - DNA, 22 bp, Mus musculus
ctgagtgtggttgctgctgcct

SEQ ID NO: 221650 - DNA, 18 bp, Mus musculus
aaggaagattactttaga

SEQ ID NO: 221651 - DNA, 23 bp, Mus musculus
tgtctgtgactccagttccaggg

SEQ ID NO: 221652 - DNA, 22 bp, Mus musculus
tctgcttgcagttggtgacctc

SEQ ID NO: 221653 - DNA, 22 bp, Mus musculus
tgttttgtgaccaattatatgg

SEQ ID NO: 221654 - DNA, 22 bp, Mus musculus
tgttttgtgaccaattatatgg

SEQ ID NO: 221655 - DNA, 22 bp, Mus musculus
tgttttgtgaccaattatatgg

SEQ ID NO: 221656 - DNA, 21 bp, Mus musculus
atgtgtatgcttagggtgagt

SEQ ID NO: 221657 - DNA, 18 bp, Mus musculus
tgagagagagagagagag

SEQ ID NO: 221658 - DNA, 23 bp, Mus musculus
tgtgtctcactcagtggtctctt

SEQ ID NO: 221659 - DNA, 22 bp, Mus musculus
tgtatctgtgcatgtgcatgtg

SEQ ID NO: 221660 - DNA, 23 bp, Mus musculus
ccctgagatcctggtgtgactaa

SEQ ID NO: 221661 - DNA, 23 bp, Mus musculus
gtgttagagcacctggatgtggt

SEQ ID NO: 221662 - DNA, 21 bp, Mus musculus
agagggagagagccaggctga

SEQ ID NO: 221663 - DNA, 19 bp, Mus musculus
ttaagacctaaccctcctc

SEQ ID NO: 221664 - DNA, 21 bp, Mus musculus
acgtatgtatgtatgtatgta

SEQ ID NO: 221665 - DNA, 23 bp, Mus musculus
tatgtgtgtgtacatatgtgtat

SEQ ID NO: 221666 - DNA, 23 bp, Mus musculus
tatatgcatatgtacacgtatgt

SEQ ID NO: 221667 - DNA, 23 bp, Mus musculus
ttactgaactttcagagctgagc

SEQ ID NO: 221668 - DNA, 19 bp, Mus musculus
tcactgacttgctcttctt

SEQ ID NO: 221669 - DNA, 18 bp, Mus musculus
tctgtcaccctggcattc

SEQ ID NO: 221670 - DNA, 23 bp, Mus musculus
ctgctacagtgttgactggctct

SEQ ID NO: 221671 - DNA, 18 bp, Mus musculus
cacggtggcaaacatgag

SEQ ID NO: 221672 - DNA, 23 bp, Mus musculus
tgtcttgtcactgtgtgtcagtc

SEQ ID NO: 221673 - DNA, 21 bp, Mus musculus
tagatagatatagatatagat

SEQ ID NO: 221674 - DNA, 22 bp, Mus musculus
tgtttatgtgtgtgcctgtgtg

SEQ ID NO: 221675 - DNA, 23 bp, Mus musculus
ctctgcgtgtgtctgtgtgtctg

SEQ ID NO: 221676 - DNA, 23 bp, Mus musculus
tagaaaggaatgaagtctgcggg

SEQ ID NO: 221677 - DNA, 18 bp, Mus musculus
tggagatccaggttgaca

SEQ ID NO: 221678 - DNA, 23 bp, Mus musculus
tcagacagacaggaaaagtaggc

SEQ ID NO: 221679 - DNA, 23 bp, Mus musculus
tcctctgtgagtcctctgtatct

SEQ ID NO: 221680 - DNA, 23 bp, Mus musculus
atcacacagccaggttacgggat

SEQ ID NO: 221681 - DNA, 23 bp, Mus musculus
tagtgcatggtgatctgatagga

SEQ ID NO: 221682 - DNA, 22 bp, Mus musculus
tgttttgtgacctattatgtgg

SEQ ID NO: 221683 - DNA, 20 bp, Mus musculus
actcctcagagtccagcttc

SEQ ID NO: 221684 - DNA, 23 bp, Mus musculus
taaactaaatgtccatgtgcatg

SEQ ID NO: 221685 - DNA, 23 bp, Mus musculus
aaatcatggaagagagtgagcag

SEQ ID NO: 221686 - DNA, 22 bp, Mus musculus
agccattgtgtatctctggttc

SEQ ID NO: 221687 - DNA, 23 bp, Mus musculus
agagctcagagtcattctctgtc

SEQ ID NO: 221688 - DNA, 19 bp, Mus musculus
atgcctcttgtctgggctg

SEQ ID NO: 221689 - DNA, 19 bp, Mus musculus
tatgtatgtatgtgtgtgt

SEQ ID NO: 221690 - DNA, 23 bp, Mus musculus
gtgaatgcatgtatacatgtatg

SEQ ID NO: 221691 - DNA, 23 bp, Mus musculus
ctgggtccgtgtgtccctgagtc

SEQ ID NO: 221692 - DNA, 20 bp, Mus musculus
cagtcctgtgacttcctgct

SEQ ID NO: 221693 - DNA, 21 bp, Mus musculus
ttgtgtatatgtatacataca

SEQ ID NO: 221694 - DNA, 23 bp, Mus musculus
aggctttcgtagtagaatctgat

SEQ ID NO: 221695 - DNA, 21 bp, Mus musculus
aatcacactcagagttatggg

SEQ ID NO: 221696 - DNA, 23 bp, Mus musculus
tgtgtctcagtgtctctgtagcc

SEQ ID NO: 221697 - DNA, 23 bp, Mus musculus
tctgaggatcactgaatgtgata

SEQ ID NO: 221698 - DNA, 20 bp, Mus musculus
tatgtgtgtgtacatatgta

SEQ ID NO: 221699 - DNA, 23 bp, Mus musculus
atacacacacagatatatatgtg

SEQ ID NO: 221700 - DNA, 22 bp, Mus musculus
tgttttgtgaccaattatatgg

SEQ ID NO: 221701 - DNA, 23 bp, Mus musculus
tctgtgtgacacaggctggtctt

SEQ ID NO: 221702 - DNA, 23 bp, Mus musculus
tctgctccacactgtgtctctaa

SEQ ID NO: 221703 - DNA, 23 bp, Mus musculus
caggtagtttgtcacagtgtcca

SEQ ID NO: 221704 - DNA, 23 bp, Mus musculus
ctctgagtgaacagagcctgcac

SEQ ID NO: 221705 - DNA, 23 bp, Mus musculus
cacagtgagtgttggctttctgt

SEQ ID NO: 221706 - DNA, 20 bp, Mus musculus
actggctcactctcacccat

SEQ ID NO: 221707 - DNA, 19 bp, Mus musculus
ttctgttcattttggtatc

SEQ ID NO: 221708 - DNA, 22 bp, Mus musculus
ttattgcatttgaaaacactgt

SEQ ID NO: 221709 - DNA, 23 bp, Mus musculus
gtgtatatccatgtgaatgtgta

SEQ ID NO: 221710 - DNA, 19 bp, Mus musculus
agtgtacatgcatatacat

SEQ ID NO: 221711 - DNA, 23 bp, Mus musculus
tgtgtgtgtatatgtatgtatat

SEQ ID NO: 221712 - DNA, 22 bp, Mus musculus
tatatgtgcatacatattcaca

SEQ ID NO: 221713 - DNA, 19 bp, Mus musculus
tagaatgaactgggtagag

SEQ ID NO: 221714 - DNA, 22 bp, Mus musculus
tcctagagatatacattaaatt

SEQ ID NO: 221715 - DNA, 23 bp, Mus musculus
tcactgtgtctctgtttagtttc

SEQ ID NO: 221716 - DNA, 20 bp, Mus musculus
tgtcagtcactgagccttgt

SEQ ID NO: 221717 - DNA, 23 bp, Mus musculus
acacagcacaatggtcagtgagt

SEQ ID NO: 221718 - DNA, 22 bp, Mus musculus
tgttttgtgaccaattatatgg

SEQ ID NO: 221719 - DNA, 21 bp, Mus musculus
taaacagaagaatgacagcag

SEQ ID NO: 221720 - DNA, 21 bp, Mus musculus
ttcaactgctcttcatcattt

SEQ ID NO: 221721 - DNA, 22 bp, Mus musculus
tgttttgtgaccaattatatgg

SEQ ID NO: 221722 - DNA, 19 bp, Mus musculus
gtctgtggtgatctgatag

SEQ ID NO: 221723 - DNA, 23 bp, Mus musculus
aattatatgatcatttggaggag

SEQ ID NO: 221724 - DNA, 21 bp, Mus musculus
aatgacaccttacatctgtta

SEQ ID NO: 221725 - DNA, 23 bp, Mus musculus
ttactgaggctctttgaatcagc

SEQ ID NO: 221726 - DNA, 22 bp, Mus musculus
tccatggtggtctgataggatg

SEQ ID NO: 221727 - DNA, 22 bp, Mus musculus
tgttttgtgaccaattatatgg

SEQ ID NO: 221728 - DNA, 23 bp, Mus musculus
tgtgtgtgtgtgtatgtatacat

SEQ ID NO: 221729 - DNA, 20 bp, Mus musculus
tgtacacacacacacatata

SEQ ID NO: 221730 - DNA, 21 bp, Mus musculus
tccatggtggtctgataggat

SEQ ID NO: 221731 - DNA, 23 bp, Mus musculus
tgtgagtcctgttttctgaccaa

SEQ ID NO: 221732 - DNA, 23 bp, Mus musculus
agaagctttttatttctatgtgt

SEQ ID NO: 221733 - DNA, 22 bp, Mus musculus
agaatgaggtagttctttctgc

SEQ ID NO: 221734 - DNA, 19 bp, Mus musculus
aagaggaagcagaaaatgt

SEQ ID NO: 221735 - DNA, 23 bp, Mus musculus
atgtatgtatgtatgtatgtatg

SEQ ID NO: 221736 - DNA, 21 bp, Mus musculus
tgccactgtactgagtgtgca

SEQ ID NO: 221737 - DNA, 23 bp, Mus musculus
tgcttgagtactgtattacttgg

SEQ ID NO: 221738 - DNA, 22 bp, Mus musculus
tgttttgtgaccaattatatgg

SEQ ID NO: 221739 - DNA, 19 bp, Mus musculus
tgtgagagagaaagcaggc

SEQ ID NO: 221740 - DNA, 23 bp, Mus musculus
aagagagagtactgagtgtggac

SEQ ID NO: 221741 - DNA, 21 bp, Mus musculus
atcagcaccatcctctttgct

SEQ ID NO: 221742 - DNA, 23 bp, Mus musculus
tatgtgcatgtgtatgtgcatgt

SEQ ID NO: 221743 - DNA, 23 bp, Mus musculus
taagagcactgactgctcttcca

SEQ ID NO: 221744 - DNA, 21 bp, Mus musculus
atgcatatatatatatatgtg

SEQ ID NO: 221745 - DNA, 23 bp, Mus musculus
tcattgctacttcataactgtga

SEQ ID NO: 221746 - DNA, 23 bp, Mus musculus
tgtaatgtaaatatctatgtttt

SEQ ID NO: 221747 - DNA, 23 bp, Mus musculus
gtctgtgactctgagttgtcacg

SEQ ID NO: 221748 - DNA, 21 bp, Mus musculus
tccctgtgtgtctgtctctat

SEQ ID NO: 221749 - DNA, 23 bp, Mus musculus
aggccagacacacagtgtgactc

SEQ ID NO: 221750 - DNA, 23 bp, Mus musculus
gtatttgcatgtgtgtatgtatg

SEQ ID NO: 221751 - DNA, 23 bp, Mus musculus
agatgtgagatgcttaggttggc

SEQ ID NO: 221752 - DNA, 23 bp, Mus musculus
agacagacacactgtggcttttt

SEQ ID NO: 221753 - DNA, 20 bp, Mus musculus
tagttgtgggtgaaaatgaa

SEQ ID NO: 221754 - DNA, 23 bp, Mus musculus
tgtacctgtctcagtcactcaaa

SEQ ID NO: 221755 - DNA, 22 bp, Mus musculus
ttatgtgaatatgaatacaagt

SEQ ID NO: 221756 - DNA, 22 bp, Mus musculus
tcagggtctctgacttcagtcc

SEQ ID NO: 221757 - DNA, 19 bp, Mus musculus
aggaaacagaagtattcat

SEQ ID NO: 221758 - DNA, 23 bp, Mus musculus
ctgtgtgtgtctgtgagagtggt

SEQ ID NO: 221759 - DNA, 20 bp, Mus musculus
atacttgttccttgtgtgtg

SEQ ID NO: 221760 - DNA, 23 bp, Mus musculus
gtatgtatgcatgtgtgtctctg

SEQ ID NO: 221761 - DNA, 21 bp, Mus musculus
atatatgtgtacatgcattgt

SEQ ID NO: 221762 - DNA, 19 bp, Mus musculus
acaacaggagcaaagctgt

SEQ ID NO: 221763 - DNA, 22 bp, Mus musculus
ttagtgtcttgagggttggaga

SEQ ID NO: 221764 - DNA, 23 bp, Mus musculus
tgtgttttacaatgctatagatg

SEQ ID NO: 221765 - DNA, 23 bp, Mus musculus
gtgtatgtgcatttgcatgtgca

SEQ ID NO: 221766 - DNA, 23 bp, Mus musculus
gtgaggtcattgtctgtaacact

SEQ ID NO: 221767 - DNA, 21 bp, Mus musculus
tctctgtgattctcagtgtaa

SEQ ID NO: 221768 - DNA, 22 bp, Mus musculus
tatatatgtgtgtgtatatgta

SEQ ID NO: 221769 - DNA, 23 bp, Mus musculus
ttcactatggccattgacataaa

SEQ ID NO: 221770 - DNA, 20 bp, Mus musculus
tgcgcatgtgtattatgtgt

SEQ ID NO: 221771 - DNA, 19 bp, Mus musculus
tccaaaggaattagtgact

SEQ ID NO: 221772 - DNA, 23 bp, Mus musculus
aaaattctgtggttctggatact

SEQ ID NO: 221773 - DNA, 23 bp, Mus musculus
tagtcccagatacagcttctgct

SEQ ID NO: 221774 - DNA, 23 bp, Mus musculus
cctgtgaaggactagcagtcaat

SEQ ID NO: 221775 - DNA, 21 bp, Mus musculus
atgtatgtatgtatgtgtgtg

SEQ ID NO: 221776 - DNA, 23 bp, Mus musculus
tgtatatatgtatgtatgtatgt

SEQ ID NO: 221777 - DNA, 21 bp, Mus musculus
tgtatgcatgcgtgtgtgtgt

SEQ ID NO: 221778 - DNA, 23 bp, Mus musculus
aatctctctcattctcaatttga

SEQ ID NO: 221779 - DNA, 23 bp, Mus musculus
tagagagtagagactgtgcaata

SEQ ID NO: 221780 - DNA, 21 bp, Mus musculus
cacagccctagagctgtccct

SEQ ID NO: 221781 - DNA, 23 bp, Mus musculus
agactgtctggttaaggtccagc

SEQ ID NO: 221782 - DNA, 23 bp, Mus musculus
agagtacagtgagaacagaatgc

SEQ ID NO: 221783 - DNA, 23 bp, Mus musculus
tcacgttgagactgactgactgc

SEQ ID NO: 221784 - DNA, 21 bp, Mus musculus
tgtatgtatatatgtatgtat

SEQ ID NO: 221785 - DNA, 23 bp, Mus musculus
tgtatgtatatatatatatgtgt

SEQ ID NO: 221786 - DNA, 23 bp, Mus musculus
cagtcaacctgtctctgtctctg

SEQ ID NO: 221787 - DNA, 23 bp, Mus musculus
agtgtttctgtcactttctgatg

SEQ ID NO: 221788 - DNA, 23 bp, Mus musculus
gagtgtctgtcgtagagtgtaga

SEQ ID NO: 221789 - DNA, 21 bp, Mus musculus
tatatgtatacacacacacac

SEQ ID NO: 221790 - DNA, 23 bp, Mus musculus
tcagagcctgcctggctgcctgc

SEQ ID NO: 221791 - DNA, 18 bp, Mus musculus
tgtcaggctggagagttg

SEQ ID NO: 221792 - DNA, 23 bp, Mus musculus
ttcaattctcagcaaccacatgg

SEQ ID NO: 221793 - DNA, 23 bp, Mus musculus
cccagtctgtctctctgtcctct

SEQ ID NO: 221794 - DNA, 23 bp, Mus musculus
tctgcctgcctgcctgcctgcct

SEQ ID NO: 221795 - DNA, 19 bp, Mus musculus
aggcagagtgatggctgtt

SEQ ID NO: 221796 - DNA, 22 bp, Mus musculus
gttttcactgttgaggttctgt

SEQ ID NO: 221797 - DNA, 22 bp, Mus musculus
accctgggcaaagaagaactga

SEQ ID NO: 221798 - DNA, 22 bp, Mus musculus
tgtctgtctgtctatcttctga

SEQ ID NO: 221799 - DNA, 21 bp, Mus musculus
tcaggtgggttttgagcctga

SEQ ID NO: 221800 - DNA, 23 bp, Mus musculus
ctctgcctgtcagtcagtgagat

SEQ ID NO: 221801 - DNA, 20 bp, Mus musculus
acagtagtctagactcagga

SEQ ID NO: 221802 - DNA, 23 bp, Mus musculus
tgagttgtgtctgtctgttcctg

SEQ ID NO: 221803 - DNA, 21 bp, Mus musculus
agtgagacacattcacttgtg

SEQ ID NO: 221804 - DNA, 23 bp, Mus musculus
tcagtcagacagacagtgtagag

SEQ ID NO: 221805 - DNA, 21 bp, Mus musculus
ttctggtcctggttgtgggag

SEQ ID NO: 221806 - DNA, 23 bp, Mus musculus
cagttcactctgtgcatctcctt

SEQ ID NO: 221807 - DNA, 23 bp, Mus musculus
taagagtgcctgtagtcagaggc

SEQ ID NO: 221808 - DNA, 23 bp, Mus musculus
ctataagtagtgggaccaggatt

SEQ ID NO: 221809 - DNA, 22 bp, Mus musculus
tgttagatagtgtcaaagatct

SEQ ID NO: 221810 - DNA, 23 bp, Mus musculus
gagtctgtgtgtgtgtgtgcgcg

SEQ ID NO: 221811 - DNA, 23 bp, Mus musculus
tcacacacactcattttggtgtg

SEQ ID NO: 221812 - DNA, 21 bp, Mus musculus
tggattatttagaagtatgtt

SEQ ID NO: 221813 - DNA, 18 bp, Mus musculus
atatgtatatctggatat

SEQ ID NO: 221814 - DNA, 23 bp, Mus musculus
tgggtgtgatcagtgctttgctc

SEQ ID NO: 221815 - DNA, 23 bp, Mus musculus
agacaccctgcctagcttctctc

SEQ ID NO: 221816 - DNA, 21 bp, Mus musculus
tttttgcaggttggtgtttgc

SEQ ID NO: 221817 - DNA, 22 bp, Mus musculus
ttctgctgtgttgtcaggggct

SEQ ID NO: 221818 - DNA, 22 bp, Mus musculus
ttctgtctgtctgtcttaccca

SEQ ID NO: 221819 - DNA, 18 bp, Mus musculus
aagaaccacacaaatata

SEQ ID NO: 221820 - DNA, 19 bp, Mus musculus
ttgtttgtctttttccagt

SEQ ID NO: 221821 - DNA, 23 bp, Mus musculus
aagtgacagtactgacagagaac

SEQ ID NO: 221822 - DNA, 23 bp, Mus musculus
acagtggatttgcatagcagtag

SEQ ID NO: 221823 - DNA, 23 bp, Mus musculus
gtaacagaagatagtcttcactg

SEQ ID NO: 221824 - DNA, 23 bp, Mus musculus
tgtgtgtctctgtgtgtctgcta

SEQ ID NO: 221825 - DNA, 22 bp, Mus musculus
ctgcatgagagagaaggtgtgt

SEQ ID NO: 221826 - DNA, 20 bp, Mus musculus
tatgtatatatgtatgtatg

SEQ ID NO: 221827 - DNA, 23 bp, Mus musculus
tatgtatgcatgtgtatatgtat

SEQ ID NO: 221828 - DNA, 18 bp, Mus musculus
gagtggtactatacacac

SEQ ID NO: 221829 - DNA, 23 bp, Mus musculus
ctcacagcaactggatgtgcttg

SEQ ID NO: 221830 - DNA, 21 bp, Mus musculus
actctgtgagtctctatgatc

SEQ ID NO: 221831 - DNA, 21 bp, Mus musculus
tttgggggccatattcttgac

SEQ ID NO: 221832 - DNA, 23 bp, Mus musculus
gcctgtctcagtgcctgagtgag

SEQ ID NO: 221833 - DNA, 20 bp, Mus musculus
tatatatgtgagtatgcata

SEQ ID NO: 221834 - DNA, 23 bp, Mus musculus
tcactgtatgtatttctgtaaac

SEQ ID NO: 221835 - DNA, 19 bp, Mus musculus
gagagaactgtgtgagcag

SEQ ID NO: 221836 - DNA, 23 bp, Mus musculus
tagtccatggtgatctgatagga

SEQ ID NO: 221837 - DNA, 21 bp, Mus musculus
tcaggatcttttgttatgtct

SEQ ID NO: 221838 - DNA, 22 bp, Mus musculus
tatgcatatatatagatatatg

SEQ ID NO: 221839 - DNA, 19 bp, Mus musculus
atatctatatatatatatg

SEQ ID NO: 221840 - DNA, 23 bp, Mus musculus
tgtgtgtttatctatctatatga

SEQ ID NO: 221841 - DNA, 20 bp, Mus musculus
tatacttgtcaatgtgatat

SEQ ID NO: 221842 - DNA, 23 bp, Mus musculus
gtatttgtgcatgtatgtgtatt

SEQ ID NO: 221843 - DNA, 23 bp, Mus musculus
tatctatagatatctatagatag

SEQ ID NO: 221844 - DNA, 23 bp, Mus musculus
atatagatagatatctatagata

SEQ ID NO: 221845 - DNA, 22 bp, Mus musculus
gatgaagcagcctcatttgtgg

SEQ ID NO: 221846 - DNA, 22 bp, Mus musculus
tgatgactgtgtcacttcaaag

SEQ ID NO: 221847 - DNA, 22 bp, Mus musculus
tgttttgtgaccaattatatgg

SEQ ID NO: 221848 - DNA, 20 bp, Mus musculus
tatgtgactgtgtcagtgtc

SEQ ID NO: 221849 - DNA, 23 bp, Mus musculus
tgtatatatgtgtatgtatatgt

SEQ ID NO: 221850 - DNA, 18 bp, Mus musculus
ctgtgcatttgttaggga

SEQ ID NO: 221851 - DNA, 22 bp, Mus musculus
tgttttgtgaccaattatatgg

SEQ ID NO: 221852 - DNA, 23 bp, Mus musculus
tctatatgtgtatctatatgtgt

SEQ ID NO: 221853 - DNA, 23 bp, Mus musculus
tatgtgtatctatatgtgtatgt

SEQ ID NO: 221854 - DNA, 22 bp, Mus musculus
tgagcctgtaacagcaggagca

SEQ ID NO: 221855 - DNA, 23 bp, Mus musculus
ttctgagaggtactggtacacct

SEQ ID NO: 221856 - DNA, 22 bp, Mus musculus
ttccctgaagctgatctttgct

SEQ ID NO: 221857 - DNA, 20 bp, Mus musculus
atggttttcaacctgtttac

SEQ ID NO: 221858 - DNA, 22 bp, Mus musculus
aatatgtgtgtgtataacatga

SEQ ID NO: 221859 - DNA, 23 bp, Mus musculus
ttagtccatagtgatctgataga

SEQ ID NO: 221860 - DNA, 23 bp, Mus musculus
aggaaagttttgataagaatatc

SEQ ID NO: 221861 - DNA, 22 bp, Mus musculus
taggaactgtaaatatgatgta

SEQ ID NO: 221862 - DNA, 23 bp, Mus musculus
tttgtcatcctctaccacacagt

SEQ ID NO: 221863 - DNA, 23 bp, Mus musculus
cagagccttcaacttgagatttg

SEQ ID NO: 221864 - DNA, 23 bp, Mus musculus
gatgagactgaagacagaggaga

SEQ ID NO: 221865 - DNA, 23 bp, Mus musculus
agacactcggtgtcagtgctagg

SEQ ID NO: 221866 - DNA, 22 bp, Mus musculus
tgcatgtgtatgtatatgtata

SEQ ID NO: 221867 - DNA, 18 bp, Mus musculus
tcagcagcacttacacac

SEQ ID NO: 221868 - DNA, 22 bp, Mus musculus
tgttttgtgaccaattatatgg

SEQ ID NO: 221869 - DNA, 23 bp, Mus musculus
agaagagtgttgttcagtttcca

SEQ ID NO: 221870 - DNA, 22 bp, Mus musculus
cttagtccatggtgatctgata

SEQ ID NO: 221871 - DNA, 23 bp, Mus musculus
atgtatgtatgtatgtatgtatg

SEQ ID NO: 221872 - DNA, 21 bp, Mus musculus
ccacaccctcactcagtgctt

SEQ ID NO: 221873 - DNA, 23 bp, Mus musculus
ctctggctctccctctctctgct

SEQ ID NO: 221874 - DNA, 22 bp, Mus musculus
atgtgtatgtatagatgtgagt

SEQ ID NO: 221875 - DNA, 20 bp, Mus musculus
tttgacactatgtctctcac

SEQ ID NO: 221876 - DNA, 23 bp, Mus musculus
tgtttgtttgcatgttgtatttg

SEQ ID NO: 221877 - DNA, 22 bp, Mus musculus
gagtgcattgatgtaagggcat

SEQ ID NO: 221878 - DNA, 21 bp, Mus musculus
gtttgagttatgggaattcaa

SEQ ID NO: 221879 - DNA, 23 bp, Mus musculus
ttttctccttgcctttagacagt

SEQ ID NO: 221880 - DNA, 23 bp, Mus musculus
tcaaacagttctgtttttgtttt

SEQ ID NO: 221881 - DNA, 23 bp, Mus musculus
ctatgagtatgtgtctgtctctg

SEQ ID NO: 221882 - DNA, 23 bp, Mus musculus
cagaagcaccataagctccagca

SEQ ID NO: 221883 - DNA, 19 bp, Mus musculus
aatgcaaatatatagaaaa

SEQ ID NO: 221884 - DNA, 20 bp, Mus musculus
tgagagtggagatagaggtc

SEQ ID NO: 221885 - DNA, 22 bp, Mus musculus
cagaggattgaagtttgggtcc

SEQ ID NO: 221886 - DNA, 23 bp, Mus musculus
tagtgcatggtgatctgatagga

SEQ ID NO: 221887 - DNA, 23 bp, Mus musculus
tccagatactgcatgctctttag

SEQ ID NO: 221888 - DNA, 22 bp, Mus musculus
ggttcagtctctgtgagcctcc

SEQ ID NO: 221889 - DNA, 23 bp, Mus musculus
gcctgcctgcctgcctgcctgcc

SEQ ID NO: 221890 - DNA, 20 bp, Mus musculus
taagtgctgtgagtcctgct

SEQ ID NO: 221891 - DNA, 23 bp, Mus musculus
agtggttaccagttgtttcaaga

SEQ ID NO: 221892 - DNA, 23 bp, Mus musculus
atactcacacacacctttgtcat

SEQ ID NO: 221893 - DNA, 20 bp, Mus musculus
gtctgctgtcaaacagtctc

SEQ ID NO: 221894 - DNA, 22 bp, Mus musculus
agaaggctgctgatgctggcat

SEQ ID NO: 221895 - DNA, 20 bp, Mus musculus
catgagtgtgtgtgtgtgtg

SEQ ID NO: 221896 - DNA, 19 bp, Mus musculus
agtctgttagtcactgtat

SEQ ID NO: 221897 - DNA, 20 bp, Mus musculus
ttacaggctggagagatggc

SEQ ID NO: 221898 - DNA, 23 bp, Mus musculus
cgctctgtgaggctctgtgcatg

SEQ ID NO: 221899 - DNA, 23 bp, Mus musculus
tatatatgtatatgtctgttgta

SEQ ID NO: 221900 - DNA, 18 bp, Mus musculus
atatgtgtgtatgtgtgt

SEQ ID NO: 221901 - DNA, 18 bp, Mus musculus
tctgtggggttttgtttt

SEQ ID NO: 221902 - DNA, 18 bp, Mus musculus
aaggtcctgagttaaaat

SEQ ID NO: 221903 - DNA, 20 bp, Mus musculus
agagactcactgtgtgtcta

SEQ ID NO: 221904 - DNA, 22 bp, Mus musculus
taatctcatagaattacaaagc

SEQ ID NO: 221905 - DNA, 23 bp, Mus musculus
aaccctgttctgggcaatgttgt

SEQ ID NO: 221906 - DNA, 20 bp, Mus musculus
gagtctgactctgtctggga

SEQ ID NO: 221907 - DNA, 18 bp, Mus musculus
tgaggtggggctggagag

SEQ ID NO: 221908 - DNA, 20 bp, Mus musculus
agactaagtttgaagttaaa

SEQ ID NO: 221909 - DNA, 22 bp, Mus musculus
ttttatagttttaaacttgttc

SEQ ID NO: 221910 - DNA, 18 bp, Mus musculus
aagtgctccaggtccagt

SEQ ID NO: 221911 - DNA, 19 bp, Mus musculus
tttaggtcatttactttaa

SEQ ID NO: 221912 - DNA, 19 bp, Mus musculus
caactctgcctcctcctca

SEQ ID NO: 221913 - DNA, 18 bp, Mus musculus
ttgataaatatattttgt

SEQ ID NO: 221914 - DNA, 20 bp, Mus musculus
attagaatagcttataggtt

SEQ ID NO: 221915 - DNA, 18 bp, Mus musculus
actagtgtcgggctggag

SEQ ID NO: 221916 - DNA, 23 bp, Mus musculus
cacagagattggtctctggccct

SEQ ID NO: 221917 - DNA, 22 bp, Mus musculus
cccactcactctcactggctct

SEQ ID NO: 221918 - DNA, 18 bp, Mus musculus
aggtcaggggctggagag

SEQ ID NO: 221919 - DNA, 23 bp, Mus musculus
gtcagtcagtgtgtgagacttga

SEQ ID NO: 221920 - DNA, 19 bp, Mus musculus
ctcagttcagtcggtggag

SEQ ID NO: 221921 - DNA, 22 bp, Mus musculus
agtgctgtctctctcagagggg

SEQ ID NO: 221922 - DNA, 23 bp, Mus musculus
gtctgtttgtctgtctgtctgtc

SEQ ID NO: 221923 - DNA, 21 bp, Mus musculus
tgtcgcactatgcctctctgt

SEQ ID NO: 221924 - DNA, 19 bp, Mus musculus
tttaggtgatgctgtgaat

SEQ ID NO: 221925 - DNA, 23 bp, Mus musculus
tatctcagctttcattcatcgtc

SEQ ID NO: 221926 - DNA, 23 bp, Mus musculus
gagaagacactgattgtgttgtg

SEQ ID NO: 221927 - DNA, 23 bp, Mus musculus
tgtctctgtgtgagttcgtgcgt

SEQ ID NO: 221928 - DNA, 19 bp, Mus musculus
tctgtgtgtgtgtgtgtgt

SEQ ID NO: 221929 - DNA, 23 bp, Mus musculus
aggctcagggtctctctgtctgt

SEQ ID NO: 221930 - DNA, 23 bp, Mus musculus
gtgtgtgtatgtgtgtgcatgtg

SEQ ID NO: 221931 - DNA, 23 bp, Mus musculus
tatgtatgggctttgtgtatgtg

SEQ ID NO: 221932 - DNA, 22 bp, Mus musculus
ttaaggcactggtatacactga

SEQ ID NO: 221933 - DNA, 20 bp, Mus musculus
attaatatgtggagttgaag

SEQ ID NO: 221934 - DNA, 21 bp, Mus musculus
ttccagaggccacatggtggc

SEQ ID NO: 221935 - DNA, 21 bp, Mus musculus
cccagtcctatccatctctga

SEQ ID NO: 221936 - DNA, 20 bp, Mus musculus
taagcaagctctaggaaact

SEQ ID NO: 221937 - DNA, 23 bp, Mus musculus
attccatgttgatctgattggat

SEQ ID NO: 221938 - DNA, 23 bp, Mus musculus
gttttgtgaccaattatgctgtc

SEQ ID NO: 221939 - DNA, 22 bp, Mus musculus
tgttttgtgaccaattatatgg

SEQ ID NO: 221940 - DNA, 23 bp, Mus musculus
tgacagaagtcagtctgccttga

SEQ ID NO: 221941 - DNA, 22 bp, Mus musculus
tgttttgtgaccaattatatgg

SEQ ID NO: 221942 - DNA, 23 bp, Mus musculus
cactgtcacactcaccatagctg

SEQ ID NO: 221943 - DNA, 23 bp, Mus musculus
ggtgacagaatagacagagagca

SEQ ID NO: 221944 - DNA, 21 bp, Mus musculus
atatatataaatgtgcattgg

SEQ ID NO: 221945 - DNA, 23 bp, Mus musculus
caggcacacacagtggctctgtg

SEQ ID NO: 221946 - DNA, 23 bp, Mus musculus
tctgtctgtctctgtctatctcc

SEQ ID NO: 221947 - DNA, 18 bp, Mus musculus
gacaaggaggtggtgtct

SEQ ID NO: 221948 - DNA, 23 bp, Mus musculus
ctgtctgtctgtgaggtagtctg

SEQ ID NO: 221949 - DNA, 23 bp, Mus musculus
gactaaagacaggcagaactggg

SEQ ID NO: 221950 - DNA, 21 bp, Mus musculus
tctctgtcactgccagtcttt

SEQ ID NO: 221951 - DNA, 23 bp, Mus musculus
tgtcactgtccagatgtgtaact

SEQ ID NO: 221952 - DNA, 21 bp, Mus musculus
accgacagaccgtaaggtgag

SEQ ID NO: 221953 - DNA, 23 bp, Mus musculus
tgtgagcctctgtctctgcctcc

SEQ ID NO: 221954 - DNA, 23 bp, Mus musculus
atgagactgaggtcacatggtgc

SEQ ID NO: 221955 - DNA, 20 bp, Mus musculus
acaccaggagcagaggtgct

SEQ ID NO: 221956 - DNA, 23 bp, Mus musculus
aactcactctacagactgtcctc

SEQ ID NO: 221957 - DNA, 23 bp, Mus musculus
caggcacactgtctctgactgga

SEQ ID NO: 221958 - DNA, 22 bp, Mus musculus
agaagtagatgcttggaaagtt

SEQ ID NO: 221959 - DNA, 20 bp, Mus musculus
acagagagatctttgcccat

SEQ ID NO: 221960 - DNA, 23 bp, Mus musculus
ggacatcagagtctctgtgtctc

SEQ ID NO: 221961 - DNA, 18 bp, Mus musculus
gtacagatatgcatgtac

SEQ ID NO: 221962 - DNA, 23 bp, Mus musculus
tttatgcatatatatatatgtgt

SEQ ID NO: 221963 - DNA, 23 bp, Mus musculus
actctgtatggatctgagtgtga

SEQ ID NO: 221964 - DNA, 20 bp, Mus musculus
ttggcatatcaacctgctgt

SEQ ID NO: 221965 - DNA, 18 bp, Mus musculus
tcagacactgtctaaagg

SEQ ID NO: 221966 - DNA, 23 bp, Mus musculus
aattagtcctcttgcttctgaaa

SEQ ID NO: 221967 - DNA, 23 bp, Mus musculus
agagtcacaggctgtgtctgtct

SEQ ID NO: 221968 - DNA, 23 bp, Mus musculus
agctactaagaagcagtgaattt

SEQ ID NO: 221969 - DNA, 19 bp, Mus musculus
tattatatatatgtatatg

SEQ ID NO: 221970 - DNA, 23 bp, Mus musculus
cttagagtgcagactgtgtgcac

SEQ ID NO: 221971 - DNA, 23 bp, Mus musculus
tggatcagggtgtagagactcta

SEQ ID NO: 221972 - DNA, 23 bp, Mus musculus
tacatttgtgtttatgtatatgt

SEQ ID NO: 221973 - DNA, 23 bp, Mus musculus
tcactgatgagtgtctgctgtgt

SEQ ID NO: 221974 - DNA, 21 bp, Mus musculus
ttggtgagagactaaagagag

SEQ ID NO: 221975 - DNA, 20 bp, Mus musculus
ttagtgcatgtaaacactga

SEQ ID NO: 221976 - DNA, 23 bp, Mus musculus
ctcagggtatctgtgtgcaagtg

SEQ ID NO: 221977 - DNA, 22 bp, Mus musculus
ttccaggttattttggattcag

SEQ ID NO: 221978 - DNA, 23 bp, Mus musculus
attgaactagaagagcaagggca

SEQ ID NO: 221979 - DNA, 23 bp, Mus musculus
attgcttgaattcagtgtgttat

SEQ ID NO: 221980 - DNA, 23 bp, Mus musculus
atgagtgcagagtgaccacagtg

SEQ ID NO: 221981 - DNA, 21 bp, Mus musculus
gtcaactagctcatctcatca

SEQ ID NO: 221982 - DNA, 23 bp, Mus musculus
tactggaactagaacaaggttgc

SEQ ID NO: 221983 - DNA, 22 bp, Mus musculus
ggaagtcaagacagtttctgat

SEQ ID NO: 221984 - DNA, 23 bp, Mus musculus
ttagttgattaactgtttttcta

SEQ ID NO: 221985 - DNA, 20 bp, Mus musculus
tgtcactgaggatgggcttt

SEQ ID NO: 221986 - DNA, 22 bp, Mus musculus
tgttttgtgaccaattatatgg

SEQ ID NO: 221987 - DNA, 23 bp, Mus musculus
ttcaggttccatatgtatatggg

SEQ ID NO: 221988 - DNA, 19 bp, Mus musculus
tagtgttgtctggacatag

SEQ ID NO: 221989 - DNA, 18 bp, Mus musculus
actggatgaaaaaagcaa

SEQ ID NO: 221990 - DNA, 22 bp, Mus musculus
tgtgcatgtatgtgtgtgtata

SEQ ID NO: 221991 - DNA, 22 bp, Mus musculus
tatgtgcttttatatttgtgtg

SEQ ID NO: 221992 - DNA, 18 bp, Mus musculus
tgtgtgtttgtgtatgct

SEQ ID NO: 221993 - DNA, 21 bp, Mus musculus
ttgtttcatcttggcttgctc

SEQ ID NO: 221994 - DNA, 23 bp, Mus musculus
tctctgtcttagtcactgttcta

SEQ ID NO: 221995 - DNA, 19 bp, Mus musculus
tgaagttcaaattctatca

SEQ ID NO: 221996 - DNA, 23 bp, Mus musculus
tatatatcaggtagtgggtgagt

SEQ ID NO: 221997 - DNA, 23 bp, Mus musculus
ctgtgtccatttgaaatgtttat

SEQ ID NO: 221998 - DNA, 23 bp, Mus musculus
ttatcagttctttgagatcagaa

SEQ ID NO: 221999 - DNA, 21 bp, Mus musculus
tgtgtatgtatacatgtatgt

SEQ ID NO: 222000 - DNA, 23 bp, Mus musculus
tgtatgtatgtatgcatatgagt

SEQ ID NO: 222001 - DNA, 19 bp, Mus musculus
acagctcctacttctaagg

SEQ ID NO: 222002 - DNA, 23 bp, Mus musculus
ttcagagagagctcacaagcttc

SEQ ID NO: 222003 - DNA, 21 bp, Mus musculus
ctgagaggcaatgttacatct

SEQ ID NO: 222004 - DNA, 22 bp, Mus musculus
atgtatgtatatgtatgtgtat

SEQ ID NO: 222005 - DNA, 23 bp, Mus musculus
tgtctgggtgtgagtgaggttgt

SEQ ID NO: 222006 - DNA, 21 bp, Mus musculus
gtatgtatgtatatatgtatg

SEQ ID NO: 222007 - DNA, 20 bp, Mus musculus
agactgcagagggtcatgtt

SEQ ID NO: 222008 - DNA, 23 bp, Mus musculus
atatgtgtgtgtatatgtatgtg

SEQ ID NO: 222009 - DNA, 23 bp, Mus musculus
cctgcctgcctgcctgcctgcct

SEQ ID NO: 222010 - DNA, 23 bp, Mus musculus
tatgtgcatgtgcatgtgcatgt

SEQ ID NO: 222011 - DNA, 22 bp, Mus musculus
atcatgcatatgtacatgtaca

SEQ ID NO: 222012 - DNA, 23 bp, Mus musculus
tgcatgtaatgtgtttatgtata

SEQ ID NO: 222013 - DNA, 22 bp, Mus musculus
tgtctgtgtgtgaccctgtttg

SEQ ID NO: 222014 - DNA, 21 bp, Mus musculus
tatgcatatatatttgagtga

SEQ ID NO: 222015 - DNA, 22 bp, Mus musculus
tgtgaacatgcagacatgcact

SEQ ID NO: 222016 - DNA, 19 bp, Mus musculus
agtcaccctgtgtgtctca

SEQ ID NO: 222017 - DNA, 23 bp, Mus musculus
tttaaagctcagtgaggaatgtg

SEQ ID NO: 222018 - DNA, 23 bp, Mus musculus
tgtgtctatttctctctctattt

SEQ ID NO: 222019 - DNA, 23 bp, Mus musculus
ttgtgtgtatatgaatatatgtg

SEQ ID NO: 222020 - DNA, 18 bp, Mus musculus
tatgcacattagaatgtt

SEQ ID NO: 222021 - DNA, 21 bp, Mus musculus
atgtgtatttgtacatgtatg

SEQ ID NO: 222022 - DNA, 23 bp, Mus musculus
tgtctgtctgtctgtctgtctgc

SEQ ID NO: 222023 - DNA, 23 bp, Mus musculus
tatatagatagatgtagacaaag

SEQ ID NO: 222024 - DNA, 22 bp, Mus musculus
tgacagatctctgtgtgagacc

SEQ ID NO: 222025 - DNA, 21 bp, Mus musculus
acattcagtacatccatgtct

SEQ ID NO: 222026 - DNA, 18 bp, Mus musculus
atgtgtaaagttgttgga

SEQ ID NO: 222027 - DNA, 23 bp, Mus musculus
tcagtgtgtgtgtgtgtatgtgc

SEQ ID NO: 222028 - DNA, 23 bp, Mus musculus
acatgtgacacagagagagagag

SEQ ID NO: 222029 - DNA, 23 bp, Mus musculus
actttctctgcatgtgcaggtgg

SEQ ID NO: 222030 - DNA, 23 bp, Mus musculus
acaggaactgaatggagagtgag

SEQ ID NO: 222031 - DNA, 22 bp, Mus musculus
agtgagccactgtcactccctg

SEQ ID NO: 222032 - DNA, 18 bp, Mus musculus
tgccatgatgatagtgga

SEQ ID NO: 222033 - DNA, 23 bp, Mus musculus
tacaagagtttccatgatcatgt

SEQ ID NO: 222034 - DNA, 23 bp, Mus musculus
tgtctgtctatgtgcctgtgtgt

SEQ ID NO: 222035 - DNA, 22 bp, Mus musculus
acactcagactgctacaggact

SEQ ID NO: 222036 - DNA, 22 bp, Mus musculus
tatgtatatatgtatatatgtg

SEQ ID NO: 222037 - DNA, 21 bp, Mus musculus
tgtgtctatgtgtatatgtgt

SEQ ID NO: 222038 - DNA, 22 bp, Mus musculus
atgtgtctatatgtatatgtga

SEQ ID NO: 222039 - DNA, 18 bp, Mus musculus
tgtatgtgcatatgcatg

SEQ ID NO: 222040 - DNA, 22 bp, Mus musculus
tatgtgtacatatatgtatgta

SEQ ID NO: 222041 - DNA, 21 bp, Mus musculus
atgtacatagtatctgtgtat

SEQ ID NO: 222042 - DNA, 22 bp, Mus musculus
tgttttgtgaccaattatatgg

SEQ ID NO: 222043 - DNA, 22 bp, Mus musculus
tgttttgtgaccaattatatgg

SEQ ID NO: 222044 - DNA, 19 bp, Mus musculus
ctttacatcctccagtggt

SEQ ID NO: 222045 - DNA, 23 bp, Mus musculus
tttttgtgcctcgaggttatctg

SEQ ID NO: 222046 - DNA, 18 bp, Mus musculus
gacatccagtttagaaca

SEQ ID NO: 222047 - DNA, 23 bp, Mus musculus
tggctctctggttttgtttccat

SEQ ID NO: 222048 - DNA, 23 bp, Mus musculus
ttttctgattttgttgttcatgg

SEQ ID NO: 222049 - DNA, 21 bp, Mus musculus
tgtgtgtgtacctaaatgtat

SEQ ID NO: 222050 - DNA, 23 bp, Mus musculus
tgtgtgtatgtacttgtgtgtat

SEQ ID NO: 222051 - DNA, 23 bp, Mus musculus
ttttgttttgttatctattcatt

SEQ ID NO: 222052 - DNA, 23 bp, Mus musculus
tctgtctatgtatgtatatatga

SEQ ID NO: 222053 - DNA, 22 bp, Mus musculus
tgttttgtgaccaattatatgg

SEQ ID NO: 222054 - DNA, 22 bp, Mus musculus
agaagagtgttgttcagtttcc

SEQ ID NO: 222055 - DNA, 22 bp, Mus musculus
cttagtccatggtgatctgata

SEQ ID NO: 222056 - DNA, 22 bp, Mus musculus
tgttttgtgaccaattatatgg

SEQ ID NO: 222057 - DNA, 22 bp, Mus musculus
tgttttgtgaccaattatatgg

SEQ ID NO: 222058 - DNA, 22 bp, Mus musculus
acttatgtgaggcagccagagg

SEQ ID NO: 222059 - DNA, 23 bp, Mus musculus
tgtgcctgcctgcctgcctgcca

SEQ ID NO: 222060 - DNA, 23 bp, Mus musculus
agtgactctgagtgacatcatgg

SEQ ID NO: 222061 - DNA, 23 bp, Mus musculus
gccccaggagctccagctgtctc

SEQ ID NO: 222062 - DNA, 22 bp, Mus musculus
tcactgtcttactgtgtgtaac

SEQ ID NO: 222063 - DNA, 23 bp, Mus musculus
ttagtcacagattgttagaggaa

SEQ ID NO: 222064 - DNA, 23 bp, Mus musculus
ccttgtgtctgtcaaatgtactc

SEQ ID NO: 222065 - DNA, 23 bp, Mus musculus
agtgatttggttcaactgtatag

SEQ ID NO: 222066 - DNA, 18 bp, Mus musculus
acacatgctggaggtctg

SEQ ID NO: 222067 - DNA, 23 bp, Mus musculus
tcacgatgaactgtttggaagtt

SEQ ID NO: 222068 - DNA, 20 bp, Mus musculus
cttttgtaatgtatgtcctt

SEQ ID NO: 222069 - DNA, 22 bp, Mus musculus
tgttttgtgaccaattatatgg

SEQ ID NO: 222070 - DNA, 22 bp, Mus musculus
ttcaggacctaattgctctgtg

SEQ ID NO: 222071 - DNA, 22 bp, Mus musculus
tctgtgggacaaaacagggtct

SEQ ID NO: 222072 - DNA, 21 bp, Mus musculus
cagcaaccatatgatgactga

SEQ ID NO: 222073 - DNA, 23 bp, Mus musculus
ttgacataccttagccagaggct

SEQ ID NO: 222074 - DNA, 20 bp, Mus musculus
gaaaaatgtttagaagcact

SEQ ID NO: 222075 - DNA, 20 bp, Mus musculus
atcagtccatattgtcctgc

SEQ ID NO: 222076 - DNA, 22 bp, Mus musculus
tgttttgtgaccaattatatgg

SEQ ID NO: 222077 - DNA, 23 bp, Mus musculus
atatatgtatatgtgtatttgtg

SEQ ID NO: 222078 - DNA, 23 bp, Mus musculus
agttgacagaagtgtgtgtgaag

SEQ ID NO: 222079 - DNA, 23 bp, Mus musculus
acaaggtagtagtgtgtgtgtct

SEQ ID NO: 222080 - DNA, 23 bp, Mus musculus
tagagcacagtgagcagacaccc

SEQ ID NO: 222081 - DNA, 21 bp, Mus musculus
tctctagctaatgaaatgctc

SEQ ID NO: 222082 - DNA, 20 bp, Mus musculus
tgacagcactgactgtggac

SEQ ID NO: 222083 - DNA, 18 bp, Mus musculus
tctttcagagtctataga

SEQ ID NO: 222084 - DNA, 23 bp, Mus musculus
tgtatcaatttgtatttatgtct

SEQ ID NO: 222085 - DNA, 19 bp, Mus musculus
gtatatatttgtgtttgtg

SEQ ID NO: 222086 - DNA, 19 bp, Mus musculus
caatatatatatgtataca

SEQ ID NO: 222087 - DNA, 22 bp, Mus musculus
tgttttgtgaccaattatatgg

SEQ ID NO: 222088 - DNA, 23 bp, Mus musculus
attaattgttgaatgcacatata

SEQ ID NO: 222089 - DNA, 19 bp, Mus musculus
aaatgtatggaaatatatg

SEQ ID NO: 222090 - DNA, 22 bp, Mus musculus
tgttttgtgaccaattatatgg

SEQ ID NO: 222091 - DNA, 19 bp, Mus musculus
tgtatatatgtatatgtgt

SEQ ID NO: 222092 - DNA, 20 bp, Mus musculus
tatgtgcatatgtatatatg

SEQ ID NO: 222093 - DNA, 23 bp, Mus musculus
tggaatgtaaagaagtaagtctc

SEQ ID NO: 222094 - DNA, 23 bp, Mus musculus
tgtatgtatgctaagcctgtgtc

SEQ ID NO: 222095 - DNA, 19 bp, Mus musculus
tatcttgtcttggtggagg

SEQ ID NO: 222096 - DNA, 22 bp, Mus musculus
tggaaagtattgggcaaagaga

SEQ ID NO: 222097 - DNA, 21 bp, Mus musculus
tgaaaagttgagtagctgtaa

SEQ ID NO: 222098 - DNA, 22 bp, Mus musculus
tggtctgataggatgtatggga

SEQ ID NO: 222099 - DNA, 22 bp, Mus musculus
tgttttgtgaccaattatatgg

SEQ ID NO: 222100 - DNA, 22 bp, Mus musculus
tgttttgtgaccaattatatgg

SEQ ID NO: 222101 - DNA, 22 bp, Mus musculus
tgttttgtgaccaattatatgg

SEQ ID NO: 222102 - DNA, 22 bp, Mus musculus
tatgtgtatgtatatgtatatg

SEQ ID NO: 222103 - DNA, 22 bp, Mus musculus
tgttttgtgaccaattatatgg

SEQ ID NO: 222104 - DNA, 23 bp, Mus musculus
taagtatttcatgcagatgtgtt

SEQ ID NO: 222105 - DNA, 21 bp, Mus musculus
tcacttgagattttgaacttg

SEQ ID NO: 222106 - DNA, 20 bp, Mus musculus
cattgcatgcatctcagacc

SEQ ID NO: 222107 - DNA, 23 bp, Mus musculus
gaacactgcttcttgattatttc

SEQ ID NO: 222108 - DNA, 20 bp, Mus musculus
atatctgaagaacagaagtt

SEQ ID NO: 222109 - DNA, 22 bp, Mus musculus
tgttttgtgaccaattatatgg

SEQ ID NO: 222110 - DNA, 22 bp, Mus musculus
atatgtatatgtatgtgtattt

SEQ ID NO: 222111 - DNA, 23 bp, Mus musculus
agagtagtttgtgtgtacagtga

SEQ ID NO: 222112 - DNA, 19 bp, Mus musculus
tagcaaagaatacatgtat

SEQ ID NO: 222113 - DNA, 22 bp, Mus musculus
tgtgcttgtatgtatgtgtgta

SEQ ID NO: 222114 - DNA, 20 bp, Mus musculus
tgcattgtatatgtgtgcgt

SEQ ID NO: 222115 - DNA, 18 bp, Mus musculus
taagtggagtgtgtgtct

SEQ ID NO: 222116 - DNA, 23 bp, Mus musculus
tctctgactctgttatttccctt

SEQ ID NO: 222117 - DNA, 23 bp, Mus musculus
ttcagtcatctacatggtttaga

SEQ ID NO: 222118 - DNA, 22 bp, Mus musculus
tgttttgtgaccaattatatgg

SEQ ID NO: 222119 - DNA, 23 bp, Mus musculus
tttatgattggaatacattgatg

SEQ ID NO: 222120 - DNA, 22 bp, Mus musculus
cagctgagagtttaagctggga

SEQ ID NO: 222121 - DNA, 23 bp, Mus musculus
aaactctctggctgtgtgtcagt

SEQ ID NO: 222122 - DNA, 23 bp, Mus musculus
tatgagtctgttgtgtgcacgtt

SEQ ID NO: 222123 - DNA, 22 bp, Mus musculus
ttgtgcactgtgtgcacacaga

SEQ ID NO: 222124 - DNA, 19 bp, Mus musculus
atactggacatggagctgt

SEQ ID NO: 222125 - DNA, 19 bp, Mus musculus
gagctttgaagagagggct

SEQ ID NO: 222126 - DNA, 23 bp, Mus musculus
aaacagcttctttgataaaggct

SEQ ID NO: 222127 - DNA, 23 bp, Mus musculus
tcttgtctagctccacgtcagag

SEQ ID NO: 222128 - DNA, 19 bp, Mus musculus
ctatatatgtatatgtgtg

SEQ ID NO: 222129 - DNA, 23 bp, Mus musculus
tgtatgtgtatatgctatatatg

SEQ ID NO: 222130 - DNA, 23 bp, Mus musculus
atattttgtgcactttatttctt

SEQ ID NO: 222131 - DNA, 20 bp, Mus musculus
tggctcagtggttaggagca

SEQ ID NO: 222132 - DNA, 21 bp, Mus musculus
cacagggtcctgaaatggtga

SEQ ID NO: 222133 - DNA, 22 bp, Mus musculus
acactgaagtaccctttgactc

SEQ ID NO: 222134 - DNA, 20 bp, Mus musculus
aactgactgctcttccagag

SEQ ID NO: 222135 - DNA, 22 bp, Mus musculus
atatgtgtatatgtatatatgt

SEQ ID NO: 222136 - DNA, 23 bp, Mus musculus
tatttgcacttcttctacagcct

SEQ ID NO: 222137 - DNA, 23 bp, Mus musculus
tcacgctctttctctctcttgga

SEQ ID NO: 222138 - DNA, 19 bp, Mus musculus
gtcagaagagggctgtgag

SEQ ID NO: 222139 - DNA, 23 bp, Mus musculus
gtttgctagactcaggaatggat

SEQ ID NO: 222140 - DNA, 23 bp, Mus musculus
agtctgactctctaaattcagtg

SEQ ID NO: 222141 - DNA, 23 bp, Mus musculus
gtgagttcttggtgttagtttgt

SEQ ID NO: 222142 - DNA, 23 bp, Mus musculus
tcaagccagaccctgtgtctcac

SEQ ID NO: 222143 - DNA, 23 bp, Mus musculus
actgactcactctctgattgtgg

SEQ ID NO: 222144 - DNA, 23 bp, Mus musculus
ttctttgttcatgtttatgactg

SEQ ID NO: 222145 - DNA, 23 bp, Mus musculus
tgatttctaagttgaatgcagta

SEQ ID NO: 222146 - DNA, 22 bp, Mus musculus
attagtactactttctacttgg

SEQ ID NO: 222147 - DNA, 23 bp, Mus musculus
ttcatctgttcattggtgatttg

SEQ ID NO: 222148 - DNA, 23 bp, Mus musculus
tgaaactgagttgttggtctctg

SEQ ID NO: 222149 - DNA, 18 bp, Mus musculus
gactctggttcaattccc

SEQ ID NO: 222150 - DNA, 23 bp, Mus musculus
gtgtacatgtgtatacatgcata

SEQ ID NO: 222151 - DNA, 23 bp, Mus musculus
tctctctcagtcatagaaataag

SEQ ID NO: 222152 - DNA, 22 bp, Mus musculus
cttcactctatgcttctgtgag

SEQ ID NO: 222153 - DNA, 23 bp, Mus musculus
aggagggctggatttcaatgcca

SEQ ID NO: 222154 - DNA, 23 bp, Mus musculus
ctgtgagtgaagagtctgatgtg

SEQ ID NO: 222155 - DNA, 18 bp, Mus musculus
cacacagaggactagaca

SEQ ID NO: 222156 - DNA, 23 bp, Mus musculus
gtatctctgactggtttggaact

SEQ ID NO: 222157 - DNA, 23 bp, Mus musculus
ctgtctgccaaatgagaatatca

SEQ ID NO: 222158 - DNA, 22 bp, Mus musculus
tgcatgtatgtatgtatgtatg

SEQ ID NO: 222159 - DNA, 21 bp, Mus musculus
atgtatgtatgcatgtatgtg

SEQ ID NO: 222160 - DNA, 23 bp, Mus musculus
tgtatgtatatgtgcatgtctat

SEQ ID NO: 222161 - DNA, 19 bp, Mus musculus
tcacagaagccacagtgga

SEQ ID NO: 222162 - DNA, 18 bp, Mus musculus
tcaggaagcagatgtaaa

SEQ ID NO: 222163 - DNA, 22 bp, Mus musculus
tttgtagtgggaagaaagggtc

SEQ ID NO: 222164 - DNA, 23 bp, Mus musculus
tcctggacagttttgacttaagg

SEQ ID NO: 222165 - DNA, 23 bp, Mus musculus
tgtcaccctgggtctctctgtcc

SEQ ID NO: 222166 - DNA, 23 bp, Mus musculus
tgagtatagagtttctagcttct

SEQ ID NO: 222167 - DNA, 23 bp, Mus musculus
gaaatgtaatgggactggactca

SEQ ID NO: 222168 - DNA, 23 bp, Mus musculus
tatgtgtatgtatatatgtatgt

SEQ ID NO: 222169 - DNA, 19 bp, Mus musculus
tatttattttctgttaggg

SEQ ID NO: 222170 - DNA, 23 bp, Mus musculus
acactgcctcactggatgtgaaa

SEQ ID NO: 222171 - DNA, 23 bp, Mus musculus
tctctcggtcactaacaatggaa

SEQ ID NO: 222172 - DNA, 20 bp, Mus musculus
tttagtgaccaagataaagg

SEQ ID NO: 222173 - DNA, 21 bp, Mus musculus
attgctctaggtccagttgta

SEQ ID NO: 222174 - DNA, 23 bp, Mus musculus
catggtctctgtcactcactggt

SEQ ID NO: 222175 - DNA, 21 bp, Mus musculus
tgttctgactgtgtctctcac

SEQ ID NO: 222176 - DNA, 23 bp, Mus musculus
gcactgctctcttctgtgactct

SEQ ID NO: 222177 - DNA, 23 bp, Mus musculus
gtgtccttgtcagtatctggtct

SEQ ID NO: 222178 - DNA, 23 bp, Mus musculus
atatgtgtatgtttatgtataca

SEQ ID NO: 222179 - DNA, 20 bp, Mus musculus
atgatgtatgtatgtacata

SEQ ID NO: 222180 - DNA, 23 bp, Mus musculus
tatgtgtctatatgtatatatgt

SEQ ID NO: 222181 - DNA, 23 bp, Mus musculus
tgtgtcagtgtgtgacaagtaac

SEQ ID NO: 222182 - DNA, 23 bp, Mus musculus
tgagtgtcagtctgtgattacgc

SEQ ID NO: 222183 - DNA, 22 bp, Mus musculus
agtggcagagactatgttgtgt

SEQ ID NO: 222184 - DNA, 22 bp, Mus musculus
caccttgggatatcttcctgtt

SEQ ID NO: 222185 - DNA, 23 bp, Mus musculus
tgagaccctgtgtgtgtgtctgt

SEQ ID NO: 222186 - DNA, 23 bp, Mus musculus
tcaggggcaggaattcagaagaa

SEQ ID NO: 222187 - DNA, 23 bp, Mus musculus
aagcctcttgtttgctttctctc

SEQ ID NO: 222188 - DNA, 22 bp, Mus musculus
tttctgtgtctgtgctaaggca

SEQ ID NO: 222189 - DNA, 23 bp, Mus musculus
ttagagactgaagagagtctaga

SEQ ID NO: 222190 - DNA, 20 bp, Mus musculus
tgcagtctccatgatgtgag

SEQ ID NO: 222191 - DNA, 22 bp, Mus musculus
tgttttgtgaccaattatatgg

SEQ ID NO: 222192 - DNA, 23 bp, Mus musculus
tgtctctctatttctgtgtctga

SEQ ID NO: 222193 - DNA, 23 bp, Mus musculus
atagctcctagacctagtgatga

SEQ ID NO: 222194 - DNA, 23 bp, Mus musculus
atatatacacatatacatgcata

SEQ ID NO: 222195 - DNA, 21 bp, Mus musculus
atatgtatgtatgtatatatg

SEQ ID NO: 222196 - DNA, 23 bp, Mus musculus
tatgtggatatatatacacatac

SEQ ID NO: 222197 - DNA, 23 bp, Mus musculus
ttctcagactctcagacacccag

SEQ ID NO: 222198 - DNA, 23 bp, Mus musculus
atagagagacaacagagtgagca

SEQ ID NO: 222199 - DNA, 22 bp, Mus musculus
tgttttgtgaccaattatatgg

SEQ ID NO: 222200 - DNA, 23 bp, Mus musculus
caggctctgtcactgtctgttga

SEQ ID NO: 222201 - DNA, 19 bp, Mus musculus
tatgaagaattaacaagct

SEQ ID NO: 222202 - DNA, 23 bp, Mus musculus
atgtatgtatgtgtgtgtatgaa

SEQ ID NO: 222203 - DNA, 23 bp, Mus musculus
atgtatgtatgtacatatctgta

SEQ ID NO: 222204 - DNA, 19 bp, Mus musculus
aactcctcagagtccagct

SEQ ID NO: 222205 - DNA, 23 bp, Mus musculus
aatatttttgtatctgttgaggc

SEQ ID NO: 222206 - DNA, 21 bp, Mus musculus
ctaagattggaagtatctggt

SEQ ID NO: 222207 - DNA, 18 bp, Mus musculus
gctcagtggttaggagct

SEQ ID NO: 222208 - DNA, 23 bp, Mus musculus
tccctcggtctgtctgtcacata

SEQ ID NO: 222209 - DNA, 22 bp, Mus musculus
gtgggagtgacagggccaccag

SEQ ID NO: 222210 - DNA, 23 bp, Mus musculus
cagacgctctgtgtctggctgca

SEQ ID NO: 222211 - DNA, 23 bp, Mus musculus
ttctgaccgtctctgacgctcac

SEQ ID NO: 222212 - DNA, 21 bp, Mus musculus
acgttgcggtagaagatgagt

SEQ ID NO: 222213 - DNA, 23 bp, Mus musculus
atctctgtgtcactgtcagactc

SEQ ID NO: 222214 - DNA, 23 bp, Mus musculus
cccactgtcactctctgactcct

SEQ ID NO: 222215 - DNA, 22 bp, Mus musculus
tgtacgtggtatctgtatgtgt

SEQ ID NO: 222216 - DNA, 23 bp, Mus musculus
gtgtgtgtgtctgcctgtctgtg

SEQ ID NO: 222217 - DNA, 23 bp, Mus musculus
gtctctgtctgtctatctgtctg

SEQ ID NO: 222218 - DNA, 21 bp, Mus musculus
cccactgtgctttgctggttg

SEQ ID NO: 222219 - DNA, 23 bp, Mus musculus
ctcctgtgaggcacagaaggggc

SEQ ID NO: 222220 - DNA, 23 bp, Mus musculus
tcagcacagtctctgtcacatag

SEQ ID NO: 222221 - DNA, 21 bp, Mus musculus
tgtgtctgtctgtgtgtctgt

SEQ ID NO: 222222 - DNA, 18 bp, Mus musculus
aatccttaggggctggag

SEQ ID NO: 222223 - DNA, 19 bp, Mus musculus
aagagcactgactgctctt

SEQ ID NO: 222224 - DNA, 20 bp, Mus musculus
aaatgcatatgtatatgtat

SEQ ID NO: 222225 - DNA, 19 bp, Mus musculus
agaacactgactgctctac

SEQ ID NO: 222226 - DNA, 23 bp, Mus musculus
ttacatacatatgtgtgcatgtg

SEQ ID NO: 222227 - DNA, 19 bp, Mus musculus
ggctcagtggttaggagca

SEQ ID NO: 222228 - DNA, 20 bp, Mus musculus
attagaagggacagagagcc

SEQ ID NO: 222229 - DNA, 22 bp, Mus musculus
tgtgtgtgtgtacatgggtgta

SEQ ID NO: 222230 - DNA, 23 bp, Mus musculus
tctgtagtacagcttgattgagg

SEQ ID NO: 222231 - DNA, 23 bp, Mus musculus
tatacataatatgtatgtgtgtg

SEQ ID NO: 222232 - DNA, 23 bp, Mus musculus
tgtcagtctctgacagagcctct

SEQ ID NO: 222233 - DNA, 23 bp, Mus musculus
agctctatcagactcctgtcagc

SEQ ID NO: 222234 - DNA, 23 bp, Mus musculus
tccctgtgtgtaagaagtgcctg

SEQ ID NO: 222235 - DNA, 23 bp, Mus musculus
gtatatatgtatgtatagatgta

SEQ ID NO: 222236 - DNA, 22 bp, Mus musculus
tgttttgtgaccaattatatgg

SEQ ID NO: 222237 - DNA, 19 bp, Mus musculus
aagaaatgagagttacctt

SEQ ID NO: 222238 - DNA, 22 bp, Mus musculus
aggatcagaagagagagtgctc

SEQ ID NO: 222239 - DNA, 23 bp, Mus musculus
tctgtgtctgtgagtgtgtgtgc

SEQ ID NO: 222240 - DNA, 23 bp, Mus musculus
tttataggtcatgctggctttga

SEQ ID NO: 222241 - DNA, 23 bp, Mus musculus
ctgagatcactgtcactctggga

SEQ ID NO: 222242 - DNA, 23 bp, Mus musculus
atctaactgcacccagtgtcact

SEQ ID NO: 222243 - DNA, 23 bp, Mus musculus
tcattggcagtggttaagttgcc

SEQ ID NO: 222244 - DNA, 23 bp, Mus musculus
gctgtcacactgtgtcttttcag

SEQ ID NO: 222245 - DNA, 23 bp, Mus musculus
ctcagactgtctctgtgcctagg

SEQ ID NO: 222246 - DNA, 21 bp, Mus musculus
gatgactgagagcttcccagc

SEQ ID NO: 222247 - DNA, 23 bp, Mus musculus
tgtctgtgcatctccatgttctg

SEQ ID NO: 222248 - DNA, 22 bp, Mus musculus
tgttttgtgaccaattatatgg

SEQ ID NO: 222249 - DNA, 23 bp, Mus musculus
tcagacaggactcttgtctccct

SEQ ID NO: 222250 - DNA, 23 bp, Mus musculus
tcataacagttctggatctggag

SEQ ID NO: 222251 - DNA, 23 bp, Mus musculus
taggacctctgcttgctctggtc

SEQ ID NO: 222252 - DNA, 22 bp, Mus musculus
tagctgacttcagatgcaccag

SEQ ID NO: 222253 - DNA, 23 bp, Mus musculus
atttacacagacaaaatgaggtc

SEQ ID NO: 222254 - DNA, 19 bp, Mus musculus
tatgtatgtatgcatgtgt

SEQ ID NO: 222255 - DNA, 20 bp, Mus musculus
tatgtgtgtgtatatatata

SEQ ID NO: 222256 - DNA, 19 bp, Mus musculus
agtcacaggctatggacag

SEQ ID NO: 222257 - DNA, 23 bp, Mus musculus
tctctcagtgtcagatgccactc

SEQ ID NO: 222258 - DNA, 23 bp, Mus musculus
tatgtctgtgtgtatgtgtctgt

SEQ ID NO: 222259 - DNA, 22 bp, Mus musculus
catatatgtatctagctatgta

SEQ ID NO: 222260 - DNA, 23 bp, Mus musculus
tcagaactgtgagccaaatatat

SEQ ID NO: 222261 - DNA, 23 bp, Mus musculus
ccgttatagtgtcagaagttggg

SEQ ID NO: 222262 - DNA, 22 bp, Mus musculus
acgtgggacagacagacagaca

SEQ ID NO: 222263 - DNA, 22 bp, Mus musculus
agttcaaatctcagcaaccaca

SEQ ID NO: 222264 - DNA, 23 bp, Mus musculus
gtgctgtctgagtctctccctca

SEQ ID NO: 222265 - DNA, 21 bp, Mus musculus
gacagagaagacagtttgcac

SEQ ID NO: 222266 - DNA, 23 bp, Mus musculus
acagtctctggttcactgtgctt

SEQ ID NO: 222267 - DNA, 23 bp, Mus musculus
ctgtgaacacacactgtggtgtt

SEQ ID NO: 222268 - DNA, 23 bp, Mus musculus
tctgtggctgtcactgtgaggtt

SEQ ID NO: 222269 - DNA, 23 bp, Mus musculus
aggaggatccgtcagttcacggg

SEQ ID NO: 222270 - DNA, 23 bp, Mus musculus
tatgtatgtatgtatgtgtgtgt

SEQ ID NO: 222271 - DNA, 20 bp, Mus musculus
ctgtatttgcatatatatgt

SEQ ID NO: 222272 - DNA, 18 bp, Mus musculus
acagactttccttagcag

SEQ ID NO: 222273 - DNA, 23 bp, Mus musculus
tggagtgtgacaatggtgtttgt

SEQ ID NO: 222274 - DNA, 23 bp, Mus musculus
ctaaatagctactgctaggcaat

SEQ ID NO: 222275 - DNA, 18 bp, Mus musculus
ttatgtatatatgtatat

SEQ ID NO: 222276 - DNA, 20 bp, Mus musculus
atgtgtatatatgtatatgt

SEQ ID NO: 222277 - DNA, 19 bp, Mus musculus
tatatattagatatagtag

SEQ ID NO: 222278 - DNA, 23 bp, Mus musculus
atatgtgtgtgtatgtatatatg

SEQ ID NO: 222279 - DNA, 22 bp, Mus musculus
tatatgtatatatatgtgtgtg

SEQ ID NO: 222280 - DNA, 23 bp, Mus musculus
atgtatgtatgtgtgtgcatgtg

SEQ ID NO: 222281 - DNA, 21 bp, Mus musculus
atgtgtgtacatgtgtatttg

SEQ ID NO: 222282 - DNA, 23 bp, Mus musculus
tgtctgtgtctgtgggtatgtag

SEQ ID NO: 222283 - DNA, 22 bp, Mus musculus
tatgtgcatatatatatgtgtg

SEQ ID NO: 222284 - DNA, 22 bp, Mus musculus
tgtgcatgtatgtatatatgtg

SEQ ID NO: 222285 - DNA, 23 bp, Mus musculus
tgtgcatatatatgtatatgtat

SEQ ID NO: 222286 - DNA, 19 bp, Mus musculus
tgtggtggtcttggaagca

SEQ ID NO: 222287 - DNA, 21 bp, Mus musculus
tgactctctgtgaggatgcaa

SEQ ID NO: 222288 - DNA, 22 bp, Mus musculus
aatttagacattcttaaagagt

SEQ ID NO: 222289 - DNA, 19 bp, Mus musculus
aaaccctgtctctttgtgt

SEQ ID NO: 222290 - DNA, 23 bp, Mus musculus
acagacaacaaacagagctgatc

SEQ ID NO: 222291 - DNA, 23 bp, Mus musculus
ctctccctcactgtcagtgtgga

SEQ ID NO: 222292 - DNA, 23 bp, Mus musculus
tccctccagccttgattcagcct

SEQ ID NO: 222293 - DNA, 23 bp, Mus musculus
gccacaagagactcagcagagga

SEQ ID NO: 222294 - DNA, 22 bp, Mus musculus
atgcatgtgtgcgtgtatgtga

SEQ ID NO: 222295 - DNA, 22 bp, Mus musculus
aggctagtgtttttcaagatgt

SEQ ID NO: 222296 - DNA, 21 bp, Mus musculus
attagtctgggtttccattga

SEQ ID NO: 222297 - DNA, 23 bp, Mus musculus
acactgtcactctctgttgagtc

SEQ ID NO: 222298 - DNA, 23 bp, Mus musculus
acagtggactgggcctggagaga

SEQ ID NO: 222299 - DNA, 23 bp, Mus musculus
ttttgtcagggaatgttaggtta

SEQ ID NO: 222300 - DNA, 23 bp, Mus musculus
tactgacacacatgtgacacagc

SEQ ID NO: 222301 - DNA, 23 bp, Mus musculus
gtctttgggtttctagctgtatc

SEQ ID NO: 222302 - DNA, 22 bp, Mus musculus
gactgacaactgagtttggtca

SEQ ID NO: 222303 - DNA, 19 bp, Mus musculus
ttccattccctgaaatcac

SEQ ID NO: 222304 - DNA, 22 bp, Mus musculus
cagtgctcttaaccactgagcc

SEQ ID NO: 222305 - DNA, 21 bp, Mus musculus
ttgtctgcagcaggagcacac

SEQ ID NO: 222306 - DNA, 20 bp, Mus musculus
atgtacatatacatatacac

SEQ ID NO: 222307 - DNA, 22 bp, Mus musculus
ataaatgtatatatgtatacgt

SEQ ID NO: 222308 - DNA, 19 bp, Mus musculus
tacacacacatatatatgt

SEQ ID NO: 222309 - DNA, 22 bp, Mus musculus
atatgtgtatgtatatatatgt

SEQ ID NO: 222310 - DNA, 23 bp, Mus musculus
acactgactgtctctgtatgacc

SEQ ID NO: 222311 - DNA, 23 bp, Mus musculus
atttgaatgggtgtcatttacca

SEQ ID NO: 222312 - DNA, 20 bp, Mus musculus
tctgtctgtctgtctgtgca

SEQ ID NO: 222313 - DNA, 23 bp, Mus musculus
aactcatgtggtactaatgtcat

SEQ ID NO: 222314 - DNA, 23 bp, Mus musculus
gtgcctctgtgtgtctctgcttg

SEQ ID NO: 222315 - DNA, 23 bp, Mus musculus
agaggacaacttgcaggagtcgg

SEQ ID NO: 222316 - DNA, 22 bp, Mus musculus
ttgaactcaggttgttaactgg

SEQ ID NO: 222317 - DNA, 19 bp, Mus musculus
ggttggtgtgagcttggga

SEQ ID NO: 222318 - DNA, 22 bp, Mus musculus
atatatgtatatatatgtgtgt

SEQ ID NO: 222319 - DNA, 22 bp, Mus musculus
tgttttgtgaccaattatatgg

SEQ ID NO: 222320 - DNA, 21 bp, Mus musculus
tggttctatttaagtttcttt

SEQ ID NO: 222321 - DNA, 23 bp, Mus musculus
atgaagaagcttatatagtaata

SEQ ID NO: 222322 - DNA, 19 bp, Mus musculus
agagcagtttattcctttg

SEQ ID NO: 222323 - DNA, 23 bp, Mus musculus
tctctgtggctcagtgcctggca

SEQ ID NO: 222324 - DNA, 23 bp, Mus musculus
cacagtgattctctgtcaaatgt

SEQ ID NO: 222325 - DNA, 23 bp, Mus musculus
agaaatgcatattttgctgttgt

SEQ ID NO: 222326 - DNA, 23 bp, Mus musculus
tctgtgtatatctctctggtaca

SEQ ID NO: 222327 - DNA, 23 bp, Mus musculus
atgtgagttttgagtctgtgagg

SEQ ID NO: 222328 - DNA, 23 bp, Mus musculus
cacattatatatgtatgtgtaca

SEQ ID NO: 222329 - DNA, 23 bp, Mus musculus
atgtatatatgtatgtatgtgtg

SEQ ID NO: 222330 - DNA, 23 bp, Mus musculus
atatgtatgtatatatgtgtgtg

SEQ ID NO: 222331 - DNA, 23 bp, Mus musculus
gtgactctctctctctctctata

SEQ ID NO: 222332 - DNA, 19 bp, Mus musculus
gtgcacctcagtgtgttct

SEQ ID NO: 222333 - DNA, 23 bp, Mus musculus
atcagtctcactctgactttgtg

SEQ ID NO: 222334 - DNA, 19 bp, Mus musculus
agagcttttctttaggaga

SEQ ID NO: 222335 - DNA, 23 bp, Mus musculus
ccactctctgcctctctgtccac

SEQ ID NO: 222336 - DNA, 22 bp, Mus musculus
acagtgaggagagatagttgtt

SEQ ID NO: 222337 - DNA, 23 bp, Mus musculus
tgagcatctgcatctgtattggt

SEQ ID NO: 222338 - DNA, 23 bp, Mus musculus
attcttgctgttgatagaggtga

SEQ ID NO: 222339 - DNA, 23 bp, Mus musculus
tgtcttctctcactgacagctga

SEQ ID NO: 222340 - DNA, 22 bp, Mus musculus
tgacagaggaggggctggacag

SEQ ID NO: 222341 - DNA, 23 bp, Mus musculus
aactgactgctcttccagaggtc

SEQ ID NO: 222342 - DNA, 23 bp, Mus musculus
tccactgtacactgttggtgtgg

SEQ ID NO: 222343 - DNA, 23 bp, Mus musculus
tttgtcactggctgacctggaac

SEQ ID NO: 222344 - DNA, 20 bp, Mus musculus
caggctggctttgaactcag

SEQ ID NO: 222345 - DNA, 21 bp, Mus musculus
ttctggagttgtaagagcaac

SEQ ID NO: 222346 - DNA, 23 bp, Mus musculus
tcttgctcacactgtgtgtggcc

SEQ ID NO: 222347 - DNA, 18 bp, Mus musculus
tcatggaagttctacagt

SEQ ID NO: 222348 - DNA, 23 bp, Mus musculus
atctgtgtctgtgagattcagct

SEQ ID NO: 222349 - DNA, 23 bp, Mus musculus
atgtgtgcatatatatacatata

SEQ ID NO: 222350 - DNA, 23 bp, Mus musculus
atatgtgtgtatgtatatgtata

SEQ ID NO: 222351 - DNA, 22 bp, Mus musculus
ataggatgtagtttgtattctt

SEQ ID NO: 222352 - DNA, 22 bp, Mus musculus
tatgtgcatttacatgaagtga

SEQ ID NO: 222353 - DNA, 23 bp, Mus musculus
tgttccatgtgtgtgtgtgcata

SEQ ID NO: 222354 - DNA, 20 bp, Mus musculus
tgcatgtatgtatatatgta

SEQ ID NO: 222355 - DNA, 22 bp, Mus musculus
tgttttgtgaccaattatatgg

SEQ ID NO: 222356 - DNA, 23 bp, Mus musculus
tagtgcatggtgatctgatagga

SEQ ID NO: 222357 - DNA, 20 bp, Mus musculus
ttttgtgaccaattatatgg

SEQ ID NO: 222358 - DNA, 23 bp, Mus musculus
atgggtgaccctcagtctctccc

SEQ ID NO: 222359 - DNA, 20 bp, Mus musculus
tatactaaaattcctgttct

SEQ ID NO: 222360 - DNA, 23 bp, Mus musculus
gtgtctctctgtatcttcatgtg

SEQ ID NO: 222361 - DNA, 20 bp, Mus musculus
aagagtcacatgggattaag

SEQ ID NO: 222362 - DNA, 23 bp, Mus musculus
actgcctgacacagattaaggac

SEQ ID NO: 222363 - DNA, 21 bp, Mus musculus
atagtcattcaatatatgtgt

SEQ ID NO: 222364 - DNA, 19 bp, Mus musculus
ggcagtctgagcctctgtc

SEQ ID NO: 222365 - DNA, 23 bp, Mus musculus
aggactgaggctgcttttgaggt

SEQ ID NO: 222366 - DNA, 18 bp, Mus musculus
taatggatgaaggtgtat

SEQ ID NO: 222367 - DNA, 23 bp, Mus musculus
ttctcactggctctcttactcta

SEQ ID NO: 222368 - DNA, 23 bp, Mus musculus
tgggtcagcatgtgtgtgtgtgt

SEQ ID NO: 222369 - DNA, 18 bp, Mus musculus
tgtggttctttgtatgtg

SEQ ID NO: 222370 - DNA, 23 bp, Mus musculus
gacacagactcagacagaaacat

SEQ ID NO: 222371 - DNA, 23 bp, Mus musculus
tgaaagtcactgctcttcctgtc

SEQ ID NO: 222372 - DNA, 23 bp, Mus musculus
tatgtgtgtgtatatgtttatat

SEQ ID NO: 222373 - DNA, 23 bp, Mus musculus
atgtatatgtgtatatgtgtatg

SEQ ID NO: 222374 - DNA, 19 bp, Mus musculus
acagagcagagtcagctga

SEQ ID NO: 222375 - DNA, 20 bp, Mus musculus
tggtagatgatcagcccttg

SEQ ID NO: 222376 - DNA, 23 bp, Mus musculus
gagtcccacagtggctgtctcac

SEQ ID NO: 222377 - DNA, 23 bp, Mus musculus
tctctctctctctgggtgtccca

SEQ ID NO: 222378 - DNA, 23 bp, Mus musculus
caagctcagagaggtggatgagt

SEQ ID NO: 222379 - DNA, 20 bp, Mus musculus
ggtctggaccaggtcctctg

SEQ ID NO: 222380 - DNA, 23 bp, Mus musculus
gaggcacagtctgtactcagtgt

SEQ ID NO: 222381 - DNA, 23 bp, Mus musculus
ctgtctctcacagtgcctgtacc

SEQ ID NO: 222382 - DNA, 23 bp, Mus musculus
gaacactgactgctcttccagag

SEQ ID NO: 222383 - DNA, 22 bp, Mus musculus
tcactgactgctcttccagagg

SEQ ID NO: 222384 - DNA, 21 bp, Mus musculus
accaagtcctcgagctggaga

SEQ ID NO: 222385 - DNA, 23 bp, Mus musculus
agaagacccctgactggagagat

SEQ ID NO: 222386 - DNA, 20 bp, Mus musculus
aagagcactgactgctcttc

SEQ ID NO: 222387 - DNA, 22 bp, Mus musculus
tgtggatgtatgtacatatgta

SEQ ID NO: 222388 - DNA, 23 bp, Mus musculus
gtgtgtgtctctgtgtgtgtacg

SEQ ID NO: 222389 - DNA, 23 bp, Mus musculus
tgtctgtctgtctgtctgtgggc

SEQ ID NO: 222390 - DNA, 23 bp, Mus musculus
tcatgctttgcagctctcagtgc

SEQ ID NO: 222391 - DNA, 18 bp, Mus musculus
tctgtgataagcttgagg

SEQ ID NO: 222392 - DNA, 23 bp, Mus musculus
ctcctgtctgtctgtgagtctag

SEQ ID NO: 222393 - DNA, 19 bp, Mus musculus
gtgtgagcacagcctccag

SEQ ID NO: 222394 - DNA, 19 bp, Mus musculus
tctcagtgccccacatagc

SEQ ID NO: 222395 - DNA, 23 bp, Mus musculus
aagagcactgactgctcttccag

SEQ ID NO: 222396 - DNA, 20 bp, Mus musculus
aagagcactgactgctcttc

SEQ ID NO: 222397 - DNA, 23 bp, Mus musculus
gtgctctgactctctgggtcagc

SEQ ID NO: 222398 - DNA, 23 bp, Mus musculus
gtctgtcactcgttctctatccc

SEQ ID NO: 222399 - DNA, 22 bp, Mus musculus
tgagagggcaagcactgtcact

SEQ ID NO: 222400 - DNA, 23 bp, Mus musculus
tcacaggcaacagtcttctctct

SEQ ID NO: 222401 - DNA, 23 bp, Mus musculus
tctctcagagatcagagaggtca

SEQ ID NO: 222402 - DNA, 23 bp, Mus musculus
cctcaggtatgtgtgtgtattga

SEQ ID NO: 222403 - DNA, 22 bp, Mus musculus
actttacattatatgatgtaag

SEQ ID NO: 222404 - DNA, 23 bp, Mus musculus
tgtgcctctctctgcctgtccct

SEQ ID NO: 222405 - DNA, 23 bp, Mus musculus
atgtatgcatgtatgtatgagtg

SEQ ID NO: 222406 - DNA, 23 bp, Mus musculus
tgactgactcacactgaatcttg

SEQ ID NO: 222407 - DNA, 23 bp, Mus musculus
atgacacacacacatatatatgt

SEQ ID NO: 222408 - DNA, 23 bp, Mus musculus
tctgtctgtccatctgtctgcct

SEQ ID NO: 222409 - DNA, 23 bp, Mus musculus
taagagcactgactgctcttcca

SEQ ID NO: 222410 - DNA, 20 bp, Mus musculus
cagatctgtcccctctctcg

SEQ ID NO: 222411 - DNA, 23 bp, Mus musculus
agagagagaacagacttgctcct

SEQ ID NO: 222412 - DNA, 23 bp, Mus musculus
gaatctcagggtggttttgattt

SEQ ID NO: 222413 - DNA, 19 bp, Mus musculus
tgcatgtatgtatgtatgt

SEQ ID NO: 222414 - DNA, 23 bp, Mus musculus
caggagagtcagtgcacagtggc

SEQ ID NO: 222415 - DNA, 22 bp, Mus musculus
gctcagcctctgtcactgtcca

SEQ ID NO: 222416 - DNA, 23 bp, Mus musculus
ctttgagtctgtgctttgctagt

SEQ ID NO: 222417 - DNA, 20 bp, Mus musculus
aaagcaccttactgtggagc

SEQ ID NO: 222418 - DNA, 23 bp, Mus musculus
ctgtgttattcatccctgactca

SEQ ID NO: 222419 - DNA, 23 bp, Mus musculus
cagagagaagagagtgtggcact

SEQ ID NO: 222420 - DNA, 23 bp, Mus musculus
ctctgcctgcctcccagactggc

SEQ ID NO: 222421 - DNA, 23 bp, Mus musculus
acagacagacagataggccagac

SEQ ID NO: 222422 - DNA, 19 bp, Mus musculus
aatgatagaatgtgactgc

SEQ ID NO: 222423 - DNA, 19 bp, Mus musculus
agtcttgtattaagtttgg

SEQ ID NO: 222424 - DNA, 23 bp, Mus musculus
gtgtgtctgtgtgtgtgtcctgg

SEQ ID NO: 222425 - DNA, 23 bp, Mus musculus
tgctgtctctctgtgtgcgtcac

SEQ ID NO: 222426 - DNA, 23 bp, Mus musculus
atgtgtatatatgtatatatgtg

SEQ ID NO: 222427 - DNA, 21 bp, Mus musculus
ttcacataagtcagtcagcag

SEQ ID NO: 222428 - DNA, 22 bp, Mus musculus
tgtgcaagtatgtgtgtgtgta

SEQ ID NO: 222429 - DNA, 23 bp, Mus musculus
tacagttgagattttgttaaact

SEQ ID NO: 222430 - DNA, 23 bp, Mus musculus
ttaactatctcctgtctctttag

SEQ ID NO: 222431 - DNA, 23 bp, Mus musculus
ctctgggtctctgtctctctcta

SEQ ID NO: 222432 - DNA, 23 bp, Mus musculus
gtcttgtgtctgtctctcaccac

SEQ ID NO: 222433 - DNA, 23 bp, Mus musculus
ttctctcactctcttctgttgcc

SEQ ID NO: 222434 - DNA, 19 bp, Mus musculus
cagaggacaagtcttggga

SEQ ID NO: 222435 - DNA, 23 bp, Mus musculus
tgtgtgtgtgtatgtgtgtctat

SEQ ID NO: 222436 - DNA, 21 bp, Mus musculus
cagccttggaagagaggcgga

SEQ ID NO: 222437 - DNA, 23 bp, Mus musculus
ggtatgtgtatatgtatatgtgt

SEQ ID NO: 222438 - DNA, 23 bp, Mus musculus
atgaatgagtttatgtatatgag

SEQ ID NO: 222439 - DNA, 22 bp, Mus musculus
atgtatgcatgcatgtgtgtat

SEQ ID NO: 222440 - DNA, 23 bp, Mus musculus
tttttgcattttctgataaggaa

SEQ ID NO: 222441 - DNA, 19 bp, Mus musculus
aatctcgaaggttagcatg

SEQ ID NO: 222442 - DNA, 22 bp, Mus musculus
tcagtgtcaactcatgctactt

SEQ ID NO: 222443 - DNA, 23 bp, Mus musculus
atgagatagcagagagagtgcac

SEQ ID NO: 222444 - DNA, 23 bp, Mus musculus
gtcacactcaccctgtgcctcac

SEQ ID NO: 222445 - DNA, 21 bp, Mus musculus
attctcagtcctttccatagc

SEQ ID NO: 222446 - DNA, 23 bp, Mus musculus
atctgtcagttgtgggaagattg

SEQ ID NO: 222447 - DNA, 23 bp, Mus musculus
aatttgcactatatgtataatgt

SEQ ID NO: 222448 - DNA, 18 bp, Mus musculus
tatatgtgtatatgtatt

SEQ ID NO: 222449 - DNA, 21 bp, Mus musculus
tcagctctctcacactcacac

SEQ ID NO: 222450 - DNA, 18 bp, Mus musculus
atgttggtctgataggat

SEQ ID NO: 222451 - DNA, 22 bp, Mus musculus
tgttttgtgaccaattatatgg

SEQ ID NO: 222452 - DNA, 23 bp, Mus musculus
tatatgaagcttataaaatgata

SEQ ID NO: 222453 - DNA, 23 bp, Mus musculus
gtctgtctgtctctctgcctgcc

SEQ ID NO: 222454 - DNA, 22 bp, Mus musculus
ttcacagtgtgcacactggggc

SEQ ID NO: 222455 - DNA, 23 bp, Mus musculus
ctcagaacagagtgaacagacta

SEQ ID NO: 222456 - DNA, 21 bp, Mus musculus
ttgatgtcattggtcctttgt

SEQ ID NO: 222457 - DNA, 23 bp, Mus musculus
ctccgactctatactctggacac

SEQ ID NO: 222458 - DNA, 23 bp, Mus musculus
atgtatgtgtgtatatgtatgtg

SEQ ID NO: 222459 - DNA, 23 bp, Mus musculus
atgtatgtatgcatgtatgtgta

SEQ ID NO: 222460 - DNA, 22 bp, Mus musculus
gtgacaggctgtttggtgtcac

SEQ ID NO: 222461 - DNA, 23 bp, Mus musculus
ccatgcctgcctgcctgtatgac

SEQ ID NO: 222462 - DNA, 23 bp, Mus musculus
tgtgtgtatgtctgtgtgtgtgt

SEQ ID NO: 222463 - DNA, 22 bp, Mus musculus
ctttgaccagtctctctgtcac

SEQ ID NO: 222464 - DNA, 23 bp, Mus musculus
gcgtgcgtgcgtgcgtgcgtgcg

SEQ ID NO: 222465 - DNA, 23 bp, Mus musculus
tgcatgcctgtgtgcctgtgtgc

SEQ ID NO: 222466 - DNA, 23 bp, Mus musculus
acacacatatatatatgtatatg

SEQ ID NO: 222467 - DNA, 23 bp, Mus musculus
ttttgtatgtacctgtgtgtata

SEQ ID NO: 222468 - DNA, 23 bp, Mus musculus
tccttgtgggtggcattgaggct

SEQ ID NO: 222469 - DNA, 23 bp, Mus musculus
catgtatatgtgtgtgtatatga

SEQ ID NO: 222470 - DNA, 19 bp, Mus musculus
tcacaggaaagagtgtgcc

SEQ ID NO: 222471 - DNA, 23 bp, Mus musculus
gcatgcatgcatgcatgtatgcc

SEQ ID NO: 222472 - DNA, 18 bp, Mus musculus
aaggtagattggagatga

SEQ ID NO: 222473 - DNA, 23 bp, Mus musculus
aggatgacagaagtgtgtgtgtt

SEQ ID NO: 222474 - DNA, 23 bp, Mus musculus
cttagtggacactctctctgtga

SEQ ID NO: 222475 - DNA, 23 bp, Mus musculus
gacagtgtcaactgagtgagctc

SEQ ID NO: 222476 - DNA, 21 bp, Mus musculus
atcagcttaagattaactgag

SEQ ID NO: 222477 - DNA, 23 bp, Mus musculus
atttgtgtatatatgtatatgtt

SEQ ID NO: 222478 - DNA, 21 bp, Mus musculus
atgtatatacatgtatatgta

SEQ ID NO: 222479 - DNA, 23 bp, Mus musculus
gagatctgcctgtctctgcctct

SEQ ID NO: 222480 - DNA, 22 bp, Mus musculus
aatgagagagggtgataagaca

SEQ ID NO: 222481 - DNA, 23 bp, Mus musculus
tttgagtgcaatgataacaggga

SEQ ID NO: 222482 - DNA, 23 bp, Mus musculus
tgtatgtgtgcatgtgtatgtgc

SEQ ID NO: 222483 - DNA, 23 bp, Mus musculus
tgtgtgcatgtgtgtgtgtgtct

SEQ ID NO: 222484 - DNA, 23 bp, Mus musculus
tgtatgacacaggtatgtgtgtg

SEQ ID NO: 222485 - DNA, 19 bp, Mus musculus
atgtgtgtgtgtgcatacg

SEQ ID NO: 222486 - DNA, 23 bp, Mus musculus
gtcaatgtctgtggctcatacta

SEQ ID NO: 222487 - DNA, 19 bp, Mus musculus
gaccatgaggacatccctg

SEQ ID NO: 222488 - DNA, 23 bp, Mus musculus
atatgtgtatatgtatatgtcac

SEQ ID NO: 222489 - DNA, 22 bp, Mus musculus
tatgacacacatatgtatatga

SEQ ID NO: 222490 - DNA, 18 bp, Mus musculus
aggattcaaggtgtgaga

SEQ ID NO: 222491 - DNA, 22 bp, Mus musculus
gagtgtacatagaacctgtaca

SEQ ID NO: 222492 - DNA, 23 bp, Mus musculus
acagggcctttacattctgctgt

SEQ ID NO: 222493 - DNA, 23 bp, Mus musculus
acatcaccaccttcaggtccatg

SEQ ID NO: 222494 - DNA, 22 bp, Mus musculus
ctgtctctctgtgtgctcaggt

SEQ ID NO: 222495 - DNA, 23 bp, Mus musculus
ctgggtcactgagtcactgggtc

SEQ ID NO: 222496 - DNA, 22 bp, Mus musculus
tcactgggtcattgggtcactg

SEQ ID NO: 222497 - DNA, 23 bp, Mus musculus
tgtgtgtatatgtaattgtgtgc

SEQ ID NO: 222498 - DNA, 21 bp, Mus musculus
tgtgcctgtcagtcactgaga

SEQ ID NO: 222499 - DNA, 23 bp, Mus musculus
actgcatctgtgacagggtttga

SEQ ID NO: 222500 - DNA, 23 bp, Mus musculus
ggtcagtccgtctgtgtgtcatt

SEQ ID NO: 222501 - DNA, 22 bp, Mus musculus
tgttttgtgaccaattatatgg

SEQ ID NO: 222502 - DNA, 23 bp, Mus musculus
tctgcaagatcaatgcatgctct

SEQ ID NO: 222503 - DNA, 20 bp, Mus musculus
ttaagagcactgactgctct

SEQ ID NO: 222504 - DNA, 22 bp, Mus musculus
tgcatgtatgtatgcatgtatg

SEQ ID NO: 222505 - DNA, 23 bp, Mus musculus
tgtgtggctccgtgtgtggctcc

SEQ ID NO: 222506 - DNA, 22 bp, Mus musculus
tgttttgtgaccaattatatgg

SEQ ID NO: 222507 - DNA, 23 bp, Mus musculus
ttcagcagatgtcatactcttca

SEQ ID NO: 222508 - DNA, 22 bp, Mus musculus
agagagatgacactcagcaaga

SEQ ID NO: 222509 - DNA, 21 bp, Mus musculus
tgaggagctctctctctctct

SEQ ID NO: 222510 - DNA, 21 bp, Mus musculus
tttagatctacaggacgtgag

SEQ ID NO: 222511 - DNA, 23 bp, Mus musculus
cataccgactctctcactttctc

SEQ ID NO: 222512 - DNA, 23 bp, Mus musculus
tatttgtatttgtatatctgttg

SEQ ID NO: 222513 - DNA, 21 bp, Mus musculus
tctgacaagactgtgaggtgt

SEQ ID NO: 222514 - DNA, 23 bp, Mus musculus
tgtgtatctctgtgtgtgtcttc

SEQ ID NO: 222515 - DNA, 23 bp, Mus musculus
aaaagagagtgctttaatataca

SEQ ID NO: 222516 - DNA, 21 bp, Mus musculus
acacacacacacatatatatg

SEQ ID NO: 222517 - DNA, 18 bp, Mus musculus
tatgtatatatatatatg

SEQ ID NO: 222518 - DNA, 21 bp, Mus musculus
tttttgatcttagcgattctg

SEQ ID NO: 222519 - DNA, 21 bp, Mus musculus
tacagttttcctcatcatgta

SEQ ID NO: 222520 - DNA, 23 bp, Mus musculus
taaagcttccatttcatgtggtt

SEQ ID NO: 222521 - DNA, 22 bp, Mus musculus
tgttttgtgaccaattatatgg

SEQ ID NO: 222522 - DNA, 23 bp, Mus musculus
ctgagaactcattttgaagaaga

SEQ ID NO: 222523 - DNA, 23 bp, Mus musculus
tcaacttcaaagagcttctgcct

SEQ ID NO: 222524 - DNA, 23 bp, Mus musculus
tatctgtgtgtttatgtacttat

SEQ ID NO: 222525 - DNA, 19 bp, Mus musculus
tccatccatccatatgtaa

SEQ ID NO: 222526 - DNA, 22 bp, Mus musculus
tctgaaattatgctacagagtg

SEQ ID NO: 222527 - DNA, 22 bp, Mus musculus
attcttgctattggtctctatg

SEQ ID NO: 222528 - DNA, 18 bp, Mus musculus
tttgctttaaagtgaaat

SEQ ID NO: 222529 - DNA, 18 bp, Mus musculus
cactgcatttatttatgt

SEQ ID NO: 222530 - DNA, 23 bp, Mus musculus
tatgtatgtatgtatgtatatgt

SEQ ID NO: 222531 - DNA, 22 bp, Mus musculus
aatgtaagttaaggaaccagaa

SEQ ID NO: 222532 - DNA, 23 bp, Mus musculus
ttgagcccagagactgagccgtg

SEQ ID NO: 222533 - DNA, 22 bp, Mus musculus
tgttttgtgaccaattatatgg

SEQ ID NO: 222534 - DNA, 23 bp, Mus musculus
tgcaaatgaaagaactcagtggg

SEQ ID NO: 222535 - DNA, 23 bp, Mus musculus
gtatgtatgtatgtatgtatgta

SEQ ID NO: 222536 - DNA, 22 bp, Mus musculus
tgttttgtgaccaattatatgg

SEQ ID NO: 222537 - DNA, 20 bp, Mus musculus
tgtgtatatatatgtatatg

SEQ ID NO: 222538 - DNA, 19 bp, Mus musculus
tatgtatatatgtatgtac

SEQ ID NO: 222539 - DNA, 20 bp, Mus musculus
cagttgctatttagaactaa

SEQ ID NO: 222540 - DNA, 23 bp, Mus musculus
ttcacagccacattaactcgtat

SEQ ID NO: 222541 - DNA, 22 bp, Mus musculus
atatgcacacatacatatgagt

SEQ ID NO: 222542 - DNA, 21 bp, Mus musculus
atatatgtatatgtttgtgta

SEQ ID NO: 222543 - DNA, 22 bp, Mus musculus
tgttttgtgaccaattatatgg

SEQ ID NO: 222544 - DNA, 22 bp, Mus musculus
tctcagtcacctgctggtagag

SEQ ID NO: 222545 - DNA, 22 bp, Mus musculus
tgttttgtgaccaattatatgg

SEQ ID NO: 222546 - DNA, 23 bp, Mus musculus
tatcacacccagctatttacatg

SEQ ID NO: 222547 - DNA, 22 bp, Mus musculus
tgttttgtgaccaattatatgg

SEQ ID NO: 222548 - DNA, 18 bp, Mus musculus
tacatatacacataggtt

SEQ ID NO: 222549 - DNA, 23 bp, Mus musculus
ttatgtgtatatgtatttgtcag

SEQ ID NO: 222550 - DNA, 22 bp, Mus musculus
tgttttgtgaccaattatatgg

SEQ ID NO: 222551 - DNA, 23 bp, Mus musculus
taatagtgtcaggttttggtgcc

SEQ ID NO: 222552 - DNA, 23 bp, Mus musculus
tcagtctttctctctgtaactcc

SEQ ID NO: 222553 - DNA, 23 bp, Mus musculus
gagtctgtgtcactgactctgct

SEQ ID NO: 222554 - DNA, 22 bp, Mus musculus
tgttttgtgaccaattatatgg

SEQ ID NO: 222555 - DNA, 22 bp, Mus musculus
tgttttgtgaccaattatatgg

SEQ ID NO: 222556 - DNA, 22 bp, Mus musculus
tgttttgtgaccaattatatgg

SEQ ID NO: 222557 - DNA, 23 bp, Mus musculus
ataagaaagaagtgtgtgagctg

SEQ ID NO: 222558 - DNA, 22 bp, Mus musculus
tacattgagacaagttttgtgt

SEQ ID NO: 222559 - DNA, 22 bp, Mus musculus
tgttttgtgaccaattatatgg

SEQ ID NO: 222560 - DNA, 23 bp, Mus musculus
aatatctggatcacatatcagaa

SEQ ID NO: 222561 - DNA, 22 bp, Mus musculus
tgtttaattctgttggatagac

SEQ ID NO: 222562 - DNA, 22 bp, Mus musculus
tctggggtctatatctgtgttt

SEQ ID NO: 222563 - DNA, 23 bp, Mus musculus
acttgacacagcataagtagaca

SEQ ID NO: 222564 - DNA, 21 bp, Mus musculus
ttcagctggtgtatgctgcct

SEQ ID NO: 222565 - DNA, 22 bp, Mus musculus
tgtgtgtatgatgtttgcatat

SEQ ID NO: 222566 - DNA, 23 bp, Mus musculus
aagctcaagcactctttctcact

SEQ ID NO: 222567 - DNA, 23 bp, Mus musculus
tgtgtgtgtctgtctctgtgggt

SEQ ID NO: 222568 - DNA, 22 bp, Mus musculus
atatatgtacatgtacatgtat

SEQ ID NO: 222569 - DNA, 19 bp, Mus musculus
tagttcaaccacaggtgtc

SEQ ID NO: 222570 - DNA, 22 bp, Mus musculus
tgttttgtgaccaattatatgg

SEQ ID NO: 222571 - DNA, 22 bp, Mus musculus
tgttttgtgaccaattatatgg

SEQ ID NO: 222572 - DNA, 20 bp, Mus musculus
ggaatacatatatatatgga

SEQ ID NO: 222573 - DNA, 21 bp, Mus musculus
tccatggtggtctgataggat

SEQ ID NO: 222574 - DNA, 22 bp, Mus musculus
tgttttgtgaccaattatatgg

SEQ ID NO: 222575 - DNA, 23 bp, Mus musculus
gcctctgtgtgtgtgtgtgatga

SEQ ID NO: 222576 - DNA, 19 bp, Mus musculus
caggatctgaactcatcat

SEQ ID NO: 222577 - DNA, 23 bp, Mus musculus
attctctgggtgagtttgaggtc

SEQ ID NO: 222578 - DNA, 22 bp, Mus musculus
agcaactcatttgtcattctga

SEQ ID NO: 222579 - DNA, 23 bp, Mus musculus
tatcttaggtattctaggttttt

SEQ ID NO: 222580 - DNA, 22 bp, Mus musculus
tgttttgtgaccaattatatgg

SEQ ID NO: 222581 - DNA, 18 bp, Mus musculus
tatagtttagaactgata

SEQ ID NO: 222582 - DNA, 21 bp, Mus musculus
tgtgcatgcacatatgcatgt

SEQ ID NO: 222583 - DNA, 19 bp, Mus musculus
atgtgtgcatatgcatgtg

SEQ ID NO: 222584 - DNA, 22 bp, Mus musculus
tgttttgtgaccaattatatgg

SEQ ID NO: 222585 - DNA, 23 bp, Mus musculus
tagtgcatcgtgatctgatagga

SEQ ID NO: 222586 - DNA, 23 bp, Mus musculus
tgttttgtgacctattatgtggt

SEQ ID NO: 222587 - DNA, 21 bp, Mus musculus
ttctagttcactctcttgctg

SEQ ID NO: 222588 - DNA, 23 bp, Mus musculus
aaaacagttcagagagagcagaa

SEQ ID NO: 222589 - DNA, 19 bp, Mus musculus
tccctcatggacctatttg

SEQ ID NO: 222590 - DNA, 22 bp, Mus musculus
taaggattatctttgtgttttc

SEQ ID NO: 222591 - DNA, 20 bp, Mus musculus
cactgtctgagctggtgctc

SEQ ID NO: 222592 - DNA, 23 bp, Mus musculus
ctgtctgtctgtctgtctatcat

SEQ ID NO: 222593 - DNA, 22 bp, Mus musculus
tagagcaatatttttcttgaac

SEQ ID NO: 222594 - DNA, 22 bp, Mus musculus
cacactgtgcagtaaggctctg

SEQ ID NO: 222595 - DNA, 23 bp, Mus musculus
tgagactagagaatctgatcttg

SEQ ID NO: 222596 - DNA, 23 bp, Mus musculus
ttagagaaacgtttgcctctgtc

SEQ ID NO: 222597 - DNA, 23 bp, Mus musculus
agaagaggcagagtttgctgact

SEQ ID NO: 222598 - DNA, 18 bp, Mus musculus
agactgcgtgtctgcatg

SEQ ID NO: 222599 - DNA, 23 bp, Mus musculus
tgtagatgcatgtgtgtgtatgt

SEQ ID NO: 222600 - DNA, 23 bp, Mus musculus
tatgtatgtatgtgcatatgtag

SEQ ID NO: 222601 - DNA, 20 bp, Mus musculus
tatgtgtgtgtttatgtaga

SEQ ID NO: 222602 - DNA, 22 bp, Mus musculus
tatgtatgtatgtatgtatgta

SEQ ID NO: 222603 - DNA, 22 bp, Mus musculus
tgtctcagtgactgacaggcac

SEQ ID NO: 222604 - DNA, 23 bp, Mus musculus
tgacatcttggtgaatggaacat

SEQ ID NO: 222605 - DNA, 23 bp, Mus musculus
cagactgactgactcaatgaggt

SEQ ID NO: 222606 - DNA, 20 bp, Mus musculus
gtttctggatcatttcacag

SEQ ID NO: 222607 - DNA, 23 bp, Mus musculus
attgaaaggagacagtgagctga

SEQ ID NO: 222608 - DNA, 20 bp, Mus musculus
gtggctgtggctgtggctgt

SEQ ID NO: 222609 - DNA, 23 bp, Mus musculus
tgtggctgtggctgcagctgcag

SEQ ID NO: 222610 - DNA, 23 bp, Mus musculus
tctgtctgtctgtctgtctgtct

SEQ ID NO: 222611 - DNA, 19 bp, Mus musculus
atatactatttgctattgt

SEQ ID NO: 222612 - DNA, 23 bp, Mus musculus
aaagagtccctgtgtctgagtct

SEQ ID NO: 222613 - DNA, 21 bp, Mus musculus
tccatggtggtctgataggat

SEQ ID NO: 222614 - DNA, 23 bp, Mus musculus
gtatatatgtatatatacatgta

SEQ ID NO: 222615 - DNA, 23 bp, Mus musculus
atgtgtgtgtatgtgtgtatgct

SEQ ID NO: 222616 - DNA, 23 bp, Mus musculus
atgtatgtatgtatgtatgtatg

SEQ ID NO: 222617 - DNA, 23 bp, Mus musculus
tctgtgagagctgtgagaggaga

SEQ ID NO: 222618 - DNA, 22 bp, Mus musculus
tgcctggctctcacaccctctc

SEQ ID NO: 222619 - DNA, 23 bp, Mus musculus
tctgtgtgttagtataatctggg

SEQ ID NO: 222620 - DNA, 20 bp, Mus musculus
acacagacacacagtgtttt

SEQ ID NO: 222621 - DNA, 23 bp, Mus musculus
tggagtctgaagtaagtgtgctc

SEQ ID NO: 222622 - DNA, 23 bp, Mus musculus
agtgtagatttccctctgtgatt

SEQ ID NO: 222623 - DNA, 20 bp, Mus musculus
atccacccctaccaggagga

SEQ ID NO: 222624 - DNA, 23 bp, Mus musculus
gctctctctatgtctgactgggt

SEQ ID NO: 222625 - DNA, 22 bp, Mus musculus
cccagagtatcctggatgtcct

SEQ ID NO: 222626 - DNA, 21 bp, Mus musculus
tgagagtggaaagtcagaggt

SEQ ID NO: 222627 - DNA, 23 bp, Mus musculus
gaattggaaaagaatgtgatttg

SEQ ID NO: 222628 - DNA, 20 bp, Mus musculus
ttagtttttgttaggatgat

SEQ ID NO: 222629 - DNA, 22 bp, Mus musculus
tacactggtgagggtggagtat

SEQ ID NO: 222630 - DNA, 23 bp, Mus musculus
actctctcacaatcagtgtgtaa

SEQ ID NO: 222631 - DNA, 22 bp, Mus musculus
tgatttaagctctagtagtgtt

SEQ ID NO: 222632 - DNA, 23 bp, Mus musculus
ctgaagtgtgtgtgcgcatgtgg

SEQ ID NO: 222633 - DNA, 21 bp, Mus musculus
atgtgggtgtgcatatgattg

SEQ ID NO: 222634 - DNA, 23 bp, Mus musculus
tgtgcatgtatgtacgtatgtat

SEQ ID NO: 222635 - DNA, 23 bp, Mus musculus
tgtatgtatgtatgtatgtatgt

SEQ ID NO: 222636 - DNA, 23 bp, Mus musculus
aacagtactgtgagagcagttga

SEQ ID NO: 222637 - DNA, 23 bp, Mus musculus
actgtgccttctctcactctctc

SEQ ID NO: 222638 - DNA, 23 bp, Mus musculus
ctctgacactcagtgcctgcctt

SEQ ID NO: 222639 - DNA, 23 bp, Mus musculus
cagtccctgtcactgtcttttga

SEQ ID NO: 222640 - DNA, 23 bp, Mus musculus
tgtgtatatgtatgcatgtatgt

SEQ ID NO: 222641 - DNA, 18 bp, Mus musculus
gagccactgggtcaccga

SEQ ID NO: 222642 - DNA, 23 bp, Mus musculus
ttgctgactgagatgtcttccca

SEQ ID NO: 222643 - DNA, 23 bp, Mus musculus
ttgtatactagaggaagagttac

SEQ ID NO: 222644 - DNA, 19 bp, Mus musculus
agctctgttctcaagctga

SEQ ID NO: 222645 - DNA, 20 bp, Mus musculus
tttgcaatacatgttgagtc

SEQ ID NO: 222646 - DNA, 23 bp, Mus musculus
atatttcaatttgatatcacagt

SEQ ID NO: 222647 - DNA, 23 bp, Mus musculus
atcctctagtccccagtgagtct

SEQ ID NO: 222648 - DNA, 23 bp, Mus musculus
cagggaagctgtgtctctctgtg

SEQ ID NO: 222649 - DNA, 22 bp, Mus musculus
ctgacagaacactgagaggtga

SEQ ID NO: 222650 - DNA, 22 bp, Mus musculus
tgtgaggctgtccacctggtga

SEQ ID NO: 222651 - DNA, 23 bp, Mus musculus
tctgggctttgtgtctctgtctg

SEQ ID NO: 222652 - DNA, 23 bp, Mus musculus
cacatgaagatgagagtgtccac

SEQ ID NO: 222653 - DNA, 23 bp, Mus musculus
tggaattcaggcagtttatcatc

SEQ ID NO: 222654 - DNA, 23 bp, Mus musculus
taaatgatagctttctaaaactc

SEQ ID NO: 222655 - DNA, 22 bp, Mus musculus
tgtcagagtattttgttatctg

SEQ ID NO: 222656 - DNA, 23 bp, Mus musculus
atgtatgtgtgtatgtgtatgta

SEQ ID NO: 222657 - DNA, 23 bp, Mus musculus
atacactgacacaaagctgtatg

SEQ ID NO: 222658 - DNA, 23 bp, Mus musculus
ttactcagacgtaaaacacagtg

SEQ ID NO: 222659 - DNA, 23 bp, Mus musculus
tgactgtgtgtgtgtgtgtgtgc

SEQ ID NO: 222660 - DNA, 20 bp, Mus musculus
tgacagctctcactgtgcac

SEQ ID NO: 222661 - DNA, 23 bp, Mus musculus
gtctatctgtgtctctctggtac

SEQ ID NO: 222662 - DNA, 23 bp, Mus musculus
gtgtgtctctctctgtggatggg

SEQ ID NO: 222663 - DNA, 23 bp, Mus musculus
atgagacaagtgtgtgcacacac

SEQ ID NO: 222664 - DNA, 22 bp, Mus musculus
acacacacacctttacatatgt

SEQ ID NO: 222665 - DNA, 20 bp, Mus musculus
agctagatagatcaatagat

SEQ ID NO: 222666 - DNA, 23 bp, Mus musculus
atgtatatgtgtatgtgtatgtg

SEQ ID NO: 222667 - DNA, 22 bp, Mus musculus
cagtcttaggccatggtggtct

SEQ ID NO: 222668 - DNA, 23 bp, Mus musculus
ttttgtgaccaactatatggtca

SEQ ID NO: 222669 - DNA, 22 bp, Mus musculus
agtatatgtatatgtgtatgta

SEQ ID NO: 222670 - DNA, 23 bp, Mus musculus
atcttggtttgtactgcagaaag

SEQ ID NO: 222671 - DNA, 23 bp, Mus musculus
gtgtatgtgcatctgcttctgga

SEQ ID NO: 222672 - DNA, 19 bp, Mus musculus
gtgagtccttgtattgacg

SEQ ID NO: 222673 - DNA, 20 bp, Mus musculus
ttctgcttatgtctgcccct

SEQ ID NO: 222674 - DNA, 23 bp, Mus musculus
tggtagacctgaaggtgctctca

SEQ ID NO: 222675 - DNA, 22 bp, Mus musculus
tagagtttttgtttttctcaag

SEQ ID NO: 222676 - DNA, 19 bp, Mus musculus
atataggttgtattaggta

SEQ ID NO: 222677 - DNA, 23 bp, Mus musculus
ctgtgtcctttcagtttctctct

SEQ ID NO: 222678 - DNA, 19 bp, Mus musculus
aggaggaaacaatgtttag

SEQ ID NO: 222679 - DNA, 23 bp, Mus musculus
atctctgtatattgttctgtatg

SEQ ID NO: 222680 - DNA, 18 bp, Mus musculus
tcagagctaaattctgtg

SEQ ID NO: 222681 - DNA, 20 bp, Mus musculus
tgatgagagtgaggtgttga

SEQ ID NO: 222682 - DNA, 23 bp, Mus musculus
ctgcctctctgagcctgtgatca

SEQ ID NO: 222683 - DNA, 23 bp, Mus musculus
aggtggctctcagtcactcggac

SEQ ID NO: 222684 - DNA, 23 bp, Mus musculus
ggtagaagagactacagacagac

SEQ ID NO: 222685 - DNA, 20 bp, Mus musculus
cacacacactcagacctgtg

SEQ ID NO: 222686 - DNA, 23 bp, Mus musculus
gtctgtctgtctgtctgtgtgca

SEQ ID NO: 222687 - DNA, 23 bp, Mus musculus
tgtgtatttgtatatatgtatgt

SEQ ID NO: 222688 - DNA, 23 bp, Mus musculus
tttgtgtgtataaatgtgtgtgt

SEQ ID NO: 222689 - DNA, 23 bp, Mus musculus
agactctctctcactgaggctca

SEQ ID NO: 222690 - DNA, 20 bp, Mus musculus
agtatgtaacttttttttaa

SEQ ID NO: 222691 - DNA, 23 bp, Mus musculus
ttaagtatgattaagatatgaaa

SEQ ID NO: 222692 - DNA, 23 bp, Mus musculus
aaggaccagcaggtcctgctgct

SEQ ID NO: 222693 - DNA, 21 bp, Mus musculus
tgcgtgtgtgcctgcctgtgt

SEQ ID NO: 222694 - DNA, 22 bp, Mus musculus
tgcttccctcttgtttctgaag

SEQ ID NO: 222695 - DNA, 23 bp, Mus musculus
agactgactgactgactgactct

SEQ ID NO: 222696 - DNA, 23 bp, Mus musculus
ttgacagtctggttcctcctgtt

SEQ ID NO: 222697 - DNA, 23 bp, Mus musculus
gaaaagacaggcagctaagaacc

SEQ ID NO: 222698 - DNA, 22 bp, Mus musculus
agtttccagcacctgtgttaga

SEQ ID NO: 222699 - DNA, 23 bp, Mus musculus
acatttaatccatggtactctga

SEQ ID NO: 222700 - DNA, 18 bp, Mus musculus
gtcaccagtgggaggtca

SEQ ID NO: 222701 - DNA, 23 bp, Mus musculus
actcacagccacagtgcatgcct

SEQ ID NO: 222702 - DNA, 21 bp, Mus musculus
tgaaagagcgaagcctttgct

SEQ ID NO: 222703 - DNA, 23 bp, Mus musculus
tagtgtgagagtagagtgagccc

SEQ ID NO: 222704 - DNA, 19 bp, Mus musculus
tgtctgcggttgaccactg

SEQ ID NO: 222705 - DNA, 22 bp, Mus musculus
ttgtatgtatgtatgtatgtgt

SEQ ID NO: 222706 - DNA, 22 bp, Mus musculus
tgttttgtgaccaattatatgg

SEQ ID NO: 222707 - DNA, 23 bp, Mus musculus
tgtctcactgtgtgttgagtaga

SEQ ID NO: 222708 - DNA, 22 bp, Mus musculus
tatgtgtgtatatatatgtgtg

SEQ ID NO: 222709 - DNA, 23 bp, Mus musculus
tttgactcagactatgacatcta

SEQ ID NO: 222710 - DNA, 21 bp, Mus musculus
tgtgtgtctatgtatgtgtct

SEQ ID NO: 222711 - DNA, 22 bp, Mus musculus
tgtcactgtttcactatgaggt

SEQ ID NO: 222712 - DNA, 23 bp, Mus musculus
aggtcctatgtattctgtcacag

SEQ ID NO: 222713 - DNA, 23 bp, Mus musculus
tctttctctctcagcaaggaaat

SEQ ID NO: 222714 - DNA, 23 bp, Mus musculus
tctctgtgtgtctgtgtgcgtct

SEQ ID NO: 222715 - DNA, 21 bp, Mus musculus
gagtgaactgtgggagctcac

SEQ ID NO: 222716 - DNA, 23 bp, Mus musculus
ggtctgtgtctgtttcactgtca

SEQ ID NO: 222717 - DNA, 23 bp, Mus musculus
ggtttcagaatcccaaaggtgtc

SEQ ID NO: 222718 - DNA, 23 bp, Mus musculus
gtcaaagtccatgcttaactgct

SEQ ID NO: 222719 - DNA, 23 bp, Mus musculus
ttttggtctcattttgttcatct

SEQ ID NO: 222720 - DNA, 23 bp, Mus musculus
ggagatttctgggaggcaaggat

SEQ ID NO: 222721 - DNA, 23 bp, Mus musculus
tctgagtccctctgtctctaagt

SEQ ID NO: 222722 - DNA, 20 bp, Mus musculus
tgtgtgtatatatatgtatg

SEQ ID NO: 222723 - DNA, 22 bp, Mus musculus
tctgagcagtattgagcatgag

SEQ ID NO: 222724 - DNA, 21 bp, Mus musculus
agagcactgactgctcttcca

SEQ ID NO: 222725 - DNA, 23 bp, Mus musculus
tgggaagagtgtgagcagacgca

SEQ ID NO: 222726 - DNA, 23 bp, Mus musculus
gtgtgtgtgtgtatttgcatgtg

SEQ ID NO: 222727 - DNA, 23 bp, Mus musculus
tcagttctcagcaaccacatggt

SEQ ID NO: 222728 - DNA, 23 bp, Mus musculus
ggccctgtgtctctctctttctg

SEQ ID NO: 222729 - DNA, 22 bp, Mus musculus
tcacactgaatgactctcagtg

SEQ ID NO: 222730 - DNA, 21 bp, Mus musculus
tatgcatgtatgtatatatgt

SEQ ID NO: 222731 - DNA, 21 bp, Mus musculus
ttgaaagagcagtccctgctg

SEQ ID NO: 222732 - DNA, 22 bp, Mus musculus
tttctcagaattcagtgtggag

SEQ ID NO: 222733 - DNA, 22 bp, Mus musculus
tttgggtcagcatgatatgagc

SEQ ID NO: 222734 - DNA, 20 bp, Mus musculus
tccgcctgtctctgcctctc

SEQ ID NO: 222735 - DNA, 21 bp, Mus musculus
cagtatttcctcctgtctctc

SEQ ID NO: 222736 - DNA, 19 bp, Mus musculus
gagtagtttttatttgcat

SEQ ID NO: 222737 - DNA, 22 bp, Mus musculus
aacaactcacagaagagagtta

SEQ ID NO: 222738 - DNA, 21 bp, Mus musculus
tgtctttctggggaatcttga

SEQ ID NO: 222739 - DNA, 21 bp, Mus musculus
aggcaagctttgaagtctcat

SEQ ID NO: 222740 - DNA, 19 bp, Mus musculus
taagacatggaactctcag

SEQ ID NO: 222741 - DNA, 23 bp, Mus musculus
gagcgctctgtcagtcagtctcc

SEQ ID NO: 222742 - DNA, 23 bp, Mus musculus
agagcgctctgtctgtcagtctc

SEQ ID NO: 222743 - DNA, 23 bp, Mus musculus
aggagacagctattgttggacta

SEQ ID NO: 222744 - DNA, 22 bp, Mus musculus
atcagtcctgttcctctagaga

SEQ ID NO: 222745 - DNA, 23 bp, Mus musculus
atgtctctgcttctctatgctct

SEQ ID NO: 222746 - DNA, 23 bp, Mus musculus
taacaggagagctacatttcagg

SEQ ID NO: 222747 - DNA, 23 bp, Mus musculus
tgtgtgtgtatgtattatgtatg

SEQ ID NO: 222748 - DNA, 20 bp, Mus musculus
aactatgtgcatgtatgtgc

SEQ ID NO: 222749 - DNA, 23 bp, Mus musculus
tgtgcatctctctcactgtctct

SEQ ID NO: 222750 - DNA, 18 bp, Mus musculus
ttaagaaaggtttgttaa

SEQ ID NO: 222751 - DNA, 22 bp, Mus musculus
tgttttgtgaccaattatatgg

SEQ ID NO: 222752 - DNA, 22 bp, Mus musculus
tgagagagaactctgtctggac

SEQ ID NO: 222753 - DNA, 23 bp, Mus musculus
cttagtccatggtgatctgatag

SEQ ID NO: 222754 - DNA, 23 bp, Mus musculus
aaaaacaaaatcattaggtgttg

SEQ ID NO: 222755 - DNA, 23 bp, Mus musculus
agagacaacagagagggggatca

SEQ ID NO: 222756 - DNA, 23 bp, Mus musculus
atatatgaatatatgtatgtgtg

SEQ ID NO: 222757 - DNA, 18 bp, Mus musculus
tacatatacacatacata

SEQ ID NO: 222758 - DNA, 23 bp, Mus musculus
ttgcaagtccaagtcgtcctgca

SEQ ID NO: 222759 - DNA, 21 bp, Mus musculus
tgccaggcaccgtcatagcct

SEQ ID NO: 222760 - DNA, 23 bp, Mus musculus
ttgtgtgtatatgaatatgcctg

SEQ ID NO: 222761 - DNA, 19 bp, Mus musculus
gtgtgtgtgtgtgtgtgtg

SEQ ID NO: 222762 - DNA, 22 bp, Mus musculus
tgttttgtgaccaattatatgg

SEQ ID NO: 222763 - DNA, 23 bp, Mus musculus
ctctctgcagttcttcaggagat

SEQ ID NO: 222764 - DNA, 22 bp, Mus musculus
acagagtgaagagactgcggcc

SEQ ID NO: 222765 - DNA, 22 bp, Mus musculus
tacatagtcacatacatatgtg

SEQ ID NO: 222766 - DNA, 21 bp, Mus musculus
tcacaaccatctggaattggt

SEQ ID NO: 222767 - DNA, 23 bp, Mus musculus
atatgtgtatatgtatatgttac

SEQ ID NO: 222768 - DNA, 23 bp, Mus musculus
gtatacaccttctctgaagttca

SEQ ID NO: 222769 - DNA, 23 bp, Mus musculus
atttgtcagaacagtgtatgcac

SEQ ID NO: 222770 - DNA, 23 bp, Mus musculus
ctgtctctgcctctgtgtgtgtt

SEQ ID NO: 222771 - DNA, 23 bp, Mus musculus
ggtgtctgtcggtcagtctgtgc

SEQ ID NO: 222772 - DNA, 23 bp, Mus musculus
ggtacatttttattgttgcatat

SEQ ID NO: 222773 - DNA, 23 bp, Mus musculus
agttgcagcttaaaaatacctta

SEQ ID NO: 222774 - DNA, 21 bp, Mus musculus
tgagtatgtatgtatatatgt

SEQ ID NO: 222775 - DNA, 20 bp, Mus musculus
ccccaggtttgtttttcttc

SEQ ID NO: 222776 - DNA, 23 bp, Mus musculus
agttagtgagtgaaactagtttg

SEQ ID NO: 222777 - DNA, 18 bp, Mus musculus
tggttcttggcaaagctg

SEQ ID NO: 222778 - DNA, 23 bp, Mus musculus
ttgaggaagagatgtgatataga

SEQ ID NO: 222779 - DNA, 18 bp, Mus musculus
tgcgagctcacactctgt

SEQ ID NO: 222780 - DNA, 23 bp, Mus musculus
tgtgtctgtgtgtctctctgtgt

SEQ ID NO: 222781 - DNA, 23 bp, Mus musculus
ggcctctgtgactctgtgagcca

SEQ ID NO: 222782 - DNA, 22 bp, Mus musculus
tgttttgtgaccaattatatgg

SEQ ID NO: 222783 - DNA, 23 bp, Mus musculus
tgtgtgtatatacatatgtgtgt

SEQ ID NO: 222784 - DNA, 20 bp, Mus musculus
tttgaggcagggtcttctgt

SEQ ID NO: 222785 - DNA, 22 bp, Mus musculus
attctcccactatttcttccca

SEQ ID NO: 222786 - DNA, 22 bp, Mus musculus
taggactagagagagggttaag

SEQ ID NO: 222787 - DNA, 19 bp, Mus musculus
tacacacacatacatatat

SEQ ID NO: 222788 - DNA, 23 bp, Mus musculus
tgtatgtatgtatatgtatatgc

SEQ ID NO: 222789 - DNA, 19 bp, Mus musculus
catctctctgtctgtgtct

SEQ ID NO: 222790 - DNA, 23 bp, Mus musculus
gtccgtctgtctgtcactgacat

SEQ ID NO: 222791 - DNA, 23 bp, Mus musculus
tgcttactttatgtagatcagtg

SEQ ID NO: 222792 - DNA, 23 bp, Mus musculus
gttcagttgtctttttgttgtag

SEQ ID NO: 222793 - DNA, 23 bp, Mus musculus
taaagtattccaggaaaggtttt

SEQ ID NO: 222794 - DNA, 20 bp, Mus musculus
ttcaaagtcagtgatagggg

SEQ ID NO: 222795 - DNA, 23 bp, Mus musculus
acatgtgtatatatatgtgtgtg

SEQ ID NO: 222796 - DNA, 23 bp, Mus musculus
tatgtgtgtgtatgtatatatgt

SEQ ID NO: 222797 - DNA, 23 bp, Mus musculus
taaatatgcatatgtatacatac

SEQ ID NO: 222798 - DNA, 22 bp, Mus musculus
tgttttgtgaccaattatatgg

SEQ ID NO: 222799 - DNA, 22 bp, Mus musculus
tgttttgtgaccaattatatgg

SEQ ID NO: 222800 - DNA, 21 bp, Mus musculus
tatgcaagtaggttgttttct

SEQ ID NO: 222801 - DNA, 22 bp, Mus musculus
taactggagcagggactgtgct

SEQ ID NO: 222802 - DNA, 23 bp, Mus musculus
tggacagtctggcttcagtggga

SEQ ID NO: 222803 - DNA, 22 bp, Mus musculus
tgttttgtgaccaattatatgg

SEQ ID NO: 222804 - DNA, 23 bp, Mus musculus
actttctctctgtctatgtgggc

SEQ ID NO: 222805 - DNA, 22 bp, Mus musculus
tgttttgtgaccaattatatgg

SEQ ID NO: 222806 - DNA, 21 bp, Mus musculus
tgcatgtatgtatgtatgtat

SEQ ID NO: 222807 - DNA, 20 bp, Mus musculus
atacatatgtcaatatgctg

SEQ ID NO: 222808 - DNA, 23 bp, Mus musculus
caggatgtctcattctctgactg

SEQ ID NO: 222809 - DNA, 20 bp, Mus musculus
tgtatgtatgtactatgtac

SEQ ID NO: 222810 - DNA, 22 bp, Mus musculus
ttggaaatgttctgattttttt

SEQ ID NO: 222811 - DNA, 23 bp, Mus musculus
ctctgtgtgactcactgacatgc

SEQ ID NO: 222812 - DNA, 19 bp, Mus musculus
ccatgcttagcaagctgta

SEQ ID NO: 222813 - DNA, 22 bp, Mus musculus
actgaggctttcttggaggaaa

SEQ ID NO: 222814 - DNA, 23 bp, Mus musculus
ttgagacagggtttctctgcgta

SEQ ID NO: 222815 - DNA, 22 bp, Mus musculus
tgctatgtaaacaagtttggtc

SEQ ID NO: 222816 - DNA, 21 bp, Mus musculus
tgtatgtatgtatacatgtat

SEQ ID NO: 222817 - DNA, 21 bp, Mus musculus
tatgtatgtatgtatatatgt

SEQ ID NO: 222818 - DNA, 23 bp, Mus musculus
gaggactctctgactgtgtgcca

SEQ ID NO: 222819 - DNA, 23 bp, Mus musculus
tgaaggtgcaaaggaattctctg

SEQ ID NO: 222820 - DNA, 18 bp, Mus musculus
ctgcgttctttgtccctt

SEQ ID NO: 222821 - DNA, 23 bp, Mus musculus
agtgtatatgtatatatgtgtgt

SEQ ID NO: 222822 - DNA, 18 bp, Mus musculus
agtgtatatatgtatatg

SEQ ID NO: 222823 - DNA, 21 bp, Mus musculus
atgtatgtatgtatgtatgta

SEQ ID NO: 222824 - DNA, 21 bp, Mus musculus
tgtgtgaatgtatgtattatg

SEQ ID NO: 222825 - DNA, 23 bp, Mus musculus
tgtgtgtatgtatgtatgcatgt

SEQ ID NO: 222826 - DNA, 23 bp, Mus musculus
tgtgcatatacacacatgtgtgg

SEQ ID NO: 222827 - DNA, 21 bp, Mus musculus
acactccctgtctcagcccct

SEQ ID NO: 222828 - DNA, 22 bp, Mus musculus
tttctctctgcctgtatctcct

SEQ ID NO: 222829 - DNA, 23 bp, Mus musculus
ttgctctgtttccatgttctttt

SEQ ID NO: 222830 - DNA, 23 bp, Mus musculus
tgtgtggctctgtgtctcagctt

SEQ ID NO: 222831 - DNA, 22 bp, Mus musculus
tgttttgtgaccaattatatgg

SEQ ID NO: 222832 - DNA, 18 bp, Mus musculus
agagaagtacgggattgc

SEQ ID NO: 222833 - DNA, 23 bp, Mus musculus
actgtctgtgcatgtgcatgtgg

SEQ ID NO: 222834 - DNA, 23 bp, Mus musculus
tgtctgtctgtctgtcttggaac

SEQ ID NO: 222835 - DNA, 23 bp, Mus musculus
gtctctgtgtgcgtgtgtgcaca

SEQ ID NO: 222836 - DNA, 19 bp, Mus musculus
gagaactagatatagagag

SEQ ID NO: 222837 - DNA, 22 bp, Mus musculus
tgttttgtgaccaattatatgg

SEQ ID NO: 222838 - DNA, 19 bp, Mus musculus
aaagtttaaggttatcatc

SEQ ID NO: 222839 - DNA, 23 bp, Mus musculus
ttaggcttattattactatgttt

SEQ ID NO: 222840 - DNA, 23 bp, Mus musculus
tgtgtgtatatatatatgtgtgt

SEQ ID NO: 222841 - DNA, 19 bp, Mus musculus
atatgtgtacatatgtatt

SEQ ID NO: 222842 - DNA, 23 bp, Mus musculus
aatgagacatgtgtttttcatga

SEQ ID NO: 222843 - DNA, 23 bp, Mus musculus
ttgctcactcacaactgcaccca

SEQ ID NO: 222844 - DNA, 20 bp, Mus musculus
acagaggagagagtggtcag

SEQ ID NO: 222845 - DNA, 23 bp, Mus musculus
aagcacacgcactgtccatcctg

SEQ ID NO: 222846 - DNA, 23 bp, Mus musculus
tgcatgcttgtgtgtgtgtgtgt

SEQ ID NO: 222847 - DNA, 23 bp, Mus musculus
tatatgtatgtatatatgacagc

SEQ ID NO: 222848 - DNA, 23 bp, Mus musculus
tgctgtgcaacttgaatctggca

SEQ ID NO: 222849 - DNA, 23 bp, Mus musculus
tgagttgtctgtctgtgacgctg

SEQ ID NO: 222850 - DNA, 23 bp, Mus musculus
ccttacactctgtctctgaatgc

SEQ ID NO: 222851 - DNA, 23 bp, Mus musculus
ttgcaagtgcatgtggatgtgaa

SEQ ID NO: 222852 - DNA, 23 bp, Mus musculus
gtgtggtacaagtgtgtgtatgt

SEQ ID NO: 222853 - DNA, 18 bp, Mus musculus
ttttaagattagggtctc

SEQ ID NO: 222854 - DNA, 21 bp, Mus musculus
tgggtgcatgtatgtacttgg

SEQ ID NO: 222855 - DNA, 21 bp, Mus musculus
tccctggctgcctgcatgcca

SEQ ID NO: 222856 - DNA, 21 bp, Mus musculus
gcgcctgtctcccagcctgag

SEQ ID NO: 222857 - DNA, 23 bp, Mus musculus
ctgagatgaagcactgtagctca

SEQ ID NO: 222858 - DNA, 23 bp, Mus musculus
tgtgtgtatgtatatgtatgtgt

SEQ ID NO: 222859 - DNA, 22 bp, Mus musculus
tatgcgtatatgtatatatgta

SEQ ID NO: 222860 - DNA, 23 bp, Mus musculus
ttttctgtctctgtgtgacacag

SEQ ID NO: 222861 - DNA, 21 bp, Mus musculus
ttttgtgtttctccaaggaca

SEQ ID NO: 222862 - DNA, 23 bp, Mus musculus
ctgggtgtctgcctcagtgcctc

SEQ ID NO: 222863 - DNA, 23 bp, Mus musculus
tcttagtgcaacttgatgtgcca

SEQ ID NO: 222864 - DNA, 23 bp, Mus musculus
catgctggctctggaagaaatct

SEQ ID NO: 222865 - DNA, 22 bp, Mus musculus
aataacttctgggactggagag

SEQ ID NO: 222866 - DNA, 23 bp, Mus musculus
atgtctctgtgtgtatgtggtat

SEQ ID NO: 222867 - DNA, 22 bp, Mus musculus
tatgtgtctgtgtgtccatgtc

SEQ ID NO: 222868 - DNA, 19 bp, Mus musculus
agaaaacatgcacttcttc

SEQ ID NO: 222869 - DNA, 23 bp, Mus musculus
aacagagaagtgagtgttcagat

SEQ ID NO: 222870 - DNA, 21 bp, Mus musculus
tgactcctctctctctcagcg

SEQ ID NO: 222871 - DNA, 23 bp, Mus musculus
gtctctgcctgtctctgaccctg

SEQ ID NO: 222872 - DNA, 23 bp, Mus musculus
cttaagtctggcagctttggaca

SEQ ID NO: 222873 - DNA, 23 bp, Mus musculus
tgtctgtctgtctgtctatctgt

SEQ ID NO: 222874 - DNA, 20 bp, Mus musculus
tatgtatatgtatatgatgt

SEQ ID NO: 222875 - DNA, 21 bp, Mus musculus
ccatttgtttggtatatcttt

SEQ ID NO: 222876 - DNA, 21 bp, Mus musculus
ttggatgtacagatgggtgga

SEQ ID NO: 222877 - DNA, 22 bp, Mus musculus
tgttttgtgaccaattatatgg

SEQ ID NO: 222878 - DNA, 23 bp, Mus musculus
gtgtgtgtctgtctgtcaaattc

SEQ ID NO: 222879 - DNA, 21 bp, Mus musculus
tgtgtctatttgtatatttgt

SEQ ID NO: 222880 - DNA, 23 bp, Mus musculus
aaatgtgtgtgcatttgcatgtg

SEQ ID NO: 222881 - DNA, 23 bp, Mus musculus
tgtggaaatgtatgcatatgtgt

SEQ ID NO: 222882 - DNA, 18 bp, Mus musculus
tgtgtatgcaagtgtatg

SEQ ID NO: 222883 - DNA, 19 bp, Mus musculus
gtgagtgagtgagtgagtg

SEQ ID NO: 222884 - DNA, 22 bp, Mus musculus
tgttttgtgaccaattatatgg

SEQ ID NO: 222885 - DNA, 18 bp, Mus musculus
aaagagattcatatgaga

SEQ ID NO: 222886 - DNA, 21 bp, Mus musculus
tgttgtctgcctgctactgga

SEQ ID NO: 222887 - DNA, 18 bp, Mus musculus
actggcagataaatctag

SEQ ID NO: 222888 - DNA, 23 bp, Mus musculus
tctctgtgtgcttctcttctgct

SEQ ID NO: 222889 - DNA, 23 bp, Mus musculus
atttttgtttacaaactgtgagt

SEQ ID NO: 222890 - DNA, 23 bp, Mus musculus
tatatgtatgtatatatgtgtgt

SEQ ID NO: 222891 - DNA, 20 bp, Mus musculus
tatatgcatgtatatgtgta

SEQ ID NO: 222892 - DNA, 23 bp, Mus musculus
tgtctctctgtgtgagaattttg

SEQ ID NO: 222893 - DNA, 20 bp, Mus musculus
aagtgtagttgttattttta

SEQ ID NO: 222894 - DNA, 21 bp, Mus musculus
tccatcaaatgtgtgtatgta

SEQ ID NO: 222895 - DNA, 23 bp, Mus musculus
tatatgtgcatgtgtaagatggt

SEQ ID NO: 222896 - DNA, 20 bp, Mus musculus
ttggcatgatatggcagact

SEQ ID NO: 222897 - DNA, 23 bp, Mus musculus
tgcatatatatccctgtctaaac

SEQ ID NO: 222898 - DNA, 23 bp, Mus musculus
atatgcatgtatgtatgtatgta

SEQ ID NO: 222899 - DNA, 23 bp, Mus musculus
ttactaactggtagctatcacat

SEQ ID NO: 222900 - DNA, 23 bp, Mus musculus
tgtgtgtgagtagagactttgga

SEQ ID NO: 222901 - DNA, 23 bp, Mus musculus
cctgagagaacagagtgtgcaga

SEQ ID NO: 222902 - DNA, 23 bp, Mus musculus
tttccacagtagagtggacattg

SEQ ID NO: 222903 - DNA, 22 bp, Mus musculus
aagcacacagataaagaggctg

SEQ ID NO: 222904 - DNA, 19 bp, Mus musculus
gtatacatgcatgtgtata

SEQ ID NO: 222905 - DNA, 22 bp, Mus musculus
tgttttgtgaccaattatatgg

SEQ ID NO: 222906 - DNA, 23 bp, Mus musculus
ctctctctgtgtatgtgcactcg

SEQ ID NO: 222907 - DNA, 23 bp, Mus musculus
tgtctcactgagagccttccagt

SEQ ID NO: 222908 - DNA, 23 bp, Mus musculus
ccctagacttatatgagtagcca

SEQ ID NO: 222909 - DNA, 19 bp, Mus musculus
gcagtcttgtgtggctggg

SEQ ID NO: 222910 - DNA, 22 bp, Mus musculus
atttcaagaagtttctactgac

SEQ ID NO: 222911 - DNA, 23 bp, Mus musculus
ggctctctactgagcacattgga

SEQ ID NO: 222912 - DNA, 21 bp, Mus musculus
tatatgtatatgtatatgtat

SEQ ID NO: 222913 - DNA, 20 bp, Mus musculus
agaaacatagtaatatagta

SEQ ID NO: 222914 - DNA, 21 bp, Mus musculus
tatatgtatatgtgtatatgt

SEQ ID NO: 222915 - DNA, 20 bp, Mus musculus
tcagtgtgtgtaaaagtggt

SEQ ID NO: 222916 - DNA, 22 bp, Mus musculus
tgttttgtgaccaattatatgg

SEQ ID NO: 222917 - DNA, 23 bp, Mus musculus
gtatatatacaattgtgtgtgtg

SEQ ID NO: 222918 - DNA, 20 bp, Mus musculus
actggctgctgtctgtgtat

SEQ ID NO: 222919 - DNA, 23 bp, Mus musculus
tttaggtatctctgcatagacag

SEQ ID NO: 222920 - DNA, 18 bp, Mus musculus
ttctggttttcaaagcat

SEQ ID NO: 222921 - DNA, 23 bp, Mus musculus
tctgagacagtcttgtttgcagc

SEQ ID NO: 222922 - DNA, 23 bp, Mus musculus
tagttgacctaagagtttctggg

SEQ ID NO: 222923 - DNA, 23 bp, Mus musculus
ggtgctaatcaatggattactga

SEQ ID NO: 222924 - DNA, 23 bp, Mus musculus
acagaagagaaacaggatacgat

SEQ ID NO: 222925 - DNA, 20 bp, Mus musculus
tgggacagggactcctcaga

SEQ ID NO: 222926 - DNA, 18 bp, Mus musculus
gtgtgagccaccatgtgg

SEQ ID NO: 222927 - DNA, 22 bp, Mus musculus
tgttttgtgaccaattatatgg

SEQ ID NO: 222928 - DNA, 23 bp, Mus musculus
atgtgtgtgtacatgtgtatgtg

SEQ ID NO: 222929 - DNA, 21 bp, Mus musculus
tatgtgtatatatatgcatat

SEQ ID NO: 222930 - DNA, 20 bp, Mus musculus
aactccagcttcttcagatt

SEQ ID NO: 222931 - DNA, 20 bp, Mus musculus
tctatccctctatgtcttca

SEQ ID NO: 222932 - DNA, 23 bp, Mus musculus
aggtttagttcaaggagtgtttc

SEQ ID NO: 222933 - DNA, 20 bp, Mus musculus
atgcatgtacagaattgcat

SEQ ID NO: 222934 - DNA, 23 bp, Mus musculus
gcatgattcatttgctaactctt

SEQ ID NO: 222935 - DNA, 23 bp, Mus musculus
aagagactgaagtgtttcccata

SEQ ID NO: 222936 - DNA, 18 bp, Mus musculus
gtgaggatgctcctctgt

SEQ ID NO: 222937 - DNA, 23 bp, Mus musculus
actggctgtctcctactgcagag

SEQ ID NO: 222938 - DNA, 23 bp, Mus musculus
ttacttactctgactgcctctct

SEQ ID NO: 222939 - DNA, 20 bp, Mus musculus
gtgtgtgtgtgtgtatatac

SEQ ID NO: 222940 - DNA, 21 bp, Mus musculus
atgtatatatatatgtgtaca

SEQ ID NO: 222941 - DNA, 19 bp, Mus musculus
tgtgttcacacatgtgtga

SEQ ID NO: 222942 - DNA, 23 bp, Mus musculus
tgaatatatgcatgtatacacat

SEQ ID NO: 222943 - DNA, 19 bp, Mus musculus
ttactggaaatctaggcta

SEQ ID NO: 222944 - DNA, 18 bp, Mus musculus
catgtaattcccatggtg

SEQ ID NO: 222945 - DNA, 23 bp, Mus musculus
agtgacactcgtattctactgaa

SEQ ID NO: 222946 - DNA, 22 bp, Mus musculus
tgttttgtgaccaattatatgg

SEQ ID NO: 222947 - DNA, 20 bp, Mus musculus
ccaggggattgtggttccct

SEQ ID NO: 222948 - DNA, 21 bp, Mus musculus
tctcacagcacagagtgcaga

SEQ ID NO: 222949 - DNA, 21 bp, Mus musculus
tctcacactggttctattttc

SEQ ID NO: 222950 - DNA, 23 bp, Mus musculus
tgtgtgtgtgtatacatgcatgc

SEQ ID NO: 222951 - DNA, 23 bp, Mus musculus
tatgtatgcatgtatgtatatgt

SEQ ID NO: 222952 - DNA, 23 bp, Mus musculus
agaagagtgttgttcagtttcca

SEQ ID NO: 222953 - DNA, 22 bp, Mus musculus
cttagtccatggtgatctgata

SEQ ID NO: 222954 - DNA, 23 bp, Mus musculus
agaagagtgttgttcagtttcca

SEQ ID NO: 222955 - DNA, 22 bp, Mus musculus
cttagtccatggtgatctgata

SEQ ID NO: 222956 - DNA, 21 bp, Mus musculus
caactcccagccactacatgg

SEQ ID NO: 222957 - DNA, 23 bp, Mus musculus
gctttctcacccacactgtttgt

SEQ ID NO: 222958 - DNA, 23 bp, Mus musculus
aacacagagaagttgatctggtg

SEQ ID NO: 222959 - DNA, 23 bp, Mus musculus
tatttaaacctgattttgttgta

SEQ ID NO: 222960 - DNA, 23 bp, Mus musculus
actagtgtatatgatcttttgtt

SEQ ID NO: 222961 - DNA, 23 bp, Mus musculus
aagagcactgactgctcttccag

SEQ ID NO: 222962 - DNA, 23 bp, Mus musculus
ttagtcatatgtgatttgtggat

SEQ ID NO: 222963 - DNA, 23 bp, Mus musculus
agtctctgtctgtctgtctgtct

SEQ ID NO: 222964 - DNA, 19 bp, Mus musculus
ctctgtgagatgtgtgccc

SEQ ID NO: 222965 - DNA, 23 bp, Mus musculus
taagagcactgactgctcttctg

SEQ ID NO: 222966 - DNA, 23 bp, Mus musculus
tgtgaattgtatctcaggtattc

SEQ ID NO: 222967 - DNA, 23 bp, Mus musculus
tgatcagtgagtgcatactatgt

SEQ ID NO: 222968 - DNA, 22 bp, Mus musculus
tgttttgtgaccaattatatgg

SEQ ID NO: 222969 - DNA, 20 bp, Mus musculus
acagacttggtctaggtgcc

SEQ ID NO: 222970 - DNA, 23 bp, Mus musculus
actaagacaactgtttttgttct

SEQ ID NO: 222971 - DNA, 18 bp, Mus musculus
tgacgtagtagcttggag

SEQ ID NO: 222972 - DNA, 22 bp, Mus musculus
tattccagcactattcatgagt

SEQ ID NO: 222973 - DNA, 23 bp, Mus musculus
acaggtattgatgtcattttgat

SEQ ID NO: 222974 - DNA, 23 bp, Mus musculus
tttcagaggattattctcaggtc

SEQ ID NO: 222975 - DNA, 23 bp, Mus musculus
ttttgatgaggttcagttttaaa

SEQ ID NO: 222976 - DNA, 22 bp, Mus musculus
tgttttgtgaccaattatatgg

SEQ ID NO: 222977 - DNA, 21 bp, Mus musculus
tttggttcagtttggtttttc

SEQ ID NO: 222978 - DNA, 20 bp, Mus musculus
tactggacctcactctgtag

SEQ ID NO: 222979 - DNA, 22 bp, Mus musculus
tgttttgtgaccaattatatgg

SEQ ID NO: 222980 - DNA, 23 bp, Mus musculus
tatgagattcctatatgtgtgtg

SEQ ID NO: 222981 - DNA, 18 bp, Mus musculus
gtgtatatggatatgtga

SEQ ID NO: 222982 - DNA, 23 bp, Mus musculus
atgtatgtatgcatgtgtgtatg

SEQ ID NO: 222983 - DNA, 22 bp, Mus musculus
gtgtagtaaagtttgaaatcag

SEQ ID NO: 222984 - DNA, 23 bp, Mus musculus
tccacctgaagttattttgttgt

SEQ ID NO: 222985 - DNA, 23 bp, Mus musculus
tgtgtgtgtatatgtatatatgt

SEQ ID NO: 222986 - DNA, 23 bp, Mus musculus
atatgtgtatatgtatatatgtg

SEQ ID NO: 222987 - DNA, 20 bp, Mus musculus
tgatacatgcacatgatgga

SEQ ID NO: 222988 - DNA, 23 bp, Mus musculus
tgtttctgagtctgtattaggac

SEQ ID NO: 222989 - DNA, 23 bp, Mus musculus
cagacatctctctctgtctgtcc

SEQ ID NO: 222990 - DNA, 23 bp, Mus musculus
gagacagagtttttctgtatagc

SEQ ID NO: 222991 - DNA, 18 bp, Mus musculus
tgtcctgaaactcactca

SEQ ID NO: 222992 - DNA, 23 bp, Mus musculus
atatgtatgtatatgtaaatgta

SEQ ID NO: 222993 - DNA, 22 bp, Mus musculus
tgttttgtgaccaattatatgg

SEQ ID NO: 222994 - DNA, 22 bp, Mus musculus
tgttttgtgaccaattatatgg

SEQ ID NO: 222995 - DNA, 23 bp, Mus musculus
atttctcctccttgtgctgtatg

SEQ ID NO: 222996 - DNA, 23 bp, Mus musculus
ctctctctctctctctgggtggg

SEQ ID NO: 222997 - DNA, 21 bp, Mus musculus
gtgacacagaggtgtcaggtc

SEQ ID NO: 222998 - DNA, 23 bp, Mus musculus
tgaagtctgagttacaggttgct

SEQ ID NO: 222999 - DNA, 23 bp, Mus musculus
taagagcactgactgctcttcca

SEQ ID NO: 223000 - DNA, 21 bp, Mus musculus
aaaattgatttgttaacatat

SEQ ID NO: 223001 - DNA, 22 bp, Mus musculus
tgtatatagaggttcattttga

SEQ ID NO: 223002 - DNA, 22 bp, Mus musculus
aagccaggctcagtgtctcact

SEQ ID NO: 223003 - DNA, 23 bp, Mus musculus
tggtggtctggtaggatgtatgg

SEQ ID NO: 223004 - DNA, 23 bp, Mus musculus
tctcctagtccatgcacattcag

SEQ ID NO: 223005 - DNA, 22 bp, Mus musculus
tgtggattttcattcttgtctg

SEQ ID NO: 223006 - DNA, 22 bp, Mus musculus
tgattagtaggatatgatatga

SEQ ID NO: 223007 - DNA, 22 bp, Mus musculus
ttgcagttcacactctgctttt

SEQ ID NO: 223008 - DNA, 18 bp, Mus musculus
tgtagtaggatctgatga

SEQ ID NO: 223009 - DNA, 22 bp, Mus musculus
tatctatgcctgctttcctcag

SEQ ID NO: 223010 - DNA, 21 bp, Mus musculus
tgtgtctctgtttagtttctg

SEQ ID NO: 223011 - DNA, 23 bp, Mus musculus
ttagaaggtgtggcactattgag

SEQ ID NO: 223012 - DNA, 23 bp, Mus musculus
tgtcagtgtgtgctataagattc

SEQ ID NO: 223013 - DNA, 23 bp, Mus musculus
gcctccctctctcccacacttgt

SEQ ID NO: 223014 - DNA, 23 bp, Mus musculus
gacatcactcccagatatccctc

SEQ ID NO: 223015 - DNA, 18 bp, Mus musculus
tataatgtatgtatatgt

SEQ ID NO: 223016 - DNA, 22 bp, Mus musculus
atacagttttcagagcagcagc

SEQ ID NO: 223017 - DNA, 18 bp, Mus musculus
tggtctttaagaaatgag

SEQ ID NO: 223018 - DNA, 22 bp, Mus musculus
atgtgattatgcatttgtgagt

SEQ ID NO: 223019 - DNA, 23 bp, Mus musculus
taatgtatgtttgcatatgtgtg

SEQ ID NO: 223020 - DNA, 21 bp, Mus musculus
atgtctatatatgtatatatg

SEQ ID NO: 223021 - DNA, 23 bp, Mus musculus
tacagtgagcatgttctaagccc

SEQ ID NO: 223022 - DNA, 21 bp, Mus musculus
atgacattaaatattgttcac

SEQ ID NO: 223023 - DNA, 23 bp, Mus musculus
tgtctgcatgtatgtctgtgtga

SEQ ID NO: 223024 - DNA, 20 bp, Mus musculus
ttacagacaggtgtgagctg

SEQ ID NO: 223025 - DNA, 18 bp, Mus musculus
cacagtgtctgtagcagg

SEQ ID NO: 223026 - DNA, 23 bp, Mus musculus
tgtgtctcagtgtctcggtgact

SEQ ID NO: 223027 - DNA, 23 bp, Mus musculus
caggccaatgtttaactcactgt

SEQ ID NO: 223028 - DNA, 22 bp, Mus musculus
tctcactgggagtgttcagtct

SEQ ID NO: 223029 - DNA, 23 bp, Mus musculus
ccagtcactgtgacagtctcatc

SEQ ID NO: 223030 - DNA, 23 bp, Mus musculus
ctctctctgcctctgtgtgtctg

SEQ ID NO: 223031 - DNA, 23 bp, Mus musculus
tgtatgtatgtatgtgtgtgtgt

SEQ ID NO: 223032 - DNA, 22 bp, Mus musculus
tgttttgtgaccaattatatgg

SEQ ID NO: 223033 - DNA, 22 bp, Mus musculus
tagtcatttagttaatatgtgc

SEQ ID NO: 223034 - DNA, 22 bp, Mus musculus
tgttttgtgaccaattatatgg

SEQ ID NO: 223035 - DNA, 22 bp, Mus musculus
attcacaatatttatatatgtg

SEQ ID NO: 223036 - DNA, 23 bp, Mus musculus
tagtgcatggtgatctgatagga

SEQ ID NO: 223037 - DNA, 23 bp, Mus musculus
tgtttctcagtgcttctgagcac

SEQ ID NO: 223038 - DNA, 20 bp, Mus musculus
tataaagttaatttctttta

SEQ ID NO: 223039 - DNA, 23 bp, Mus musculus
ttcaagtactatgttgaatagtt

SEQ ID NO: 223040 - DNA, 23 bp, Mus musculus
atcatagataaagaactcttggc

SEQ ID NO: 223041 - DNA, 23 bp, Mus musculus
tagagcttcaggtttgagctgct

SEQ ID NO: 223042 - DNA, 23 bp, Mus musculus
aactgtgtgtttttacacgcgca

SEQ ID NO: 223043 - DNA, 20 bp, Mus musculus
tgtgtgtgtgtgagagtgcg

SEQ ID NO: 223044 - DNA, 22 bp, Mus musculus
aagagagggtgcttagatgagc

SEQ ID NO: 223045 - DNA, 19 bp, Mus musculus
actccctcctagtaaagat

SEQ ID NO: 223046 - DNA, 19 bp, Mus musculus
caatgagctggctgtgctg

SEQ ID NO: 223047 - DNA, 18 bp, Mus musculus
agcttgctggtcagtttg

SEQ ID NO: 223048 - DNA, 22 bp, Mus musculus
tgtctgtctgtgtatgttctta

SEQ ID NO: 223049 - DNA, 23 bp, Mus musculus
tgagactgcaactccatgttcta

SEQ ID NO: 223050 - DNA, 22 bp, Mus musculus
tgttttgtgaccaattatatgg

SEQ ID NO: 223051 - DNA, 23 bp, Mus musculus
tatatgcatgtatatagatatgt

SEQ ID NO: 223052 - DNA, 22 bp, Mus musculus
aagtgcatctttcatttgtgtc

SEQ ID NO: 223053 - DNA, 21 bp, Mus musculus
acacagaggactgagagcaca

SEQ ID NO: 223054 - DNA, 23 bp, Mus musculus
atgagacaagagagagaagaatg

SEQ ID NO: 223055 - DNA, 23 bp, Mus musculus
tgtctgtatgtctatctgtctgt

SEQ ID NO: 223056 - DNA, 23 bp, Mus musculus
tttgtccttgtatttaatgatga

SEQ ID NO: 223057 - DNA, 23 bp, Mus musculus
ataaagctagtttaccaatgcca

SEQ ID NO: 223058 - DNA, 23 bp, Mus musculus
gcctctctgtgtctcttagagct

SEQ ID NO: 223059 - DNA, 21 bp, Mus musculus
atatgtatatatgtatatgtg

SEQ ID NO: 223060 - DNA, 22 bp, Mus musculus
ctgcctgcctgcctgcctgcct

SEQ ID NO: 223061 - DNA, 19 bp, Mus musculus
tgtcctgaaggagcttcgt

SEQ ID NO: 223062 - DNA, 23 bp, Mus musculus
aagacagtgagctagctgcagct

SEQ ID NO: 223063 - DNA, 23 bp, Mus musculus
tcagacagttgtcagactgcaga

SEQ ID NO: 223064 - DNA, 23 bp, Mus musculus
ctgtttcagcatgtgaaagtggt

SEQ ID NO: 223065 - DNA, 23 bp, Mus musculus
ccctggctgggtgtctggctgtg

SEQ ID NO: 223066 - DNA, 22 bp, Mus musculus
tgttttgtgaccaattatatgg

SEQ ID NO: 223067 - DNA, 23 bp, Mus musculus
tagtgcatggtgatctgatagga

SEQ ID NO: 223068 - DNA, 22 bp, Mus musculus
tgttttgtgacctattatgtgg

SEQ ID NO: 223069 - DNA, 22 bp, Mus musculus
tgttttgtgaccaattatatgg

SEQ ID NO: 223070 - DNA, 23 bp, Mus musculus
atgtatatgtacgtgtatgtgtg

SEQ ID NO: 223071 - DNA, 23 bp, Mus musculus
tgtgacagggatacttgacaaac

SEQ ID NO: 223072 - DNA, 23 bp, Mus musculus
tatgcatatgtttggattttgat

SEQ ID NO: 223073 - DNA, 23 bp, Mus musculus
gtctgtctatctgtctgtctatc

SEQ ID NO: 223074 - DNA, 21 bp, Mus musculus
tacagatgagagacagacaga

SEQ ID NO: 223075 - DNA, 23 bp, Mus musculus
actcaagcaggtcagggagcagg

SEQ ID NO: 223076 - DNA, 20 bp, Mus musculus
ttttgtgaccgattatatgg

SEQ ID NO: 223077 - DNA, 19 bp, Mus musculus
gtatgtatgtatgtgtgtg

SEQ ID NO: 223078 - DNA, 21 bp, Mus musculus
agcaccatatttatatatgta

SEQ ID NO: 223079 - DNA, 22 bp, Mus musculus
catatatatgtatactgtttgt

SEQ ID NO: 223080 - DNA, 23 bp, Mus musculus
tgcctcttcttcccatctctttg

SEQ ID NO: 223081 - DNA, 23 bp, Mus musculus
ttgactctaaaacttgtagccat

SEQ ID NO: 223082 - DNA, 22 bp, Mus musculus
tgatatagtatctaaaaatcta

SEQ ID NO: 223083 - DNA, 23 bp, Mus musculus
tttcctgtgctttgtctatgaca

SEQ ID NO: 223084 - DNA, 18 bp, Mus musculus
tgagaactttctagagtg

SEQ ID NO: 223085 - DNA, 21 bp, Mus musculus
tgtgagtcagcctaggtggat

SEQ ID NO: 223086 - DNA, 23 bp, Mus musculus
cactgggactgttctgctgcaac

SEQ ID NO: 223087 - DNA, 22 bp, Mus musculus
tgttttgtgaccaattatatgg

SEQ ID NO: 223088 - DNA, 23 bp, Mus musculus
tgaggttctttgagtctctcaaa

SEQ ID NO: 223089 - DNA, 20 bp, Mus musculus
tcagataattagttctaaac

SEQ ID NO: 223090 - DNA, 23 bp, Mus musculus
tgtttccattagatgctgagtga

SEQ ID NO: 223091 - DNA, 22 bp, Mus musculus
tgttttgtgaccaattatatgg

SEQ ID NO: 223092 - DNA, 20 bp, Mus musculus
tgcctctgtctctctcttta

SEQ ID NO: 223093 - DNA, 19 bp, Mus musculus
agcattctgtccaacctgt

SEQ ID NO: 223094 - DNA, 19 bp, Mus musculus
tatatcatgctcaggtgga

SEQ ID NO: 223095 - DNA, 23 bp, Mus musculus
atgtatgtatgtatgtatgtatg

SEQ ID NO: 223096 - DNA, 23 bp, Mus musculus
tctgagatcttcatatagcctga

SEQ ID NO: 223097 - DNA, 22 bp, Mus musculus
tgtgtggatataagtatgaaac

SEQ ID NO: 223098 - DNA, 23 bp, Mus musculus
acactctgagtcactgttacggc

SEQ ID NO: 223099 - DNA, 22 bp, Mus musculus
aactttcagctccttctccagc

SEQ ID NO: 223100 - DNA, 23 bp, Mus musculus
gctctcagctcaggtgatctgag

SEQ ID NO: 223101 - DNA, 23 bp, Mus musculus
tccttgctaataaaagctaactc

SEQ ID NO: 223102 - DNA, 23 bp, Mus musculus
tctcagtagtaagctgtttgctt

SEQ ID NO: 223103 - DNA, 22 bp, Mus musculus
tgagttagtgcttcaggaagtg

SEQ ID NO: 223104 - DNA, 23 bp, Mus musculus
tctctatgtgcatgtatgtatat

SEQ ID NO: 223105 - DNA, 21 bp, Mus musculus
tcagctgatcaccaggtcctg

SEQ ID NO: 223106 - DNA, 22 bp, Mus musculus
tgtgcatatatttgcatgtata

SEQ ID NO: 223107 - DNA, 21 bp, Mus musculus
atatatgtatgtatatgtgtg

SEQ ID NO: 223108 - DNA, 23 bp, Mus musculus
tctcagcttgttgattgtagcta

SEQ ID NO: 223109 - DNA, 23 bp, Mus musculus
tctgcctgtctctgtctctccag

SEQ ID NO: 223110 - DNA, 22 bp, Mus musculus
tatgtccattttataggtggaa

SEQ ID NO: 223111 - DNA, 23 bp, Mus musculus
tgtcggtctgtctgtctgggaaa

SEQ ID NO: 223112 - DNA, 21 bp, Mus musculus
cacccatggttgtcttctggt

SEQ ID NO: 223113 - DNA, 19 bp, Mus musculus
acagagacagacagagacc

SEQ ID NO: 223114 - DNA, 23 bp, Mus musculus
tatatatatatgcatgctggtga

SEQ ID NO: 223115 - DNA, 18 bp, Mus musculus
aaactagggctagccaga

SEQ ID NO: 223116 - DNA, 20 bp, Mus musculus
tgactgatgagtgtgtgggc

SEQ ID NO: 223117 - DNA, 22 bp, Mus musculus
tgttttgtgaccaattatatgg

SEQ ID NO: 223118 - DNA, 22 bp, Mus musculus
tgttttgtgaccaattatatgg

SEQ ID NO: 223119 - DNA, 18 bp, Mus musculus
atgtatgtgtatacatgt

SEQ ID NO: 223120 - DNA, 23 bp, Mus musculus
cacatattttgttgttgttgttg

SEQ ID NO: 223121 - DNA, 19 bp, Mus musculus
atctggctcattttgttat

SEQ ID NO: 223122 - DNA, 23 bp, Mus musculus
aacatagatgagcctgaaggtca

SEQ ID NO: 223123 - DNA, 23 bp, Mus musculus
gagactgtatatatgtatgtatg

SEQ ID NO: 223124 - DNA, 23 bp, Mus musculus
aaagcactgactgctcttccaga

SEQ ID NO: 223125 - DNA, 20 bp, Mus musculus
aatagttttgtttcttaaga

SEQ ID NO: 223126 - DNA, 23 bp, Mus musculus
tatgtgtatgtatatatgagtgt

SEQ ID NO: 223127 - DNA, 22 bp, Mus musculus
agcagagaagagtgacaggagt

SEQ ID NO: 223128 - DNA, 23 bp, Mus musculus
aacctgaggtgcagcaggaagta

SEQ ID NO: 223129 - DNA, 22 bp, Mus musculus
gcactgactgctcttccagagg

SEQ ID NO: 223130 - DNA, 23 bp, Mus musculus
cagctttagattttgataaagtt

SEQ ID NO: 223131 - DNA, 23 bp, Mus musculus
aagactgaaatagatatgaagtg

SEQ ID NO: 223132 - DNA, 21 bp, Mus musculus
aagaggcaagaagcaggcgct

SEQ ID NO: 223133 - DNA, 21 bp, Mus musculus
ctggccctgtctccctctctg

SEQ ID NO: 223134 - DNA, 19 bp, Mus musculus
aggcagcctctgtctgtct

SEQ ID NO: 223135 - DNA, 23 bp, Mus musculus
tgtgtgtgtgcatgtatatgtat

SEQ ID NO: 223136 - DNA, 23 bp, Mus musculus
tgtgtatatgtatgtatatatgt

SEQ ID NO: 223137 - DNA, 23 bp, Mus musculus
tatacatgtgcatggacattctc

SEQ ID NO: 223138 - DNA, 23 bp, Mus musculus
tgacagaacagagtggggactga

SEQ ID NO: 223139 - DNA, 23 bp, Mus musculus
tgaggtggttgtgagctgctatg

SEQ ID NO: 223140 - DNA, 19 bp, Mus musculus
gcaggtgctggctgtgctc

SEQ ID NO: 223141 - DNA, 23 bp, Mus musculus
tacatatgtatgtatatatgtgt

SEQ ID NO: 223142 - DNA, 19 bp, Mus musculus
tagatagatagatatagat

SEQ ID NO: 223143 - DNA, 21 bp, Mus musculus
tgaggcttaatgaggctggag

SEQ ID NO: 223144 - DNA, 20 bp, Mus musculus
aggagactctttttcatctc

SEQ ID NO: 223145 - DNA, 23 bp, Mus musculus
tctgcctgtctctgcgtctctgc

SEQ ID NO: 223146 - DNA, 21 bp, Mus musculus
ccgaagagcttaggcaggtct

SEQ ID NO: 223147 - DNA, 19 bp, Mus musculus
actgaggtgaaatcttctg

SEQ ID NO: 223148 - DNA, 19 bp, Mus musculus
actactgctttatccatgt

SEQ ID NO: 223149 - DNA, 23 bp, Mus musculus
acaacagtgaagacagtgagctg

SEQ ID NO: 223150 - DNA, 22 bp, Mus musculus
ttcaattctcagcaaccacatg

SEQ ID NO: 223151 - DNA, 23 bp, Mus musculus
cctgtctgcctgtgagcgtgtca

SEQ ID NO: 223152 - DNA, 20 bp, Mus musculus
tgaatgcctgcatgtatgtc

SEQ ID NO: 223153 - DNA, 23 bp, Mus musculus
gagtgcctgtgtgcctctgtgcc

SEQ ID NO: 223154 - DNA, 23 bp, Mus musculus
gtgtgtacatgtgcatgtgcatg

SEQ ID NO: 223155 - DNA, 23 bp, Mus musculus
tgtatgtgtgtgtgcaagtgcat

SEQ ID NO: 223156 - DNA, 23 bp, Mus musculus
caatttctccatcagcaatctat

SEQ ID NO: 223157 - DNA, 21 bp, Mus musculus
gtgtgtgtgcatgagcatgag

SEQ ID NO: 223158 - DNA, 23 bp, Mus musculus
tatgcatgaacatgagcatgtat

SEQ ID NO: 223159 - DNA, 23 bp, Mus musculus
ctcactctctgtgtgtctgcctg

SEQ ID NO: 223160 - DNA, 23 bp, Mus musculus
ttgagagtagagagagattcagg

SEQ ID NO: 223161 - DNA, 22 bp, Mus musculus
tcagtctgagatgctaggatgt

SEQ ID NO: 223162 - DNA, 23 bp, Mus musculus
ctctctgtgtccctgagacaggc

SEQ ID NO: 223163 - DNA, 22 bp, Mus musculus
tagaaagtattagtaatttcct

SEQ ID NO: 223164 - DNA, 23 bp, Mus musculus
ctagcatgtgcatgtgcatgtgg

SEQ ID NO: 223165 - DNA, 23 bp, Mus musculus
ttctgcatctgcatctgtgagaa

SEQ ID NO: 223166 - DNA, 22 bp, Mus musculus
tgttttgtgaccaattatatgg

SEQ ID NO: 223167 - DNA, 23 bp, Mus musculus
gagacagtacagagagtccagta

SEQ ID NO: 223168 - DNA, 23 bp, Mus musculus
tatctgtgtgtgtgtctgtgtgc

SEQ ID NO: 223169 - DNA, 21 bp, Mus musculus
tgagaagaaggcaaagacatg

SEQ ID NO: 223170 - DNA, 18 bp, Mus musculus
agagtggtggcagtagaa

SEQ ID NO: 223171 - DNA, 23 bp, Mus musculus
tttctgtgtagccctggctgtct

SEQ ID NO: 223172 - DNA, 23 bp, Mus musculus
atgtcattggatttgtatcagta

SEQ ID NO: 223173 - DNA, 23 bp, Mus musculus
cagagagatgacagttggtgatc

SEQ ID NO: 223174 - DNA, 22 bp, Mus musculus
agagcaatgaagtgtctttgca

SEQ ID NO: 223175 - DNA, 19 bp, Mus musculus
tgtcactgagagcctcaga

SEQ ID NO: 223176 - DNA, 20 bp, Mus musculus
agacacaacaggcaggagtg

SEQ ID NO: 223177 - DNA, 23 bp, Mus musculus
acacagggtcttgagcttctgaa

SEQ ID NO: 223178 - DNA, 22 bp, Mus musculus
actcaacatggtcactcagtag

SEQ ID NO: 223179 - DNA, 22 bp, Mus musculus
ccctgtgttctgactcactgag

SEQ ID NO: 223180 - DNA, 23 bp, Mus musculus
gacctgtctatctctgtctcttg

SEQ ID NO: 223181 - DNA, 23 bp, Mus musculus
tgcctgtgactgtcactgtctgc

SEQ ID NO: 223182 - DNA, 21 bp, Mus musculus
atgagacctgtccctagtctg

SEQ ID NO: 223183 - DNA, 23 bp, Mus musculus
tgtatgtatgtatgtatgtatgt

SEQ ID NO: 223184 - DNA, 22 bp, Mus musculus
tggcaggctgacttatgtatgt

SEQ ID NO: 223185 - DNA, 23 bp, Mus musculus
atagcactgactgctcttcctga

SEQ ID NO: 223186 - DNA, 22 bp, Mus musculus
agacaggatttctctgtgaagc

SEQ ID NO: 223187 - DNA, 20 bp, Mus musculus
taagagatgaaagtgagctg

SEQ ID NO: 223188 - DNA, 19 bp, Mus musculus
acatctcgagactgtgcag

SEQ ID NO: 223189 - DNA, 20 bp, Mus musculus
ctgcctgagtccctgttagg

SEQ ID NO: 223190 - DNA, 23 bp, Mus musculus
aggtagaaagtatttctaggatt

SEQ ID NO: 223191 - DNA, 23 bp, Mus musculus
attggattacaaatcaggatgct

SEQ ID NO: 223192 - DNA, 22 bp, Mus musculus
taattacctgtagttcttcatc

SEQ ID NO: 223193 - DNA, 20 bp, Mus musculus
ctgtgtctctgaggcaacct

SEQ ID NO: 223194 - DNA, 23 bp, Mus musculus
ctctgcctcactgtgagaatggc

SEQ ID NO: 223195 - DNA, 22 bp, Mus musculus
atgggtcacaggaaaagatgag

SEQ ID NO: 223196 - DNA, 22 bp, Mus musculus
tccctgatttgaaagcactctg

SEQ ID NO: 223197 - DNA, 23 bp, Mus musculus
actgtgacactgcaagtacacag

SEQ ID NO: 223198 - DNA, 18 bp, Mus musculus
aggtgcatacatcagcac

SEQ ID NO: 223199 - DNA, 23 bp, Mus musculus
ttgtgtgtgtgcatgtgtatgtg

SEQ ID NO: 223200 - DNA, 20 bp, Mus musculus
tgcacacatgtatgtgtgca

SEQ ID NO: 223201 - DNA, 23 bp, Mus musculus
tatgtgaacctctgtctgtctgt

SEQ ID NO: 223202 - DNA, 22 bp, Mus musculus
tgttttgtgaccaattatatgg

SEQ ID NO: 223203 - DNA, 23 bp, Mus musculus
tttgtgaccaattatatggtcaa

SEQ ID NO: 223204 - DNA, 22 bp, Mus musculus
tgttttgtgaccaattatatgg

SEQ ID NO: 223205 - DNA, 18 bp, Mus musculus
tttttgcacaatgactag

SEQ ID NO: 223206 - DNA, 23 bp, Mus musculus
acaatatgtatatgtatgtgtat

SEQ ID NO: 223207 - DNA, 20 bp, Mus musculus
caaaatatgcatgtgtgtgc

SEQ ID NO: 223208 - DNA, 19 bp, Mus musculus
tgtgtgcatgcttgtgtgt

SEQ ID NO: 223209 - DNA, 23 bp, Mus musculus
tatatgcatatatatacttatat

SEQ ID NO: 223210 - DNA, 20 bp, Mus musculus
tatgcatatatatacttata

SEQ ID NO: 223211 - DNA, 21 bp, Mus musculus
atgtatatatgcatttcatat

SEQ ID NO: 223212 - DNA, 23 bp, Mus musculus
tccacagacagaattctgtcaac

SEQ ID NO: 223213 - DNA, 18 bp, Mus musculus
tatgtatacatgtatgtt

SEQ ID NO: 223214 - DNA, 23 bp, Mus musculus
tgagttcactctctctgtcctgc

SEQ ID NO: 223215 - DNA, 22 bp, Mus musculus
tgttttgtgaccaattatatgg

SEQ ID NO: 223216 - DNA, 23 bp, Mus musculus
gtgtatgtgtgtgtgtgtgcatg

SEQ ID NO: 223217 - DNA, 23 bp, Mus musculus
tatgtgtatatgtatatgtatat

SEQ ID NO: 223218 - DNA, 20 bp, Mus musculus
tatgtatatgatgtatatgt

SEQ ID NO: 223219 - DNA, 21 bp, Mus musculus
tccatggtggtctgataggat

SEQ ID NO: 223220 - DNA, 20 bp, Mus musculus
tatcagagggatgttcccag

SEQ ID NO: 223221 - DNA, 23 bp, Mus musculus
tggggaagaaatgagtctgagca

SEQ ID NO: 223222 - DNA, 21 bp, Mus musculus
tatggttatatatacatatgt

SEQ ID NO: 223223 - DNA, 23 bp, Mus musculus
aagaactatagataagaacagaa

SEQ ID NO: 223224 - DNA, 20 bp, Mus musculus
tccatggtggtctgatagga

SEQ ID NO: 223225 - DNA, 23 bp, Mus musculus
tgtctctctgtctgccatgtggg

SEQ ID NO: 223226 - DNA, 22 bp, Mus musculus
atgtgtgtgtatgtgtctgtgt

SEQ ID NO: 223227 - DNA, 23 bp, Mus musculus
tatgcaattctcatgctttgtag

SEQ ID NO: 223228 - DNA, 22 bp, Mus musculus
gagttctagctacttttgatgt

SEQ ID NO: 223229 - DNA, 18 bp, Mus musculus
tacttatacatgatgttt

SEQ ID NO: 223230 - DNA, 18 bp, Mus musculus
aggtaagaattcatgtat

SEQ ID NO: 223231 - DNA, 20 bp, Mus musculus
agcaagtagcatgtattcat

SEQ ID NO: 223232 - DNA, 23 bp, Mus musculus
tgactgtgagcatctgcttctgt

SEQ ID NO: 223233 - DNA, 23 bp, Mus musculus
tgactctgacactgacatgctag

SEQ ID NO: 223234 - DNA, 23 bp, Mus musculus
atgtcagtgtctgattctggagt

SEQ ID NO: 223235 - DNA, 18 bp, Mus musculus
aagcctcagacatgggat

SEQ ID NO: 223236 - DNA, 23 bp, Mus musculus
agctacagtagtctcgagtttcc

SEQ ID NO: 223237 - DNA, 23 bp, Mus musculus
gtgtgcacacatgttttgtggct

SEQ ID NO: 223238 - DNA, 23 bp, Mus musculus
acacactgtcattgtgcttcgct

SEQ ID NO: 223239 - DNA, 23 bp, Mus musculus
cactgtctgtgtgccttgtcttt

SEQ ID NO: 223240 - DNA, 23 bp, Mus musculus
agagtacaaccttaggtgttgga

SEQ ID NO: 223241 - DNA, 20 bp, Mus musculus
gagtgtgtgtgagtgcgcgc

SEQ ID NO: 223242 - DNA, 23 bp, Mus musculus
atagttcttgttcaaatgttttt

SEQ ID NO: 223243 - DNA, 22 bp, Mus musculus
tgttttgtgaccaattatatgg

SEQ ID NO: 223244 - DNA, 23 bp, Mus musculus
atcactctcctcattctgtcact

SEQ ID NO: 223245 - DNA, 23 bp, Mus musculus
agtcaaaagaagcagcacaggaa

SEQ ID NO: 223246 - DNA, 22 bp, Mus musculus
tgttttgtgaccaattatatgg

SEQ ID NO: 223247 - DNA, 23 bp, Mus musculus
tgtgtgtatttatatatgtgtgt

SEQ ID NO: 223248 - DNA, 23 bp, Mus musculus
aaatgtactagcatatgtgtaaa

SEQ ID NO: 223249 - DNA, 22 bp, Mus musculus
cagactgaagtctgtgtgtact

SEQ ID NO: 223250 - DNA, 22 bp, Mus musculus
tgagttcaaatccagcaaccac

SEQ ID NO: 223251 - DNA, 22 bp, Mus musculus
ggctgtagcttgtatagtagta

SEQ ID NO: 223252 - DNA, 22 bp, Mus musculus
tcgtgtcttgtgttgcagccgg

SEQ ID NO: 223253 - DNA, 18 bp, Mus musculus
tcattccttttgtcagag

SEQ ID NO: 223254 - DNA, 21 bp, Mus musculus
aatgtatagtgcaacctgttt

SEQ ID NO: 223255 - DNA, 21 bp, Mus musculus
ctgtgtgtgcatgtccatgtg

SEQ ID NO: 223256 - DNA, 20 bp, Mus musculus
tatctgtatgtgtttgtaca

SEQ ID NO: 223257 - DNA, 23 bp, Mus musculus
atctgactgctcttccagaggtc

SEQ ID NO: 223258 - DNA, 23 bp, Mus musculus
gtgctctgtctgtctgtctgtct

SEQ ID NO: 223259 - DNA, 23 bp, Mus musculus
actgtgtctctgtttagtttctg

SEQ ID NO: 223260 - DNA, 22 bp, Mus musculus
tctgtgtatctgtttcttgaat

SEQ ID NO: 223261 - DNA, 23 bp, Mus musculus
tctcagatctgtctctgtcccgg

SEQ ID NO: 223262 - DNA, 23 bp, Mus musculus
gtatgtatgtatgtatgtatgta

SEQ ID NO: 223263 - DNA, 21 bp, Mus musculus
atgcatgcatgcatgtgtgtg

SEQ ID NO: 223264 - DNA, 21 bp, Mus musculus
tatatgtatatatatatgtgt

SEQ ID NO: 223265 - DNA, 20 bp, Mus musculus
atatctaaatgaaactagtt

SEQ ID NO: 223266 - DNA, 23 bp, Mus musculus
gagcacacagaaagcagtgtgct

SEQ ID NO: 223267 - DNA, 23 bp, Mus musculus
tagtccatggtgatctgatagga

SEQ ID NO: 223268 - DNA, 22 bp, Mus musculus
aatctgtgattttcttattgtg

SEQ ID NO: 223269 - DNA, 22 bp, Mus musculus
tatgagacagaaatgaggtgga

SEQ ID NO: 223270 - DNA, 23 bp, Mus musculus
tttctagtactatggaaatgtgt

SEQ ID NO: 223271 - DNA, 23 bp, Mus musculus
attttgatgttctcaatgcttgt

SEQ ID NO: 223272 - DNA, 23 bp, Mus musculus
ttgcctttatcttgtacaagttt

SEQ ID NO: 223273 - DNA, 23 bp, Mus musculus
ctgagaagaaggtatagtctttt

SEQ ID NO: 223274 - DNA, 21 bp, Mus musculus
tttcactgtgtctctgtttag

SEQ ID NO: 223275 - DNA, 23 bp, Mus musculus
cctgggactgacccactgagtgc

SEQ ID NO: 223276 - DNA, 22 bp, Mus musculus
aatgtgaggttctaggttagtg

SEQ ID NO: 223277 - DNA, 23 bp, Mus musculus
cacaccctctgtcagtcagattc

SEQ ID NO: 223278 - DNA, 22 bp, Mus musculus
tttgtatgtatgtatatgtctg

SEQ ID NO: 223279 - DNA, 23 bp, Mus musculus
tccctctctcgatggctgactgt

SEQ ID NO: 223280 - DNA, 23 bp, Mus musculus
tccacaatgagagaattagatgt

SEQ ID NO: 223281 - DNA, 23 bp, Mus musculus
gtatgtctatgtgtattgtgtgt

SEQ ID NO: 223282 - DNA, 23 bp, Mus musculus
tgagattagaagcaggtgtcatt

SEQ ID NO: 223283 - DNA, 23 bp, Mus musculus
tgtctgtctgtctgtctctccag

SEQ ID NO: 223284 - DNA, 22 bp, Mus musculus
tgttttgtgaccaattatatgg

SEQ ID NO: 223285 - DNA, 19 bp, Mus musculus
ggctagaagttggggaaca

SEQ ID NO: 223286 - DNA, 22 bp, Mus musculus
atagtacatgtatatatgtgtg

SEQ ID NO: 223287 - DNA, 23 bp, Mus musculus
tatgtgtatgtggtatgtatgtg

SEQ ID NO: 223288 - DNA, 23 bp, Mus musculus
atatgtgtgtatatatgtgtgtg

SEQ ID NO: 223289 - DNA, 21 bp, Mus musculus
atgcatgtatgcatatgtatg

SEQ ID NO: 223290 - DNA, 22 bp, Mus musculus
ataagtctgggttagttggttc

SEQ ID NO: 223291 - DNA, 23 bp, Mus musculus
ttgtatctgcttccagtgtgaga

SEQ ID NO: 223292 - DNA, 18 bp, Mus musculus
tctcactggcaaattgat

SEQ ID NO: 223293 - DNA, 21 bp, Mus musculus
cagctatttcttctgctcact

SEQ ID NO: 223294 - DNA, 23 bp, Mus musculus
gagcaggagctagtttctgttct

SEQ ID NO: 223295 - DNA, 23 bp, Mus musculus
tatacatgggtttgtgtgtatat

SEQ ID NO: 223296 - DNA, 23 bp, Mus musculus
acacacaccatatatatgtatat

SEQ ID NO: 223297 - DNA, 23 bp, Mus musculus
tagtatgtgtgcatgtgcatgtg

SEQ ID NO: 223298 - DNA, 21 bp, Mus musculus
tcagaaggttctgtagctcac

SEQ ID NO: 223299 - DNA, 23 bp, Mus musculus
ttctctgtgtgcacttcgtgcag

SEQ ID NO: 223300 - DNA, 23 bp, Mus musculus
gtatatatgtgtgtgcatatcac

SEQ ID NO: 223301 - DNA, 20 bp, Mus musculus
ctgtgcaagggacactgtgg

SEQ ID NO: 223302 - DNA, 23 bp, Mus musculus
gtcgctccctcagtgcctgggac

SEQ ID NO: 223303 - DNA, 23 bp, Mus musculus
tctgtctctctcaaaatcatggg

SEQ ID NO: 223304 - DNA, 19 bp, Mus musculus
acacacacgagagagagag

SEQ ID NO: 223305 - DNA, 20 bp, Mus musculus
ttctgctatacaatgaaaat

SEQ ID NO: 223306 - DNA, 22 bp, Mus musculus
tgttttgtgaccaattatatgg

SEQ ID NO: 223307 - DNA, 22 bp, Mus musculus
tgttttgtgaccaattatatgg

SEQ ID NO: 223308 - DNA, 23 bp, Mus musculus
tctggctcctaaagatgtaagca

SEQ ID NO: 223309 - DNA, 23 bp, Mus musculus
tctggctcctaaagatgtaagca

SEQ ID NO: 223310 - DNA, 23 bp, Mus musculus
tgcgctgtaatacagcttgaggt

SEQ ID NO: 223311 - DNA, 23 bp, Mus musculus
tgtaagcatgtacatgaatattt

SEQ ID NO: 223312 - DNA, 23 bp, Mus musculus
ttatgtgtgcatgagtgtacatg

SEQ ID NO: 223313 - DNA, 23 bp, Mus musculus
agttgagtatatgtatatgtgtg

SEQ ID NO: 223314 - DNA, 21 bp, Mus musculus
tatgagttaataatatgtgat

SEQ ID NO: 223315 - DNA, 22 bp, Mus musculus
atgtatgtatatgtatatgtat

SEQ ID NO: 223316 - DNA, 18 bp, Mus musculus
aatgtcttagaaagtata

SEQ ID NO: 223317 - DNA, 23 bp, Mus musculus
gtctgttcagactctgcactctc

SEQ ID NO: 223318 - DNA, 22 bp, Mus musculus
tgttttgtgaccaattatatgg

SEQ ID NO: 223319 - DNA, 23 bp, Mus musculus
tacagcactattttaaatgagaa

SEQ ID NO: 223320 - DNA, 23 bp, Mus musculus
agaagtgtgttgttcagtttcca

SEQ ID NO: 223321 - DNA, 23 bp, Mus musculus
tcacacagactcactatttgtcc

SEQ ID NO: 223322 - DNA, 22 bp, Mus musculus
tgttttgtgaccaattatatgg

SEQ ID NO: 223323 - DNA, 22 bp, Mus musculus
tgttttgtgaccaattatatgg

SEQ ID NO: 223324 - DNA, 23 bp, Mus musculus
tttctcagcctgcttttgtgtac

SEQ ID NO: 223325 - DNA, 23 bp, Mus musculus
tgagaagagtgttgtttagtttc

SEQ ID NO: 223326 - DNA, 22 bp, Mus musculus
cttagtccatggtgatctgata

SEQ ID NO: 223327 - DNA, 20 bp, Mus musculus
ttttctgacacctacagatg

SEQ ID NO: 223328 - DNA, 21 bp, Mus musculus
tctttctgtgatgagtctctg

SEQ ID NO: 223329 - DNA, 18 bp, Mus musculus
ttggacagccagtctaac

SEQ ID NO: 223330 - DNA, 21 bp, Mus musculus
tctctgtttgcttatcttgct

SEQ ID NO: 223331 - DNA, 23 bp, Mus musculus
tccatctctgagcatcccattac

SEQ ID NO: 223332 - DNA, 22 bp, Mus musculus
tgttttgtgaccaattatatgg

SEQ ID NO: 223333 - DNA, 23 bp, Mus musculus
gacttttaggaattgtaatgtta

SEQ ID NO: 223334 - DNA, 20 bp, Mus musculus
tatttgttttctaatggtct

SEQ ID NO: 223335 - DNA, 23 bp, Mus musculus
taagaatgagttattgttgctca

SEQ ID NO: 223336 - DNA, 22 bp, Mus musculus
aaacacacacatatacatgtat

SEQ ID NO: 223337 - DNA, 21 bp, Mus musculus
atgtatgtatgtatatgtatg

SEQ ID NO: 223338 - DNA, 18 bp, Mus musculus
aggtgtgttctgtcacag

SEQ ID NO: 223339 - DNA, 21 bp, Mus musculus
tgggagctggagagatcgctc

SEQ ID NO: 223340 - DNA, 23 bp, Mus musculus
tatatgtgtatatgtatattgta

SEQ ID NO: 223341 - DNA, 20 bp, Mus musculus
aaagtgctgtcactgccatt

SEQ ID NO: 223342 - DNA, 23 bp, Mus musculus
tcactgtggagtgtcagcagaga

SEQ ID NO: 223343 - DNA, 23 bp, Mus musculus
atcacacaactgtcctgcaatct

SEQ ID NO: 223344 - DNA, 18 bp, Mus musculus
tgtgcatgtgtgtatgtg

SEQ ID NO: 223345 - DNA, 23 bp, Mus musculus
cttttgtatgtatgtatgtatgt

SEQ ID NO: 223346 - DNA, 23 bp, Mus musculus
tgtgtctctgtctgtctgcctgt

SEQ ID NO: 223347 - DNA, 23 bp, Mus musculus
tcaagcctgtctcagtgtcactc

SEQ ID NO: 223348 - DNA, 23 bp, Mus musculus
tgtctgtctgcctgcctgtctgt

SEQ ID NO: 223349 - DNA, 23 bp, Mus musculus
ttactgtctctcagtgtgtcttc

SEQ ID NO: 223350 - DNA, 23 bp, Mus musculus
gcattaggctcagaaaggaaatc

SEQ ID NO: 223351 - DNA, 23 bp, Mus musculus
taactctcagctgtctctctctg

SEQ ID NO: 223352 - DNA, 23 bp, Mus musculus
tgtcctggaactcactttgtaga

SEQ ID NO: 223353 - DNA, 18 bp, Mus musculus
aggtcacgctcactctga

SEQ ID NO: 223354 - DNA, 23 bp, Mus musculus
tttggcagagtctgagcgtgtct

SEQ ID NO: 223355 - DNA, 23 bp, Mus musculus
aaagatttcacagagtttttgca

SEQ ID NO: 223356 - DNA, 23 bp, Mus musculus
tctgtgtcactgtcacttccagc

SEQ ID NO: 223357 - DNA, 23 bp, Mus musculus
acacacactgataatgtctacat

SEQ ID NO: 223358 - DNA, 23 bp, Mus musculus
tgtcagtctgtctgtccatccct

SEQ ID NO: 223359 - DNA, 23 bp, Mus musculus
cagaactggactttgtgctagat

SEQ ID NO: 223360 - DNA, 22 bp, Mus musculus
tagacttctgtctctgtagatg

SEQ ID NO: 223361 - DNA, 23 bp, Mus musculus
tattgtaagtttgttgatgtcat

SEQ ID NO: 223362 - DNA, 21 bp, Mus musculus
tgaaatgtgaggtacagagag

SEQ ID NO: 223363 - DNA, 23 bp, Mus musculus
aatagttattttcttattctgtg

SEQ ID NO: 223364 - DNA, 23 bp, Mus musculus
atgtctgtgtctgtaacttctgt

SEQ ID NO: 223365 - DNA, 22 bp, Mus musculus
tttgaccttgaatatgagctgt

SEQ ID NO: 223366 - DNA, 22 bp, Mus musculus
tgttttgtgaccaattatatgg

SEQ ID NO: 223367 - DNA, 19 bp, Mus musculus
tgagattctgagatcttgg

SEQ ID NO: 223368 - DNA, 22 bp, Mus musculus
ttttatgtgcatgcatgttttt

SEQ ID NO: 223369 - DNA, 23 bp, Mus musculus
gtcacactgaagattgtcaggtg

SEQ ID NO: 223370 - DNA, 22 bp, Mus musculus
acaatgacagtctgcaggttat

SEQ ID NO: 223371 - DNA, 23 bp, Mus musculus
tatatgcatgtatatgtatatat

SEQ ID NO: 223372 - DNA, 20 bp, Mus musculus
gaggattcagtgttggtggt

SEQ ID NO: 223373 - DNA, 19 bp, Mus musculus
tcacagaagccagagacct

SEQ ID NO: 223374 - DNA, 23 bp, Mus musculus
attgttgtttttgaggtgctagg

SEQ ID NO: 223375 - DNA, 23 bp, Mus musculus
tgccactctgccacactctcagc

SEQ ID NO: 223376 - DNA, 19 bp, Mus musculus
tacttccatcttttaaaga

SEQ ID NO: 223377 - DNA, 19 bp, Mus musculus
taaagtacgcagtgtctgg

SEQ ID NO: 223378 - DNA, 23 bp, Mus musculus
agcctgtctctctcactcagtca

SEQ ID NO: 223379 - DNA, 22 bp, Mus musculus
tcactgtcaggattcctacagg

SEQ ID NO: 223380 - DNA, 23 bp, Mus musculus
tcactgtcaggattactacagga

SEQ ID NO: 223381 - DNA, 22 bp, Mus musculus
tcactgtcaggattcctacagg

SEQ ID NO: 223382 - DNA, 23 bp, Mus musculus
tgtgtctgtatgtctatgtgcat

SEQ ID NO: 223383 - DNA, 22 bp, Mus musculus
ctgtgcacatgagtgcgtgtat

SEQ ID NO: 223384 - DNA, 23 bp, Mus musculus
aggtttgaatgtttgtatgtatg

SEQ ID NO: 223385 - DNA, 22 bp, Mus musculus
aatgagagtcaagactgtgagc

SEQ ID NO: 223386 - DNA, 23 bp, Mus musculus
ggaaacacatgtgattttgatgt

SEQ ID NO: 223387 - DNA, 19 bp, Mus musculus
ttacaagatctccctgtgg

SEQ ID NO: 223388 - DNA, 22 bp, Mus musculus
tgcactgtgagcatagtgagga

SEQ ID NO: 223389 - DNA, 18 bp, Mus musculus
tgcactgtgagcaccgtg

SEQ ID NO: 223390 - DNA, 21 bp, Mus musculus
aatgtgcatattttatgtgtc

SEQ ID NO: 223391 - DNA, 19 bp, Mus musculus
tatgtatgtatatgcatgt

SEQ ID NO: 223392 - DNA, 20 bp, Mus musculus
tgcgtgtatgtatatatgta

SEQ ID NO: 223393 - DNA, 23 bp, Mus musculus
tgtatgtatgtgtatatgtatgt

SEQ ID NO: 223394 - DNA, 21 bp, Mus musculus
atgtatgtatgtatgtgtatg

SEQ ID NO: 223395 - DNA, 19 bp, Mus musculus
ctagcctcagactcacaga

SEQ ID NO: 223396 - DNA, 21 bp, Mus musculus
actggctcagcataaggagtg

SEQ ID NO: 223397 - DNA, 23 bp, Mus musculus
tcaatctctctgactgtggcatt

SEQ ID NO: 223398 - DNA, 20 bp, Mus musculus
agacagacaacagatgagtc

SEQ ID NO: 223399 - DNA, 23 bp, Mus musculus
cagcagcagcattaaagtgtgtg

SEQ ID NO: 223400 - DNA, 23 bp, Mus musculus
catgtctctctttgtctctctca

SEQ ID NO: 223401 - DNA, 23 bp, Mus musculus
caagttgaaagctggtgtgggcg

SEQ ID NO: 223402 - DNA, 23 bp, Mus musculus
ctagtaaagtagaaaaaggcttg

SEQ ID NO: 223403 - DNA, 23 bp, Mus musculus
tttctcacactgtaagttatctg

SEQ ID NO: 223404 - DNA, 23 bp, Mus musculus
tatgtgtatatatatgtatgtgt

SEQ ID NO: 223405 - DNA, 20 bp, Mus musculus
tgactgcagtgtgtgagctc

SEQ ID NO: 223406 - DNA, 18 bp, Mus musculus
agacagcatggatgagtg

SEQ ID NO: 223407 - DNA, 23 bp, Mus musculus
ccctgaggttttctgagggttgg

SEQ ID NO: 223408 - DNA, 21 bp, Mus musculus
tccttctttctctcacagagt

SEQ ID NO: 223409 - DNA, 22 bp, Mus musculus
tatcacagggtacatgagctgt

SEQ ID NO: 223410 - DNA, 18 bp, Mus musculus
tgccacaggatacagtgt

SEQ ID NO: 223411 - DNA, 23 bp, Mus musculus
tcagtgactgtcagtgtgtatgg

SEQ ID NO: 223412 - DNA, 23 bp, Mus musculus
ctggctgtgagtctctgtgtttg

SEQ ID NO: 223413 - DNA, 23 bp, Mus musculus
ttactgacttgtagttatctcga

SEQ ID NO: 223414 - DNA, 21 bp, Mus musculus
tttgtctgtctctcacttttc

SEQ ID NO: 223415 - DNA, 23 bp, Mus musculus
cttatactgtctggtatcacttt

SEQ ID NO: 223416 - DNA, 21 bp, Mus musculus
tacttctttatgtacccatat

SEQ ID NO: 223417 - DNA, 21 bp, Mus musculus
tggaatgtaaagaagtatgta

SEQ ID NO: 223418 - DNA, 23 bp, Mus musculus
tttggtccccttcaaccagctgt

SEQ ID NO: 223419 - DNA, 23 bp, Mus musculus
tctctccctctgtgtgtatgaga

SEQ ID NO: 223420 - DNA, 23 bp, Mus musculus
cagagacagtcacagagagagag

SEQ ID NO: 223421 - DNA, 19 bp, Mus musculus
tcactgtatttataatctg

SEQ ID NO: 223422 - DNA, 23 bp, Mus musculus
ttttaggtagactggctttgtaa

SEQ ID NO: 223423 - DNA, 23 bp, Mus musculus
tatgactctacttgtattgtgta

SEQ ID NO: 223424 - DNA, 23 bp, Mus musculus
tcacagtgtgtcacacagtacac

SEQ ID NO: 223425 - DNA, 23 bp, Mus musculus
aagggcagtggaagatttgactt

SEQ ID NO: 223426 - DNA, 18 bp, Mus musculus
tgtttgtctgactgcttg

SEQ ID NO: 223427 - DNA, 23 bp, Mus musculus
tgtgtctctcacagacagccgga

SEQ ID NO: 223428 - DNA, 22 bp, Mus musculus
taagtaagagacataggttctg

SEQ ID NO: 223429 - DNA, 19 bp, Mus musculus
ctcagaactgagtgtccag

SEQ ID NO: 223430 - DNA, 23 bp, Mus musculus
tcttgagtttttctagttcttca

SEQ ID NO: 223431 - DNA, 23 bp, Mus musculus
tttgcctctggatgatctcaggg

SEQ ID NO: 223432 - DNA, 20 bp, Mus musculus
tggctgtagattatgcaatg

SEQ ID NO: 223433 - DNA, 22 bp, Mus musculus
tgttttgtgaccaattatatgg

SEQ ID NO: 223434 - DNA, 23 bp, Mus musculus
ctgtgtctctgtttagtttctgt

SEQ ID NO: 223435 - DNA, 22 bp, Mus musculus
aggatctgtccattgatgagag

SEQ ID NO: 223436 - DNA, 23 bp, Mus musculus
tgagtctctttgtcactgacagt

SEQ ID NO: 223437 - DNA, 23 bp, Mus musculus
tggaatgaatacaagtttgaggt

SEQ ID NO: 223438 - DNA, 23 bp, Mus musculus
agtgagttcaaggtttattgttg

SEQ ID NO: 223439 - DNA, 23 bp, Mus musculus
gttctgtcaggctgcctcactgt

SEQ ID NO: 223440 - DNA, 18 bp, Mus musculus
gagaggtttagactggaa

SEQ ID NO: 223441 - DNA, 23 bp, Mus musculus
agtctctgtgtgtgtatgtacac

SEQ ID NO: 223442 - DNA, 21 bp, Mus musculus
acacactcaggctttcatatc

SEQ ID NO: 223443 - DNA, 20 bp, Mus musculus
tgctggcgagaaactagctc

SEQ ID NO: 223444 - DNA, 23 bp, Mus musculus
tagtccatggtgatctgatagga

SEQ ID NO: 223445 - DNA, 21 bp, Mus musculus
tgacatggatatggaaaggac

SEQ ID NO: 223446 - DNA, 23 bp, Mus musculus
tttgtagaactaggttgtataca

SEQ ID NO: 223447 - DNA, 19 bp, Mus musculus
tgtcagtgtatatatgtgt

SEQ ID NO: 223448 - DNA, 22 bp, Mus musculus
tgtgttagagcacctggaagtg

SEQ ID NO: 223449 - DNA, 21 bp, Mus musculus
agtgaagtgtcggtggactgt

SEQ ID NO: 223450 - DNA, 19 bp, Mus musculus
tatgtatatatatatatgt

SEQ ID NO: 223451 - DNA, 23 bp, Mus musculus
tagtccatagtgatctgatagga

SEQ ID NO: 223452 - DNA, 23 bp, Mus musculus
tgtgatcatggttgtgtcagaac

SEQ ID NO: 223453 - DNA, 20 bp, Mus musculus
tgtgatcctgagatcctggg

SEQ ID NO: 223454 - DNA, 22 bp, Mus musculus
tgttttgtgaccaattatatgg

SEQ ID NO: 223455 - DNA, 20 bp, Mus musculus
ccatggtgatctgataggat

SEQ ID NO: 223456 - DNA, 22 bp, Mus musculus
ttgttttgtgacccattatgtg

SEQ ID NO: 223457 - DNA, 23 bp, Mus musculus
tcactgtcagtctgtctgtctgc

SEQ ID NO: 223458 - DNA, 22 bp, Mus musculus
taaaacacagtgattaaggtgg

SEQ ID NO: 223459 - DNA, 20 bp, Mus musculus
acctagatggttctattgtt

SEQ ID NO: 223460 - DNA, 23 bp, Mus musculus
gacaggcaagagccacagagcct

SEQ ID NO: 223461 - DNA, 23 bp, Mus musculus
actctgtatgcctctgcatcagc

SEQ ID NO: 223462 - DNA, 23 bp, Mus musculus
agtcctgtgtctgtgtctcactt

SEQ ID NO: 223463 - DNA, 21 bp, Mus musculus
tgacatgttagattactgagg

SEQ ID NO: 223464 - DNA, 21 bp, Mus musculus
ttccatgcacctgtgtgtgta

SEQ ID NO: 223465 - DNA, 21 bp, Mus musculus
tgtgatggtcattgtgtgaca

SEQ ID NO: 223466 - DNA, 19 bp, Mus musculus
cacagagaggaatggctgc

SEQ ID NO: 223467 - DNA, 23 bp, Mus musculus
tgggtgtgtctctgagtgtgttt

SEQ ID NO: 223468 - DNA, 19 bp, Mus musculus
atatgtgtatgtgtatatg

SEQ ID NO: 223469 - DNA, 21 bp, Mus musculus
atatacatacatatgtataca

SEQ ID NO: 223470 - DNA, 22 bp, Mus musculus
tgtgtgtgtgtgcttgtatata

SEQ ID NO: 223471 - DNA, 23 bp, Mus musculus
ttccaggtgtgtgtgtgtgtgcg

SEQ ID NO: 223472 - DNA, 23 bp, Mus musculus
tgtgcttgtatatatgtatgtat

SEQ ID NO: 223473 - DNA, 22 bp, Mus musculus
tacattccaggtgtgtgtgtgt

SEQ ID NO: 223474 - DNA, 21 bp, Mus musculus
tgtgtgtatgtgtgtgtgtgc

SEQ ID NO: 223475 - DNA, 23 bp, Mus musculus
tgtgcttgtatatatgtatgtat

SEQ ID NO: 223476 - DNA, 23 bp, Mus musculus
tgtgtgtgtgcttgtatatatgt

SEQ ID NO: 223477 - DNA, 22 bp, Mus musculus
tgtgtgtgtgtgcttgtatata

SEQ ID NO: 223478 - DNA, 20 bp, Mus musculus
aatgcaggcatgtgggaggg

SEQ ID NO: 223479 - DNA, 22 bp, Mus musculus
tgttttgtgaccaattatatgg

SEQ ID NO: 223480 - DNA, 23 bp, Mus musculus
tctgtgacagttaattttgtgtc

SEQ ID NO: 223481 - DNA, 23 bp, Mus musculus
agagagacatagagctttccttc

SEQ ID NO: 223482 - DNA, 23 bp, Mus musculus
gtgtcactgcctgtgtctctgta

SEQ ID NO: 223483 - DNA, 23 bp, Mus musculus
tatctgctccacactttgtctct

SEQ ID NO: 223484 - DNA, 23 bp, Mus musculus
tctgtctgcctttgtctctgaaa

SEQ ID NO: 223485 - DNA, 23 bp, Mus musculus
tgtgaggaagtgcaagcgcaagc

SEQ ID NO: 223486 - DNA, 23 bp, Mus musculus
tgtgtatgtatatatatatgtgt

SEQ ID NO: 223487 - DNA, 23 bp, Mus musculus
atgtgtatatatgtatatgtatg

SEQ ID NO: 223488 - DNA, 20 bp, Mus musculus
tctgtctctgcattattatg

SEQ ID NO: 223489 - DNA, 23 bp, Mus musculus
caagtctctgtctctcgctgagg

SEQ ID NO: 223490 - DNA, 23 bp, Mus musculus
agagcactgactgctcttccaga

SEQ ID NO: 223491 - DNA, 20 bp, Mus musculus
ctcagatcagtgagagcagt

SEQ ID NO: 223492 - DNA, 23 bp, Mus musculus
agtgtctgattgtggatgtctgt

SEQ ID NO: 223493 - DNA, 23 bp, Mus musculus
cctgggtctgtctgtctctgccc

SEQ ID NO: 223494 - DNA, 23 bp, Mus musculus
agacctgcgacacactgtgtcac

SEQ ID NO: 223495 - DNA, 20 bp, Mus musculus
tgtgtgcatgagtatgtgcc

SEQ ID NO: 223496 - DNA, 21 bp, Mus musculus
agagatgagtgtgaccagaag

SEQ ID NO: 223497 - DNA, 23 bp, Mus musculus
aagggatttctttggttattttt

SEQ ID NO: 223498 - DNA, 21 bp, Mus musculus
tgctttacagagtggtctgaa

SEQ ID NO: 223499 - DNA, 23 bp, Mus musculus
tcttgctctctgtgatacattct

SEQ ID NO: 223500 - DNA, 22 bp, Mus musculus
ccccagtgtctctctctgcctc

SEQ ID NO: 223501 - DNA, 20 bp, Mus musculus
aagagcttctttagaaggca

SEQ ID NO: 223502 - DNA, 23 bp, Mus musculus
tctctgcttgaactgaggaagcc

SEQ ID NO: 223503 - DNA, 23 bp, Mus musculus
aaggctatgtcactgtttctgtg

SEQ ID NO: 223504 - DNA, 23 bp, Mus musculus
tgagtcacagtctgtctgttctc

SEQ ID NO: 223505 - DNA, 23 bp, Mus musculus
atctgtgtgtgtgcatgtgcatg

SEQ ID NO: 223506 - DNA, 22 bp, Mus musculus
tgttttgtgaccaattatatgg

SEQ ID NO: 223507 - DNA, 23 bp, Mus musculus
gtatgtgtgtgtgcatgtgagtg

SEQ ID NO: 223508 - DNA, 23 bp, Mus musculus
tttgtacatctatgagtatgtgt

SEQ ID NO: 223509 - DNA, 20 bp, Mus musculus
agtgcttacagtgttaggag

SEQ ID NO: 223510 - DNA, 21 bp, Mus musculus
atctgagaacaaagtgagcac

SEQ ID NO: 223511 - DNA, 21 bp, Mus musculus
tagccaagtgctagctttggg

SEQ ID NO: 223512 - DNA, 20 bp, Mus musculus
tgtctctcactgaccagtta

SEQ ID NO: 223513 - DNA, 23 bp, Mus musculus
tgaccttaaccatctctttgttg

SEQ ID NO: 223514 - DNA, 21 bp, Mus musculus
ctggttctcagactctcggac

SEQ ID NO: 223515 - DNA, 22 bp, Mus musculus
tgttttgtgaccaattatatgg

SEQ ID NO: 223516 - DNA, 23 bp, Mus musculus
aagagtgcatatgtatatgtgtg

SEQ ID NO: 223517 - DNA, 20 bp, Mus musculus
tgtgtacatatgtaagtgta

SEQ ID NO: 223518 - DNA, 20 bp, Mus musculus
ctgtctctgtgtggctggaa

SEQ ID NO: 223519 - DNA, 23 bp, Mus musculus
aaagcagagtagaagagcaacag

SEQ ID NO: 223520 - DNA, 23 bp, Mus musculus
ttgtgcatgtgcaggtgtgtgtg

SEQ ID NO: 223521 - DNA, 20 bp, Mus musculus
aggctcagaatgcaggttca

SEQ ID NO: 223522 - DNA, 21 bp, Mus musculus
gtctctctgtctgtctgggac

SEQ ID NO: 223523 - DNA, 23 bp, Mus musculus
agagcactattctacctgtttct

SEQ ID NO: 223524 - DNA, 21 bp, Mus musculus
ctgtctcactgtctgcgcggt

SEQ ID NO: 223525 - DNA, 20 bp, Mus musculus
aagtgcaggcaaaacattca

SEQ ID NO: 223526 - DNA, 19 bp, Mus musculus
cactgagcaatatcttcag

SEQ ID NO: 223527 - DNA, 18 bp, Mus musculus
atgatggtctgataggat

SEQ ID NO: 223528 - DNA, 22 bp, Mus musculus
tgttttgtgaccaattatatgg

SEQ ID NO: 223529 - DNA, 22 bp, Mus musculus
attgtgagaagtgagtcagctg

SEQ ID NO: 223530 - DNA, 22 bp, Mus musculus
tgttttgtgaccaattatatgg

SEQ ID NO: 223531 - DNA, 22 bp, Mus musculus
tgttttgtgaccaattatatgg

SEQ ID NO: 223532 - DNA, 23 bp, Mus musculus
ggtctcactgactgactgttctg

SEQ ID NO: 223533 - DNA, 23 bp, Mus musculus
atatgacagacagagaaagcagt

SEQ ID NO: 223534 - DNA, 21 bp, Mus musculus
atgtatgtatgtatgtatgta

SEQ ID NO: 223535 - DNA, 20 bp, Mus musculus
agacagacagacatgcatgt

SEQ ID NO: 223536 - DNA, 23 bp, Mus musculus
gtgagtctgtctgattgttctca

SEQ ID NO: 223537 - DNA, 23 bp, Mus musculus
gtctgtctgtctgtctgcctacc

SEQ ID NO: 223538 - DNA, 23 bp, Mus musculus
tgtgtctgtctgtctgtctgtcc

SEQ ID NO: 223539 - DNA, 23 bp, Mus musculus
gcagctgagagacagagaggcag

SEQ ID NO: 223540 - DNA, 23 bp, Mus musculus
caggctctctctctccctgagga

SEQ ID NO: 223541 - DNA, 20 bp, Mus musculus
ttttcaggacagggtggaga

SEQ ID NO: 223542 - DNA, 21 bp, Mus musculus
agaggacatcctagagacagg

SEQ ID NO: 223543 - DNA, 23 bp, Mus musculus
tatcacacgcacactgtgcctgt

SEQ ID NO: 223544 - DNA, 21 bp, Mus musculus
aaaggtcttaagttcaattcc

SEQ ID NO: 223545 - DNA, 23 bp, Mus musculus
tgagaccctcactgtctgggtga

SEQ ID NO: 223546 - DNA, 23 bp, Mus musculus
cattgttgtcgctgtgctctgtg

SEQ ID NO: 223547 - DNA, 19 bp, Mus musculus
ctgagtacaatggcagcag

SEQ ID NO: 223548 - DNA, 21 bp, Mus musculus
agctctggctattctggaact

SEQ ID NO: 223549 - DNA, 23 bp, Mus musculus
tatgctaatgtatgctatgtgtg

SEQ ID NO: 223550 - DNA, 21 bp, Mus musculus
ttcaaatctcagcaaccacat

SEQ ID NO: 223551 - DNA, 18 bp, Mus musculus
taagctctgatgctgcac

SEQ ID NO: 223552 - DNA, 23 bp, Mus musculus
tcaccctgtcaccctgtcccact

SEQ ID NO: 223553 - DNA, 21 bp, Mus musculus
attctctgagcttgtggtcac

SEQ ID NO: 223554 - DNA, 23 bp, Mus musculus
tgttaagaaaatgaaaagccagg

SEQ ID NO: 223555 - DNA, 23 bp, Mus musculus
tgacactaacagtctctgtatgt

SEQ ID NO: 223556 - DNA, 23 bp, Mus musculus
accaggtctgtgtctccctcagt

SEQ ID NO: 223557 - DNA, 23 bp, Mus musculus
tgtaacagcaactccatgtggaa

SEQ ID NO: 223558 - DNA, 23 bp, Mus musculus
tgacctatgaattgacagccagt

SEQ ID NO: 223559 - DNA, 22 bp, Mus musculus
cacaggtatgttcacctcaatg

SEQ ID NO: 223560 - DNA, 23 bp, Mus musculus
tgtcactctctgcgtcacatctc

SEQ ID NO: 223561 - DNA, 19 bp, Mus musculus
ctgctgcttattgtcactg

SEQ ID NO: 223562 - DNA, 19 bp, Mus musculus
tcactgtgctgagtgagct

SEQ ID NO: 223563 - DNA, 23 bp, Mus musculus
aaactagtagcatgctttggctg

SEQ ID NO: 223564 - DNA, 23 bp, Mus musculus
atgtgtgtatgtatatgtatgta

SEQ ID NO: 223565 - DNA, 21 bp, Mus musculus
tgggtggctggctctctgtga

SEQ ID NO: 223566 - DNA, 23 bp, Mus musculus
atgcatgtatagttgtatgtatg

SEQ ID NO: 223567 - DNA, 23 bp, Mus musculus
gagagagagagagagactggggg

SEQ ID NO: 223568 - DNA, 23 bp, Mus musculus
agctgactttagactctcagttc

SEQ ID NO: 223569 - DNA, 21 bp, Mus musculus
tgtatgtatgtgtgtatgtat

SEQ ID NO: 223570 - DNA, 22 bp, Mus musculus
aggagactcactctgtccctga

SEQ ID NO: 223571 - DNA, 23 bp, Mus musculus
ggtaaacatgacacacacacaga

SEQ ID NO: 223572 - DNA, 23 bp, Mus musculus
tgaaatgtcactgtttggtgtct

SEQ ID NO: 223573 - DNA, 21 bp, Mus musculus
tgacactgggacccttggagg

SEQ ID NO: 223574 - DNA, 23 bp, Mus musculus
gtggctgagaaagagaaagttgt

SEQ ID NO: 223575 - DNA, 23 bp, Mus musculus
acagtcagagctcttgagcttct

SEQ ID NO: 223576 - DNA, 22 bp, Mus musculus
tgttttgtgaccaattatatgg

SEQ ID NO: 223577 - DNA, 23 bp, Mus musculus
tctgtctgcctgtctgtctgtct

SEQ ID NO: 223578 - DNA, 22 bp, Mus musculus
aagctggaggtggagcagtcag

SEQ ID NO: 223579 - DNA, 21 bp, Mus musculus
tctctctgtctctgggagagt

SEQ ID NO: 223580 - DNA, 23 bp, Mus musculus
gtttatggcactccaagatagct

SEQ ID NO: 223581 - DNA, 18 bp, Mus musculus
gtagagccagagagaata

SEQ ID NO: 223582 - DNA, 21 bp, Mus musculus
ttctctctgtctctgggagag

SEQ ID NO: 223583 - DNA, 18 bp, Mus musculus
attgtcatttgagtgctc

SEQ ID NO: 223584 - DNA, 22 bp, Mus musculus
ttttagagatttgttgaataca

SEQ ID NO: 223585 - DNA, 19 bp, Mus musculus
tccggcttcaattcaggga

SEQ ID NO: 223586 - DNA, 23 bp, Mus musculus
gctcactggctcactggctcact

SEQ ID NO: 223587 - DNA, 23 bp, Mus musculus
agtactgagagtggagatagagg

SEQ ID NO: 223588 - DNA, 20 bp, Mus musculus
tctctgcttgacactctgtc

SEQ ID NO: 223589 - DNA, 23 bp, Mus musculus
ttgaatgtatttcataatgttct

SEQ ID NO: 223590 - DNA, 21 bp, Mus musculus
agtgggtgcttgaggccattg

SEQ ID NO: 223591 - DNA, 20 bp, Mus musculus
tgaagctgagtgtgaaggtg

SEQ ID NO: 223592 - DNA, 22 bp, Mus musculus
tcagtcagagagtaagttcata

SEQ ID NO: 223593 - DNA, 22 bp, Mus musculus
tgtgacagtggctgtgactatg

SEQ ID NO: 223594 - DNA, 22 bp, Mus musculus
acaggggctgtgactgtggctg

SEQ ID NO: 223595 - DNA, 23 bp, Mus musculus
tgactgtggctgtgattatgaca

SEQ ID NO: 223596 - DNA, 22 bp, Mus musculus
tgtcactgtcactcacctgtga

SEQ ID NO: 223597 - DNA, 18 bp, Mus musculus
tgctcttttgggggcctt

SEQ ID NO: 223598 - DNA, 19 bp, Mus musculus
agagagaggtgactgagca

SEQ ID NO: 223599 - DNA, 23 bp, Mus musculus
tgtgactgggttttttgtgagca

SEQ ID NO: 223600 - DNA, 22 bp, Mus musculus
tctctaactcactgactggctg

SEQ ID NO: 223601 - DNA, 23 bp, Mus musculus
tgtgtgtgcatgtacatgtttat

SEQ ID NO: 223602 - DNA, 23 bp, Mus musculus
atgtgagcatgtgcatgagcatg

SEQ ID NO: 223603 - DNA, 23 bp, Mus musculus
aaagttctcttagggagactgag

SEQ ID NO: 223604 - DNA, 23 bp, Mus musculus
taggacttctctgagcctgtctc

SEQ ID NO: 223605 - DNA, 23 bp, Mus musculus
tgtgtgtgtgtctgtgtgtatac

SEQ ID NO: 223606 - DNA, 23 bp, Mus musculus
cagcatctggatatcaatttatg

SEQ ID NO: 223607 - DNA, 23 bp, Mus musculus
tcattgcttatcatgctgatata

SEQ ID NO: 223608 - DNA, 21 bp, Mus musculus
ctgctgtggaagtatgtcttt

SEQ ID NO: 223609 - DNA, 21 bp, Mus musculus
tagtccagcccttatgtatgt

SEQ ID NO: 223610 - DNA, 21 bp, Mus musculus
gaagcagctgagtctcaggtc

SEQ ID NO: 223611 - DNA, 23 bp, Mus musculus
ctctctgtgtagtgtctggttgt

SEQ ID NO: 223612 - DNA, 22 bp, Mus musculus
tgttttgtgaccaattatatgg

SEQ ID NO: 223613 - DNA, 23 bp, Mus musculus
gatgaagtcattctgtgacctag

SEQ ID NO: 223614 - DNA, 23 bp, Mus musculus
tgtgtctgtgtatctgtgtgtct

SEQ ID NO: 223615 - DNA, 23 bp, Mus musculus
ttcctgactgcagagagtgtgac

SEQ ID NO: 223616 - DNA, 18 bp, Mus musculus
tttggttgatattcatgg

SEQ ID NO: 223617 - DNA, 20 bp, Mus musculus
agaccggcttatttctgtgt

SEQ ID NO: 223618 - DNA, 23 bp, Mus musculus
tgtgtgtgtgcacatgtatgcct

SEQ ID NO: 223619 - DNA, 22 bp, Mus musculus
tgttttgtgaccaattatatgg

SEQ ID NO: 223620 - DNA, 18 bp, Mus musculus
ttaacaagataccagaat

SEQ ID NO: 223621 - DNA, 20 bp, Mus musculus
atgctagaagatactgaagt

SEQ ID NO: 223622 - DNA, 23 bp, Mus musculus
acagacagcacatctctcacatg

SEQ ID NO: 223623 - DNA, 23 bp, Mus musculus
tctgtctgtctgtctgtctgtct

SEQ ID NO: 223624 - DNA, 23 bp, Mus musculus
atcggtctgtctgtcttacttat

SEQ ID NO: 223625 - DNA, 20 bp, Mus musculus
tttgtgtgtgtgatgtaggt

SEQ ID NO: 223626 - DNA, 23 bp, Mus musculus
aagcttgttaagtaaatgtggta

SEQ ID NO: 223627 - DNA, 20 bp, Mus musculus
ctgtctgtctgtctgtctat

SEQ ID NO: 223628 - DNA, 22 bp, Mus musculus
tgttttgtgaccaattatatgg

SEQ ID NO: 223629 - DNA, 23 bp, Mus musculus
agctgtgtcaccagggaactgag

SEQ ID NO: 223630 - DNA, 23 bp, Mus musculus
tagtccatggtgatctgatagga

SEQ ID NO: 223631 - DNA, 23 bp, Mus musculus
aaatctcagaggttgttgttatt

SEQ ID NO: 223632 - DNA, 22 bp, Mus musculus
aaagtgcttggtcatagtttgg

SEQ ID NO: 223633 - DNA, 23 bp, Mus musculus
tagtccatggtgatctgatagga

SEQ ID NO: 223634 - DNA, 23 bp, Mus musculus
tacagttatatagttgtatagtt

SEQ ID NO: 223635 - DNA, 23 bp, Mus musculus
aactcagacccagaaaaatgcat

SEQ ID NO: 223636 - DNA, 23 bp, Mus musculus
gtatgtatatatgtatgtataca

SEQ ID NO: 223637 - DNA, 20 bp, Mus musculus
tgtgtgtgtgtgtgtgtgtg

SEQ ID NO: 223638 - DNA, 22 bp, Mus musculus
agaccatttgcttggaaaactg

SEQ ID NO: 223639 - DNA, 23 bp, Mus musculus
ccagggactctgtctgtctggat

SEQ ID NO: 223640 - DNA, 19 bp, Mus musculus
tgtccaagacttgtgattt

SEQ ID NO: 223641 - DNA, 18 bp, Mus musculus
taaagtcaggtggcatct

SEQ ID NO: 223642 - DNA, 20 bp, Mus musculus
ttagtggacaggaaatgttg

SEQ ID NO: 223643 - DNA, 21 bp, Mus musculus
tttactgattatgtaattgtg

SEQ ID NO: 223644 - DNA, 23 bp, Mus musculus
atgtctttggataggattgtgta

SEQ ID NO: 223645 - DNA, 23 bp, Mus musculus
tgatttttaaaattgctgtttga

SEQ ID NO: 223646 - DNA, 22 bp, Mus musculus
aagtgtgtcactgtcactgagg

SEQ ID NO: 223647 - DNA, 23 bp, Mus musculus
attatgtatgcatttatatatgt

SEQ ID NO: 223648 - DNA, 23 bp, Mus musculus
tgtatatatgtatgtaattattg

SEQ ID NO: 223649 - DNA, 20 bp, Mus musculus
agcttgctataaatgcagaa

SEQ ID NO: 223650 - DNA, 23 bp, Mus musculus
agccagactcggtggctcactct

SEQ ID NO: 223651 - DNA, 23 bp, Mus musculus
ggcagagtcagtgactgcctcac

SEQ ID NO: 223652 - DNA, 23 bp, Mus musculus
atgtttatctcaatatgtatgtg

SEQ ID NO: 223653 - DNA, 23 bp, Mus musculus
agtgtgtgtgtatatatatacaa

SEQ ID NO: 223654 - DNA, 23 bp, Mus musculus
cagaccaaagcctttcagagtct

SEQ ID NO: 223655 - DNA, 22 bp, Mus musculus
ttagagtgagcagacaggctca

SEQ ID NO: 223656 - DNA, 23 bp, Mus musculus
tgtatgcatatactatatagtat

SEQ ID NO: 223657 - DNA, 23 bp, Mus musculus
atatgtatgcatatgtatacatg

SEQ ID NO: 223658 - DNA, 23 bp, Mus musculus
acagactgtcactctatgacctg

SEQ ID NO: 223659 - DNA, 23 bp, Mus musculus
tataaatgtatgtgtgtgtgtgt

SEQ ID NO: 223660 - DNA, 21 bp, Mus musculus
tgtgtacatatgtatatatgt

SEQ ID NO: 223661 - DNA, 23 bp, Mus musculus
tatatgtgtatacacacacacac

SEQ ID NO: 223662 - DNA, 23 bp, Mus musculus
agtgtgtactgtgtgtgcttgtg

SEQ ID NO: 223663 - DNA, 23 bp, Mus musculus
gtgtctgtgagtctgtctgtgtg

SEQ ID NO: 223664 - DNA, 22 bp, Mus musculus
tatgagattgttaagggttgtc

SEQ ID NO: 223665 - DNA, 23 bp, Mus musculus
tccctggttgtagattgtaggtt

SEQ ID NO: 223666 - DNA, 23 bp, Mus musculus
atatgagtcagcctttcattact

SEQ ID NO: 223667 - DNA, 20 bp, Mus musculus
atatgtgtatatgtatatgt

SEQ ID NO: 223668 - DNA, 19 bp, Mus musculus
tatatgtatatgtatatgt

SEQ ID NO: 223669 - DNA, 19 bp, Mus musculus
tggtggtttcaactttttg

SEQ ID NO: 223670 - DNA, 23 bp, Mus musculus
tcttgaagtagcttgatttccaa

SEQ ID NO: 223671 - DNA, 23 bp, Mus musculus
catatcagctggttgtatgctgc

SEQ ID NO: 223672 - DNA, 23 bp, Mus musculus
agttgagactgctagtcttccta

SEQ ID NO: 223673 - DNA, 22 bp, Mus musculus
acactgtcactgggtgggtgcc

SEQ ID NO: 223674 - DNA, 23 bp, Mus musculus
tatgttcattatatatttgtgtg

SEQ ID NO: 223675 - DNA, 23 bp, Mus musculus
atatgtatgtatatatgtatgca

SEQ ID NO: 223676 - DNA, 23 bp, Mus musculus
tatgcaaaagaaagatgttagga

SEQ ID NO: 223677 - DNA, 23 bp, Mus musculus
aagagtctgagaatgctgtagtt

SEQ ID NO: 223678 - DNA, 23 bp, Mus musculus
gtctgccactctgactgtttccc

SEQ ID NO: 223679 - DNA, 22 bp, Mus musculus
tgttttgtgaccaattatatgg

SEQ ID NO: 223680 - DNA, 23 bp, Mus musculus
tatatgtcttctttcatatgtca

SEQ ID NO: 223681 - DNA, 22 bp, Mus musculus
atgtatatgaaagaagtatagt

SEQ ID NO: 223682 - DNA, 23 bp, Mus musculus
taggtgacaggaatatttcacca

SEQ ID NO: 223683 - DNA, 23 bp, Mus musculus
acagtgatgtgtagttcctgagt

SEQ ID NO: 223684 - DNA, 23 bp, Mus musculus
cagactgtatatgtatgtgtatg

SEQ ID NO: 223685 - DNA, 23 bp, Mus musculus
ttatgtgtatatgtatatatgtg

SEQ ID NO: 223686 - DNA, 22 bp, Mus musculus
aaacttctttggagtcatgtct

SEQ ID NO: 223687 - DNA, 22 bp, Mus musculus
ttacacacttagtcactctgtg

SEQ ID NO: 223688 - DNA, 19 bp, Mus musculus
gtgagatcagagagagatg

SEQ ID NO: 223689 - DNA, 23 bp, Mus musculus
ttctctctagagagtggtctttt

SEQ ID NO: 223690 - DNA, 23 bp, Mus musculus
taatgtccatcagtttgttgttt

SEQ ID NO: 223691 - DNA, 22 bp, Mus musculus
tgttttgtgaccaattatatgg

SEQ ID NO: 223692 - DNA, 23 bp, Mus musculus
aagtagtggtagtagattctttt

SEQ ID NO: 223693 - DNA, 21 bp, Mus musculus
tttgaggatgttaacatctgt

SEQ ID NO: 223694 - DNA, 21 bp, Mus musculus
agataacatcttcatagcata

SEQ ID NO: 223695 - DNA, 23 bp, Mus musculus
aagaggtgtgaataagatgaaag

SEQ ID NO: 223696 - DNA, 23 bp, Mus musculus
attttacatctactacagcaata

SEQ ID NO: 223697 - DNA, 22 bp, Mus musculus
tgagatgatgctgagtggatca

SEQ ID NO: 223698 - DNA, 21 bp, Mus musculus
gtgtctcctaatgttgtcata

SEQ ID NO: 223699 - DNA, 22 bp, Mus musculus
agttaaatagtttgcaagtatt

SEQ ID NO: 223700 - DNA, 20 bp, Mus musculus
tccttcactctgaatctaca

SEQ ID NO: 223701 - DNA, 23 bp, Mus musculus
tctgtacttgttctactgcagga

SEQ ID NO: 223702 - DNA, 20 bp, Mus musculus
tctggagtattctgagtttc

SEQ ID NO: 223703 - DNA, 23 bp, Mus musculus
agagaagactgttagctcaacgt

SEQ ID NO: 223704 - DNA, 19 bp, Mus musculus
agagtctcaggagggtatt

SEQ ID NO: 223705 - DNA, 22 bp, Mus musculus
accaagtgtgtatgctggcaca

SEQ ID NO: 223706 - DNA, 22 bp, Mus musculus
tctctttctatgcttgtgtcta

SEQ ID NO: 223707 - DNA, 23 bp, Mus musculus
tacatgcacgcgtgcatgaatgt

SEQ ID NO: 223708 - DNA, 22 bp, Mus musculus
agggtgtgattaggagttctgc

SEQ ID NO: 223709 - DNA, 23 bp, Mus musculus
ttgcatgtggttctcttgtcaga

SEQ ID NO: 223710 - DNA, 23 bp, Mus musculus
aggactgtcagctatccttctca

SEQ ID NO: 223711 - DNA, 23 bp, Mus musculus
ttatgtgtgcatgtgcatgtgaa

SEQ ID NO: 223712 - DNA, 19 bp, Mus musculus
tgtgtctctgtgtatttgt

SEQ ID NO: 223713 - DNA, 22 bp, Mus musculus
atgtatgaatgaatgtgtgtga

SEQ ID NO: 223714 - DNA, 22 bp, Mus musculus
tatgtgtaatgttacttgtgtg

SEQ ID NO: 223715 - DNA, 21 bp, Mus musculus
ctctctgaaactctgtctgtc

SEQ ID NO: 223716 - DNA, 22 bp, Mus musculus
tgtgtgtgaagagcttggctta

SEQ ID NO: 223717 - DNA, 21 bp, Mus musculus
atgtgtgtgtgtatatgtata

SEQ ID NO: 223718 - DNA, 21 bp, Mus musculus
acaacttccacttttccaggt

SEQ ID NO: 223719 - DNA, 23 bp, Mus musculus
agagattagtgtgtttgatgatg

SEQ ID NO: 223720 - DNA, 23 bp, Mus musculus
ggatgaatagaaatgagtatgga

SEQ ID NO: 223721 - DNA, 22 bp, Mus musculus
tggaaagcaaagaagattcgag

SEQ ID NO: 223722 - DNA, 21 bp, Mus musculus
aatgctacactacaaatgtgt

SEQ ID NO: 223723 - DNA, 22 bp, Mus musculus
tgttttgtgaccaattatatgg

SEQ ID NO: 223724 - DNA, 22 bp, Mus musculus
atatgtgtgtgtatatgtgcgt

SEQ ID NO: 223725 - DNA, 23 bp, Mus musculus
ttccctttgtcatcctatgcctg

SEQ ID NO: 223726 - DNA, 23 bp, Mus musculus
agagacaagactcagtgctaaca

SEQ ID NO: 223727 - DNA, 20 bp, Mus musculus
ttccagcatgagatgtggct

SEQ ID NO: 223728 - DNA, 23 bp, Mus musculus
ctgtagtgagataatagagagct

SEQ ID NO: 223729 - DNA, 22 bp, Mus musculus
ttatggtagattttcagctctt

SEQ ID NO: 223730 - DNA, 19 bp, Mus musculus
ttatttaatacccttagga

SEQ ID NO: 223731 - DNA, 23 bp, Mus musculus
tacattgaagtctgtgccagatg

SEQ ID NO: 223732 - DNA, 23 bp, Mus musculus
tacacacagatatgcatatatgt

SEQ ID NO: 223733 - DNA, 20 bp, Mus musculus
tacatatatatactgtatac

SEQ ID NO: 223734 - DNA, 19 bp, Mus musculus
tgactcacagagaaagcag

SEQ ID NO: 223735 - DNA, 23 bp, Mus musculus
gtctctctctctcatccttgagt

SEQ ID NO: 223736 - DNA, 23 bp, Mus musculus
ggcagatagtctgtgagttcaag

SEQ ID NO: 223737 - DNA, 23 bp, Mus musculus
acatagtaacactctgtctcact

SEQ ID NO: 223738 - DNA, 23 bp, Mus musculus
gggctgtgtgtctgtctgtgagc

SEQ ID NO: 223739 - DNA, 19 bp, Mus musculus
taaatcaacaggaagaaga

SEQ ID NO: 223740 - DNA, 23 bp, Mus musculus
ttgaggttcttccttgattacta

SEQ ID NO: 223741 - DNA, 23 bp, Mus musculus
aagtcaggtatcttgctggagag

SEQ ID NO: 223742 - DNA, 23 bp, Mus musculus
ctctctctgtgtgtgtctgagtg

SEQ ID NO: 223743 - DNA, 23 bp, Mus musculus
ttcacctgacattttcttgccaa

SEQ ID NO: 223744 - DNA, 22 bp, Mus musculus
atggctcagtggttaagagcat

SEQ ID NO: 223745 - DNA, 23 bp, Mus musculus
actaaacttgcaagtccctactt

SEQ ID NO: 223746 - DNA, 23 bp, Mus musculus
caactctgactatagcgtttctc

SEQ ID NO: 223747 - DNA, 22 bp, Mus musculus
gtatctggagtagctactcaac

SEQ ID NO: 223748 - DNA, 22 bp, Mus musculus
tgttttgtgaccaattatatgg

SEQ ID NO: 223749 - DNA, 23 bp, Mus musculus
ctgtctgtctttctgtctgtgtg

SEQ ID NO: 223750 - DNA, 21 bp, Mus musculus
gacaagttgaagaaggaccat

SEQ ID NO: 223751 - DNA, 22 bp, Mus musculus
ctcaggcgctctctctctctct

SEQ ID NO: 223752 - DNA, 20 bp, Mus musculus
ctgtgaaagcgctttgtgct

SEQ ID NO: 223753 - DNA, 22 bp, Mus musculus
tgttttgtgaccaattatatgg

SEQ ID NO: 223754 - DNA, 23 bp, Mus musculus
tctgtgactgtcatctttgtgag

SEQ ID NO: 223755 - DNA, 21 bp, Mus musculus
actctgtagagtgtctcctca

SEQ ID NO: 223756 - DNA, 23 bp, Mus musculus
agacgacattctttcagcttggt

SEQ ID NO: 223757 - DNA, 23 bp, Mus musculus
tatgtatatgtatgtatgtgtga

SEQ ID NO: 223758 - DNA, 23 bp, Mus musculus
tactgactggctgtctgtctcta

SEQ ID NO: 223759 - DNA, 23 bp, Mus musculus
aaagtgaggaatgtttgaggaca

SEQ ID NO: 223760 - DNA, 23 bp, Mus musculus
atctgtagacattcgttcttgat

SEQ ID NO: 223761 - DNA, 22 bp, Mus musculus
aaaatggttcttcattatggaa

SEQ ID NO: 223762 - DNA, 22 bp, Mus musculus
atatatgtatatgtatatgtgt

SEQ ID NO: 223763 - DNA, 23 bp, Mus musculus
tatgtgtgtgtgtgtatgtatat

SEQ ID NO: 223764 - DNA, 23 bp, Mus musculus
gtcacagacagtcactttagaga

SEQ ID NO: 223765 - DNA, 23 bp, Mus musculus
acagactgtctcaacttgccagc

SEQ ID NO: 223766 - DNA, 21 bp, Mus musculus
tgagagcactgactgctcttc

SEQ ID NO: 223767 - DNA, 23 bp, Mus musculus
tttagagtgctacagaaatgtca

SEQ ID NO: 223768 - DNA, 23 bp, Mus musculus
cttgtctctctgtctcactccca

SEQ ID NO: 223769 - DNA, 23 bp, Mus musculus
cagctcagtgagtgaaatgtttg

SEQ ID NO: 223770 - DNA, 22 bp, Mus musculus
gcactgactgctcttccagagg

SEQ ID NO: 223771 - DNA, 21 bp, Mus musculus
atccgattttgttttgtgttt

SEQ ID NO: 223772 - DNA, 23 bp, Mus musculus
gacagacagacagacaggggtca

SEQ ID NO: 223773 - DNA, 23 bp, Mus musculus
tctcctgagttctagctgtgctg

SEQ ID NO: 223774 - DNA, 19 bp, Mus musculus
gatctgagactgaactgcc

SEQ ID NO: 223775 - DNA, 22 bp, Mus musculus
tacagtactgtgatagctgaag

SEQ ID NO: 223776 - DNA, 20 bp, Mus musculus
gtatgcatgcatgcatttgt

SEQ ID NO: 223777 - DNA, 23 bp, Mus musculus
aatgcatatatatacacatacac

SEQ ID NO: 223778 - DNA, 23 bp, Mus musculus
tgtgtgcatgtacatgtgtgtgt

SEQ ID NO: 223779 - DNA, 23 bp, Mus musculus
ctctgagcactctctgtctgacc

SEQ ID NO: 223780 - DNA, 23 bp, Mus musculus
tctgtagatcagtaagtggtgcc

SEQ ID NO: 223781 - DNA, 23 bp, Mus musculus
tttgaccttgtatcagtcacgga

SEQ ID NO: 223782 - DNA, 23 bp, Mus musculus
tgtgtcaccagggaactgagagg

SEQ ID NO: 223783 - DNA, 20 bp, Mus musculus
tcacagaactgagtgacttg

SEQ ID NO: 223784 - DNA, 21 bp, Mus musculus
acagtctctgtgtgtctctgt

SEQ ID NO: 223785 - DNA, 23 bp, Mus musculus
ctgtttctgtctctttaagcatt

SEQ ID NO: 223786 - DNA, 23 bp, Mus musculus
acatcagcatatgtttatctttc

SEQ ID NO: 223787 - DNA, 21 bp, Mus musculus
agtcaggctgactggctcaca

SEQ ID NO: 223788 - DNA, 18 bp, Mus musculus
ttaggtcctctgcaagag

SEQ ID NO: 223789 - DNA, 22 bp, Mus musculus
tctatctgtgtatgtcattcac

SEQ ID NO: 223790 - DNA, 22 bp, Mus musculus
aatgtgtgttgacagtgagcac

SEQ ID NO: 223791 - DNA, 23 bp, Mus musculus
tgcccgtctctctgtgtgtgtgt

SEQ ID NO: 223792 - DNA, 23 bp, Mus musculus
tcatctactctgtgtgtgtgtgt

SEQ ID NO: 223793 - DNA, 21 bp, Mus musculus
tcagatcagtgttagaagagc

SEQ ID NO: 223794 - DNA, 23 bp, Mus musculus
acatttatcatcctgtggcaggg

SEQ ID NO: 223795 - DNA, 21 bp, Mus musculus
ttaagagcactgactgctctt

SEQ ID NO: 223796 - DNA, 23 bp, Mus musculus
tgtgtgtgtgtgtgtgcatgcgc

SEQ ID NO: 223797 - DNA, 18 bp, Mus musculus
tttgcatgagcatgtgca

SEQ ID NO: 223798 - DNA, 23 bp, Mus musculus
tttcagctttaacagggcattgt

SEQ ID NO: 223799 - DNA, 23 bp, Mus musculus
tgtgagatgtgtctgaggtcaag

SEQ ID NO: 223800 - DNA, 21 bp, Mus musculus
ttttgaaccaggtatggtggc

SEQ ID NO: 223801 - DNA, 23 bp, Mus musculus
tatgtatatatgtgtatgtgtat

SEQ ID NO: 223802 - DNA, 23 bp, Mus musculus
tggatgtgcatacatatatatgt

SEQ ID NO: 223803 - DNA, 21 bp, Mus musculus
tgtgtatgtatataaatatgt

SEQ ID NO: 223804 - DNA, 23 bp, Mus musculus
caaactgacaccatgtgtacagc

SEQ ID NO: 223805 - DNA, 19 bp, Mus musculus
tgtgtatgtatgtgtgtgt

SEQ ID NO: 223806 - DNA, 18 bp, Mus musculus
acacacacacaagcatat

SEQ ID NO: 223807 - DNA, 23 bp, Mus musculus
agttctcagtgccagtgtccgtg

SEQ ID NO: 223808 - DNA, 23 bp, Mus musculus
tgtgtgcgtctgtgtgtgcctgt

SEQ ID NO: 223809 - DNA, 19 bp, Mus musculus
agcatgaattccagtttct

SEQ ID NO: 223810 - DNA, 19 bp, Mus musculus
ttgctattaaattatctca

SEQ ID NO: 223811 - DNA, 22 bp, Mus musculus
actcagagagcaaaggcaattg

SEQ ID NO: 223812 - DNA, 23 bp, Mus musculus
tgtcactgtgtttgtgcgcaaag

SEQ ID NO: 223813 - DNA, 19 bp, Mus musculus
tgtccatgtgcatacatgt

SEQ ID NO: 223814 - DNA, 23 bp, Mus musculus
agtctcagaccttttcctttcca

SEQ ID NO: 223815 - DNA, 23 bp, Mus musculus
aatttcagcatcaggatctgtga

SEQ ID NO: 223816 - DNA, 23 bp, Mus musculus
tgcctgtatatgtatatctgtgt

SEQ ID NO: 223817 - DNA, 23 bp, Mus musculus
agtcagccagacttgctgcgagt

SEQ ID NO: 223818 - DNA, 18 bp, Mus musculus
taatgcagatacactcac

SEQ ID NO: 223819 - DNA, 18 bp, Mus musculus
actctctcactgaagtga

SEQ ID NO: 223820 - DNA, 23 bp, Mus musculus
tctatgcatctatatatgtatct

SEQ ID NO: 223821 - DNA, 23 bp, Mus musculus
gaatactgactgctcttccagag

SEQ ID NO: 223822 - DNA, 23 bp, Mus musculus
tatgagcatttgcatgtgtgtgt

SEQ ID NO: 223823 - DNA, 22 bp, Mus musculus
tgttttgtgaccaattatatgg

SEQ ID NO: 223824 - DNA, 23 bp, Mus musculus
aggaatgtattgaacattgctat

SEQ ID NO: 223825 - DNA, 21 bp, Mus musculus
agttttccttgagcttcaggt

SEQ ID NO: 223826 - DNA, 23 bp, Mus musculus
taactctcactgactgtcttctc

SEQ ID NO: 223827 - DNA, 20 bp, Mus musculus
tcagtcagtctgtctgtctc

SEQ ID NO: 223828 - DNA, 23 bp, Mus musculus
tccctgaagaaagtgagcagttg

SEQ ID NO: 223829 - DNA, 18 bp, Mus musculus
tatatctagaaatgccat

SEQ ID NO: 223830 - DNA, 22 bp, Mus musculus
tcacacacactaactcacagtt

SEQ ID NO: 223831 - DNA, 23 bp, Mus musculus
tgcctgtgtctctgcctctgtgg

SEQ ID NO: 223832 - DNA, 22 bp, Mus musculus
ctttgagtgtatacccaggact

SEQ ID NO: 223833 - DNA, 22 bp, Mus musculus
tgtgtgtgtgtgttatacatgt

SEQ ID NO: 223834 - DNA, 23 bp, Mus musculus
tatgcatatatatgtgtgtgtgt

SEQ ID NO: 223835 - DNA, 23 bp, Mus musculus
tgtctccgtcagtctctcacacc

SEQ ID NO: 223836 - DNA, 23 bp, Mus musculus
ggtaaggtaagaagtttgtagtt

SEQ ID NO: 223837 - DNA, 22 bp, Mus musculus
tgagtgcttgctgatagcttct

SEQ ID NO: 223838 - DNA, 22 bp, Mus musculus
tgtctcagtgaagggaacactt

SEQ ID NO: 223839 - DNA, 23 bp, Mus musculus
acactgacagaagagggtgacct

SEQ ID NO: 223840 - DNA, 23 bp, Mus musculus
tgagtctctttgtctctggcacc

SEQ ID NO: 223841 - DNA, 20 bp, Mus musculus
tcagtgtctctttctcaaat

SEQ ID NO: 223842 - DNA, 22 bp, Mus musculus
tgtctgggtcaccatgaactct

SEQ ID NO: 223843 - DNA, 23 bp, Mus musculus
actctctcacagactgaagaaag

SEQ ID NO: 223844 - DNA, 22 bp, Mus musculus
atacatatgtgtacacatacat

SEQ ID NO: 223845 - DNA, 22 bp, Mus musculus
actatatatatgtatatgtatg

SEQ ID NO: 223846 - DNA, 22 bp, Mus musculus
tatatacatatatatagttgat

SEQ ID NO: 223847 - DNA, 23 bp, Mus musculus
tctatctctctgcttagtgtctg

SEQ ID NO: 223848 - DNA, 23 bp, Mus musculus
tgagtctctgtatctgtttccat

SEQ ID NO: 223849 - DNA, 19 bp, Mus musculus
tagcatctcagagttatgt

SEQ ID NO: 223850 - DNA, 22 bp, Mus musculus
tgttttgtgaccaattatatgg

SEQ ID NO: 223851 - DNA, 20 bp, Mus musculus
tcacagaactgagtgacttg

SEQ ID NO: 223852 - DNA, 23 bp, Mus musculus
tgtctgaatttatgtctgtgcat

SEQ ID NO: 223853 - DNA, 23 bp, Mus musculus
ctggagagatagattgctcaatg

SEQ ID NO: 223854 - DNA, 23 bp, Mus musculus
caggggctgaagagatggctcag

SEQ ID NO: 223855 - DNA, 23 bp, Mus musculus
ttgtgtctctctctgtggccttt

SEQ ID NO: 223856 - DNA, 23 bp, Mus musculus
tgtatgtgtgtgtatatgtatat

SEQ ID NO: 223857 - DNA, 19 bp, Mus musculus
aggtactcagaaagacaga

SEQ ID NO: 223858 - DNA, 19 bp, Mus musculus
tgtatgtgtgcatgtgtgt

SEQ ID NO: 223859 - DNA, 23 bp, Mus musculus
ccactctctgtgtgtttgtcggt

SEQ ID NO: 223860 - DNA, 18 bp, Mus musculus
tggtactttgagtgtggg

SEQ ID NO: 223861 - DNA, 23 bp, Mus musculus
gcctgcctgcctgcctgcctgcc

SEQ ID NO: 223862 - DNA, 23 bp, Mus musculus
gaacagactggttctcttctgga

SEQ ID NO: 223863 - DNA, 23 bp, Mus musculus
acaaaggccacactcagtcacac

SEQ ID NO: 223864 - DNA, 22 bp, Mus musculus
gtcactgtggcttgattgctgg

SEQ ID NO: 223865 - DNA, 21 bp, Mus musculus
agtgaggacttcaggagttag

SEQ ID NO: 223866 - DNA, 20 bp, Mus musculus
tcagagtacagacagaccag

SEQ ID NO: 223867 - DNA, 23 bp, Mus musculus
tgtatgtgtgtgtgtgtatacat

SEQ ID NO: 223868 - DNA, 23 bp, Mus musculus
gtctagacacactgtcagcattt

SEQ ID NO: 223869 - DNA, 23 bp, Mus musculus
gtcagaagagagagaggtgatgc

SEQ ID NO: 223870 - DNA, 21 bp, Mus musculus
ttcacagttctttgtagacac

SEQ ID NO: 223871 - DNA, 21 bp, Mus musculus
cttggctctagatactgtata

SEQ ID NO: 223872 - DNA, 23 bp, Mus musculus
tgcctgcctgcctgcctgtgtgt

SEQ ID NO: 223873 - DNA, 23 bp, Mus musculus
atctgtgtgtgcatgtgcatctg

SEQ ID NO: 223874 - DNA, 18 bp, Mus musculus
agactgaagctactgtgc

SEQ ID NO: 223875 - DNA, 21 bp, Mus musculus
tggctcgctcgctcactccca

SEQ ID NO: 223876 - DNA, 23 bp, Mus musculus
ttgtcttgcctctccaaccttgt

SEQ ID NO: 223877 - DNA, 20 bp, Mus musculus
aactctcaggagctggagag

SEQ ID NO: 223878 - DNA, 18 bp, Mus musculus
gaatgtatgtatgtgtgt

SEQ ID NO: 223879 - DNA, 18 bp, Mus musculus
gtatgcaattcctgtctt

SEQ ID NO: 223880 - DNA, 18 bp, Mus musculus
cagcaactacatggcagt

SEQ ID NO: 223881 - DNA, 22 bp, Mus musculus
tgtctgacaatctgtctgtgga

SEQ ID NO: 223882 - DNA, 23 bp, Mus musculus
tcagtgtatatgtatatgactgt

SEQ ID NO: 223883 - DNA, 23 bp, Mus musculus
ttggtcactgaagagagaaagca

SEQ ID NO: 223884 - DNA, 23 bp, Mus musculus
gtgtcagcaagtgcttctcagag

SEQ ID NO: 223885 - DNA, 22 bp, Mus musculus
gagtgcctgtgtgcctcactgt

SEQ ID NO: 223886 - DNA, 21 bp, Mus musculus
tctcactctcactctcactgt

SEQ ID NO: 223887 - DNA, 22 bp, Mus musculus
tcagcaggtaaagtaaggcagt

SEQ ID NO: 223888 - DNA, 23 bp, Mus musculus
cgctctgcaactccatctgtatg

SEQ ID NO: 223889 - DNA, 23 bp, Mus musculus
gaaccagactcactctcagcctg

SEQ ID NO: 223890 - DNA, 19 bp, Mus musculus
acatctctgaggaaatgac

SEQ ID NO: 223891 - DNA, 23 bp, Mus musculus
gaacactgagtgtagatgtagcc

SEQ ID NO: 223892 - DNA, 18 bp, Mus musculus
tcacacctgtctgactct

SEQ ID NO: 223893 - DNA, 22 bp, Mus musculus
gaggaggtgtgtcactggaggt

SEQ ID NO: 223894 - DNA, 23 bp, Mus musculus
atgcccagtgtcactctctctct

SEQ ID NO: 223895 - DNA, 19 bp, Mus musculus
acagtagacagggaacagt

SEQ ID NO: 223896 - DNA, 20 bp, Mus musculus
ttttatctttcagttgttca

SEQ ID NO: 223897 - DNA, 23 bp, Mus musculus
atgtatgttcaactgaaaggatg

SEQ ID NO: 223898 - DNA, 22 bp, Mus musculus
atgtatatatacatatgtgtgt

SEQ ID NO: 223899 - DNA, 19 bp, Mus musculus
tatgcatgtatgtgtgtat

SEQ ID NO: 223900 - DNA, 19 bp, Mus musculus
tgacagagagagacactga

SEQ ID NO: 223901 - DNA, 18 bp, Mus musculus
tatacactagggaacagt

SEQ ID NO: 223902 - DNA, 23 bp, Mus musculus
tgtcagtagtgtgtaagcacttc

SEQ ID NO: 223903 - DNA, 21 bp, Mus musculus
tcagtagtgtgtaagtgcttt

SEQ ID NO: 223904 - DNA, 20 bp, Mus musculus
tgtcagagagaaggctgccg

SEQ ID NO: 223905 - DNA, 23 bp, Mus musculus
cactcccagtctgtcaatgtcgt

SEQ ID NO: 223906 - DNA, 23 bp, Mus musculus
atctgtctgtctgtctgtctgtc

SEQ ID NO: 223907 - DNA, 19 bp, Mus musculus
gagagaaggctgagaggac

SEQ ID NO: 223908 - DNA, 18 bp, Mus musculus
aggagtgttgtgtgctgc

SEQ ID NO: 223909 - DNA, 23 bp, Mus musculus
gaaggacgtttaaatgctgctgg

SEQ ID NO: 223910 - DNA, 23 bp, Mus musculus
tgtgtatatatgtatgtgtgtat

SEQ ID NO: 223911 - DNA, 20 bp, Mus musculus
actgtgtgactgtgacaggc

SEQ ID NO: 223912 - DNA, 21 bp, Mus musculus
tgtctctgtatctctctcatt

SEQ ID NO: 223913 - DNA, 18 bp, Mus musculus
tgtgtgtgtgtgtataca

SEQ ID NO: 223914 - DNA, 23 bp, Mus musculus
tatatgtatgtatatatgtgtat

SEQ ID NO: 223915 - DNA, 20 bp, Mus musculus
tctctctgtctctgggagag

SEQ ID NO: 223916 - DNA, 23 bp, Mus musculus
gccgctcactcagtccctctcaa

SEQ ID NO: 223917 - DNA, 21 bp, Mus musculus
tgtgagactcctaacagtggg

SEQ ID NO: 223918 - DNA, 23 bp, Mus musculus
gttttgaaagaactcagtgggga

SEQ ID NO: 223919 - DNA, 23 bp, Mus musculus
gcactctctctccctgtctactc

SEQ ID NO: 223920 - DNA, 20 bp, Mus musculus
aatctcagcttttggaggca

SEQ ID NO: 223921 - DNA, 21 bp, Mus musculus
atgtctgtgagttcaagatga

SEQ ID NO: 223922 - DNA, 20 bp, Mus musculus
agagagtgagctgagaccgc

SEQ ID NO: 223923 - DNA, 23 bp, Mus musculus
tctgtagtctgtagactggaatg

SEQ ID NO: 223924 - DNA, 23 bp, Mus musculus
tctgagtctcaacagggttgaca

SEQ ID NO: 223925 - DNA, 20 bp, Mus musculus
acagagagccagtcccacag

SEQ ID NO: 223926 - DNA, 23 bp, Mus musculus
aatgaagttctctccgactctgt

SEQ ID NO: 223927 - DNA, 22 bp, Mus musculus
tgttttgtgaccaattatatgg

SEQ ID NO: 223928 - DNA, 23 bp, Mus musculus
tcatgtgtgttgtactcatgtgt

SEQ ID NO: 223929 - DNA, 22 bp, Mus musculus
tatgtagatcttgtggaactaa

SEQ ID NO: 223930 - DNA, 23 bp, Mus musculus
catctccactctgattgctgttc

SEQ ID NO: 223931 - DNA, 23 bp, Mus musculus
tgtcacactgacagtgtctggac

SEQ ID NO: 223932 - DNA, 19 bp, Mus musculus
tgagattgcagtaagtggc

SEQ ID NO: 223933 - DNA, 22 bp, Mus musculus
ctgctcacactcactcaggcag

SEQ ID NO: 223934 - DNA, 22 bp, Mus musculus
actcctctgtcactctctgcga

SEQ ID NO: 223935 - DNA, 23 bp, Mus musculus
tcgctcgctcgctcgctcactcg

SEQ ID NO: 223936 - DNA, 23 bp, Mus musculus
gtctgtctatctgtcatcaggat

SEQ ID NO: 223937 - DNA, 20 bp, Mus musculus
tgtgtgtgtgtgtctctctc

SEQ ID NO: 223938 - DNA, 23 bp, Mus musculus
ccagacatctcagatctcaccac

SEQ ID NO: 223939 - DNA, 23 bp, Mus musculus
agagcactgagactgctcttcca

SEQ ID NO: 223940 - DNA, 23 bp, Mus musculus
ctatcacttgagtttttgatctt

SEQ ID NO: 223941 - DNA, 23 bp, Mus musculus
ggctgtctgtctgtctgttttat

SEQ ID NO: 223942 - DNA, 23 bp, Mus musculus
cgctgtctctctctgtctcttac

SEQ ID NO: 223943 - DNA, 22 bp, Mus musculus
ttctctttagctcccatttggt

SEQ ID NO: 223944 - DNA, 22 bp, Mus musculus
acatgcatactttgatgtgtgt

SEQ ID NO: 223945 - DNA, 23 bp, Mus musculus
cgcactgactgctcttccagagg

SEQ ID NO: 223946 - DNA, 21 bp, Mus musculus
tcagatctatttcaaaagtta

SEQ ID NO: 223947 - DNA, 22 bp, Mus musculus
gtgagtcacactgcctgaccct

SEQ ID NO: 223948 - DNA, 19 bp, Mus musculus
tgtgtgcatgcatgttaag

SEQ ID NO: 223949 - DNA, 23 bp, Mus musculus
ggtgtctgtctgtctgtctgtct

SEQ ID NO: 223950 - DNA, 23 bp, Mus musculus
ccagtcagagtctgtgaaatctc

SEQ ID NO: 223951 - DNA, 18 bp, Mus musculus
tgaggttggcagtagctg

SEQ ID NO: 223952 - DNA, 20 bp, Mus musculus
cagatgtctgtgagctcaag

SEQ ID NO: 223953 - DNA, 22 bp, Mus musculus
ctccgtctctgtgactttcagc

SEQ ID NO: 223954 - DNA, 22 bp, Mus musculus
ctgcctcacactctgtctgtcc

SEQ ID NO: 223955 - DNA, 22 bp, Mus musculus
ctctggctctgtctggggctgt

SEQ ID NO: 223956 - DNA, 23 bp, Mus musculus
gggttgtcagtgtggaaaggtgg

SEQ ID NO: 223957 - DNA, 21 bp, Mus musculus
ttcagccccacataacctcct

SEQ ID NO: 223958 - DNA, 19 bp, Mus musculus
tagaaccatggctttcagt

SEQ ID NO: 223959 - DNA, 19 bp, Mus musculus
tgtgacaaaggtggatcat

SEQ ID NO: 223960 - DNA, 23 bp, Mus musculus
tctagatctactgtgtttcctgt

SEQ ID NO: 223961 - DNA, 23 bp, Mus musculus
tggcattggataacctatcaaga

SEQ ID NO: 223962 - DNA, 23 bp, Mus musculus
actctgggtgtctgtctgtctgt

SEQ ID NO: 223963 - DNA, 23 bp, Mus musculus
tgtgactgactctctgagtctgt

SEQ ID NO: 223964 - DNA, 23 bp, Mus musculus
tcttgaggacaagcaactcagag

SEQ ID NO: 223965 - DNA, 21 bp, Mus musculus
ctgagagcgttccatttgtgt

SEQ ID NO: 223966 - DNA, 23 bp, Mus musculus
tctgtgtgtgcttgtgcatgtgt

SEQ ID NO: 223967 - DNA, 23 bp, Mus musculus
aatctgagttctgatcttctctg

SEQ ID NO: 223968 - DNA, 23 bp, Mus musculus
tgtgtctctctgtgtgtatacac

SEQ ID NO: 223969 - DNA, 23 bp, Mus musculus
tctctgtctcagtcgctgccttg

SEQ ID NO: 223970 - DNA, 21 bp, Mus musculus
tgtctctctcctcatcttctg

SEQ ID NO: 223971 - DNA, 22 bp, Mus musculus
aggatgtctactgtattggttg

SEQ ID NO: 223972 - DNA, 21 bp, Mus musculus
tctgtctgtctgtctgtctgt

SEQ ID NO: 223973 - DNA, 23 bp, Mus musculus
tctgtctgcctgactgtctgtct

SEQ ID NO: 223974 - DNA, 23 bp, Mus musculus
ccaccctgtctttgtctctgtct

SEQ ID NO: 223975 - DNA, 23 bp, Mus musculus
tttcttcttcatctgcttggctc

SEQ ID NO: 223976 - DNA, 23 bp, Mus musculus
acctgtctgtagactgtcagaac

SEQ ID NO: 223977 - DNA, 23 bp, Mus musculus
taatgtacatgaagccctactgt

SEQ ID NO: 223978 - DNA, 23 bp, Mus musculus
gatttgtgttctttgtctatcta

SEQ ID NO: 223979 - DNA, 23 bp, Mus musculus
ctcagttctgtgtgactgttcct

SEQ ID NO: 223980 - DNA, 22 bp, Mus musculus
cttagtccatggtgatctgata

SEQ ID NO: 223981 - DNA, 23 bp, Mus musculus
taattggatatgtttaggtagga

SEQ ID NO: 223982 - DNA, 20 bp, Mus musculus
atacagtgtgataagtggag

SEQ ID NO: 223983 - DNA, 22 bp, Mus musculus
tgttttgtgaccaattatatgg

SEQ ID NO: 223984 - DNA, 23 bp, Mus musculus
tgtctgtatatctatatgtatgt

SEQ ID NO: 223985 - DNA, 21 bp, Mus musculus
atgtgtatgtgcatatgtgtg

SEQ ID NO: 223986 - DNA, 20 bp, Mus musculus
tatatacacacacacataca

SEQ ID NO: 223987 - DNA, 23 bp, Mus musculus
aaacttctacacttatccatgtg

SEQ ID NO: 223988 - DNA, 23 bp, Mus musculus
tgtatatgtatatgtatatgtat

SEQ ID NO: 223989 - DNA, 23 bp, Mus musculus
agtgtgtgccttagtttggttat

SEQ ID NO: 223990 - DNA, 23 bp, Mus musculus
agacagacagagttcttgtggga

SEQ ID NO: 223991 - DNA, 23 bp, Mus musculus
tcggttttgatagctaaggctgt

SEQ ID NO: 223992 - DNA, 22 bp, Mus musculus
tatttgcatttctacctttatc

SEQ ID NO: 223993 - DNA, 23 bp, Mus musculus
aagattttgagcatggcttttgg

SEQ ID NO: 223994 - DNA, 23 bp, Mus musculus
tctctctgtgagtgtctgcatcc

SEQ ID NO: 223995 - DNA, 23 bp, Mus musculus
gtctctgggactgacactttaga

SEQ ID NO: 223996 - DNA, 23 bp, Mus musculus
atgcatataagtatgtatgttct

SEQ ID NO: 223997 - DNA, 23 bp, Mus musculus
tctgtctgtctgtctgtctgtct

SEQ ID NO: 223998 - DNA, 21 bp, Mus musculus
tatctcacacagactctcagc

SEQ ID NO: 223999 - DNA, 20 bp, Mus musculus
tgtatgtatgtatatatgta

SEQ ID NO: 224000 - DNA, 20 bp, Mus musculus
tgtatatatgtatatctgtg

SEQ ID NO: 224001 - DNA, 23 bp, Mus musculus
tgtgtgtatatatatgtgtgcat

SEQ ID NO: 224002 - DNA, 23 bp, Mus musculus
tgagtattgtttagttttcctca

SEQ ID NO: 224003 - DNA, 22 bp, Mus musculus
gtgtgtgtgcatgtgcatgtgt

SEQ ID NO: 224004 - DNA, 23 bp, Mus musculus
atgtgtgtgtgtaaactatgtgt

SEQ ID NO: 224005 - DNA, 23 bp, Mus musculus
taatttcatacacacacacacac

SEQ ID NO: 224006 - DNA, 22 bp, Mus musculus
tatgtgtgtatatgtatatgta

SEQ ID NO: 224007 - DNA, 23 bp, Mus musculus
acatgtatatgtatatgtatatg

SEQ ID NO: 224008 - DNA, 23 bp, Mus musculus
agtgtctgtctctctttgggcat

SEQ ID NO: 224009 - DNA, 23 bp, Mus musculus
acattaaggtatggtaatgttat

SEQ ID NO: 224010 - DNA, 23 bp, Mus musculus
aactagactggttgtttttttgt

SEQ ID NO: 224011 - DNA, 21 bp, Mus musculus
aggttgttcttcacgtcctcg

SEQ ID NO: 224012 - DNA, 22 bp, Mus musculus
agagttgagactgaagactctc

SEQ ID NO: 224013 - DNA, 23 bp, Mus musculus
aagtgaccctctctgtctccttt

SEQ ID NO: 224014 - DNA, 20 bp, Mus musculus
agatgcttcgtctatgtgtg

SEQ ID NO: 224015 - DNA, 21 bp, Mus musculus
atgtatgtgtgcatgtccatg

SEQ ID NO: 224016 - DNA, 18 bp, Mus musculus
tccgtgcaagttcttatt

SEQ ID NO: 224017 - DNA, 20 bp, Mus musculus
tggaagtgtggtttagtgga

SEQ ID NO: 224018 - DNA, 21 bp, Mus musculus
gcctgggtctctcagagtctc

SEQ ID NO: 224019 - DNA, 23 bp, Mus musculus
agggtggctcagactatgccaca

SEQ ID NO: 224020 - DNA, 19 bp, Mus musculus
tcctggcttgtctgctggt

SEQ ID NO: 224021 - DNA, 23 bp, Mus musculus
aaaagtattgctttgtgtggtcg

SEQ ID NO: 224022 - DNA, 23 bp, Mus musculus
gtgtatatgtgcatgtctatgtg

SEQ ID NO: 224023 - DNA, 23 bp, Mus musculus
catgttagtgagcagagagagac

SEQ ID NO: 224024 - DNA, 23 bp, Mus musculus
gtctctctgcacttcctggaggt

SEQ ID NO: 224025 - DNA, 22 bp, Mus musculus
gacagtggctctgtcaggccca

SEQ ID NO: 224026 - DNA, 23 bp, Mus musculus
ccaccacctccctgtcttacctc

SEQ ID NO: 224027 - DNA, 22 bp, Mus musculus
atatcctcttcactctctgtct

SEQ ID NO: 224028 - DNA, 19 bp, Mus musculus
tgtgtctatatgtatatgt

SEQ ID NO: 224029 - DNA, 22 bp, Mus musculus
tgtgcatgtatgtatatatgta

SEQ ID NO: 224030 - DNA, 23 bp, Mus musculus
tatatgtatatgtatatgtatat

SEQ ID NO: 224031 - DNA, 23 bp, Mus musculus
ttttctgtcagatgaatagatgg

SEQ ID NO: 224032 - DNA, 20 bp, Mus musculus
tacatatgtgcacgtatatg

SEQ ID NO: 224033 - DNA, 22 bp, Mus musculus
tgaatgaccatgagtaatgaag

SEQ ID NO: 224034 - DNA, 23 bp, Mus musculus
cacactgagcacactgtgagcac

SEQ ID NO: 224035 - DNA, 20 bp, Mus musculus
gaacacactgagcatactgt

SEQ ID NO: 224036 - DNA, 21 bp, Mus musculus
actgagtacactgtgagcaca

SEQ ID NO: 224037 - DNA, 23 bp, Mus musculus
acactgagcacactgtgagcaca

SEQ ID NO: 224038 - DNA, 21 bp, Mus musculus
gaacacactgagtatactgtg

SEQ ID NO: 224039 - DNA, 19 bp, Mus musculus
actgagtacactgtgagca

SEQ ID NO: 224040 - DNA, 21 bp, Mus musculus
tgtgaacacactgagcacacc

SEQ ID NO: 224041 - DNA, 21 bp, Mus musculus
ctctctgagtcagtctgttgt

SEQ ID NO: 224042 - DNA, 22 bp, Mus musculus
tactgtatgcatgtatatatat

SEQ ID NO: 224043 - DNA, 18 bp, Mus musculus
tatgtgtgtatatatgta

SEQ ID NO: 224044 - DNA, 22 bp, Mus musculus
atgtctctaaagagactgccta

SEQ ID NO: 224045 - DNA, 23 bp, Mus musculus
tagactcctcagtgtgccatctc

SEQ ID NO: 224046 - DNA, 22 bp, Mus musculus
tctgtcgctctcagattgatct

SEQ ID NO: 224047 - DNA, 23 bp, Mus musculus
tgtgagtgcatctacatgtctgt

SEQ ID NO: 224048 - DNA, 23 bp, Mus musculus
tatgtatatgtataggtatatgt

SEQ ID NO: 224049 - DNA, 23 bp, Mus musculus
ggtgggtctgtctgtctgtctgc

SEQ ID NO: 224050 - DNA, 22 bp, Mus musculus
gcatgtatgtatgtatgtatgc

SEQ ID NO: 224051 - DNA, 19 bp, Mus musculus
tgtgcatgcatgtgtgtgt

SEQ ID NO: 224052 - DNA, 23 bp, Mus musculus
ctcactgactgtttctgctaggc

SEQ ID NO: 224053 - DNA, 23 bp, Mus musculus
agggtcacaagtaagtgagctct

SEQ ID NO: 224054 - DNA, 20 bp, Mus musculus
atgcatgtatgtatgtatct

SEQ ID NO: 224055 - DNA, 21 bp, Mus musculus
tctgtgcaactgtgatcctcg

SEQ ID NO: 224056 - DNA, 23 bp, Mus musculus
ctaccacactgagagtcacacac

SEQ ID NO: 224057 - DNA, 23 bp, Mus musculus
atatgtgtatatgtatatgtgtg

SEQ ID NO: 224058 - DNA, 23 bp, Mus musculus
catgtgcctatgtgtgtgtgtga

SEQ ID NO: 224059 - DNA, 23 bp, Mus musculus
gaagcacgtgtacatatgtgtgt

SEQ ID NO: 224060 - DNA, 23 bp, Mus musculus
tctgtctctttctcatcaaggtg

SEQ ID NO: 224061 - DNA, 19 bp, Mus musculus
tgcatgtatatttgtatct

SEQ ID NO: 224062 - DNA, 23 bp, Mus musculus
tatgccatttgttttgctgtctg

SEQ ID NO: 224063 - DNA, 21 bp, Mus musculus
tgggaccagggttgttggggc

SEQ ID NO: 224064 - DNA, 23 bp, Mus musculus
tcagggtctcagtcccagctaca

SEQ ID NO: 224065 - DNA, 23 bp, Mus musculus
tgtgtgcatgcaagtgcatgtgt

SEQ ID NO: 224066 - DNA, 22 bp, Mus musculus
aattggactctggggctggaga

SEQ ID NO: 224067 - DNA, 20 bp, Mus musculus
aagaactctgactgctcttc

SEQ ID NO: 224068 - DNA, 20 bp, Mus musculus
agtcatgaatcgcttgggtt

SEQ ID NO: 224069 - DNA, 21 bp, Mus musculus
tgtcagagcagagtgtgcact

SEQ ID NO: 224070 - DNA, 19 bp, Mus musculus
tgcgctgatgtaggctctt

SEQ ID NO: 224071 - DNA, 23 bp, Mus musculus
acatgtgtgtgtgtatatgtata

SEQ ID NO: 224072 - DNA, 23 bp, Mus musculus
atcctctgtgaagagagactgct

SEQ ID NO: 224073 - DNA, 20 bp, Mus musculus
atagctggtgatgtacagcg

SEQ ID NO: 224074 - DNA, 18 bp, Mus musculus
ttccaaatgtctaccctt

SEQ ID NO: 224075 - DNA, 22 bp, Mus musculus
actgtgcaaggtacactgaggg

SEQ ID NO: 224076 - DNA, 23 bp, Mus musculus
taaggttgtagcttggttagcag

SEQ ID NO: 224077 - DNA, 23 bp, Mus musculus
tctgtcacagtcagtcattgagg

SEQ ID NO: 224078 - DNA, 23 bp, Mus musculus
tctgcttctatgtctgtctgtct

SEQ ID NO: 224079 - DNA, 21 bp, Mus musculus
tcacactgtcagactccctgc

SEQ ID NO: 224080 - DNA, 23 bp, Mus musculus
atgtatgtatgtatgtgagtgaa

SEQ ID NO: 224081 - DNA, 21 bp, Mus musculus
gtgagtgtgcatggtctatgt

SEQ ID NO: 224082 - DNA, 20 bp, Mus musculus
atgactgtgttctcagtgga

SEQ ID NO: 224083 - DNA, 20 bp, Mus musculus
ctttctccatcttttctgca

SEQ ID NO: 224084 - DNA, 23 bp, Mus musculus
agacaagaggattcagaggactt

SEQ ID NO: 224085 - DNA, 23 bp, Mus musculus
tgcctgtgtcgctctatccttct

SEQ ID NO: 224086 - DNA, 19 bp, Mus musculus
tatgtgtgtatgtgcatga

SEQ ID NO: 224087 - DNA, 23 bp, Mus musculus
acagcgagtgatcagtctagctg

SEQ ID NO: 224088 - DNA, 22 bp, Mus musculus
aattagcttctgactgcttgtg

SEQ ID NO: 224089 - DNA, 18 bp, Mus musculus
tatgtatgtatgtatgta

SEQ ID NO: 224090 - DNA, 22 bp, Mus musculus
gattgattgttcttgctggctt

SEQ ID NO: 224091 - DNA, 23 bp, Mus musculus
aagaaggaagaattggaatagtt

SEQ ID NO: 224092 - DNA, 19 bp, Mus musculus
tgtatgtgcatggatatga

SEQ ID NO: 224093 - DNA, 22 bp, Mus musculus
tgtccgtccatctcttctgtct

SEQ ID NO: 224094 - DNA, 23 bp, Mus musculus
ccagtctctgcctttctctctct

SEQ ID NO: 224095 - DNA, 20 bp, Mus musculus
acacatgtgtatgtgtgtgt

SEQ ID NO: 224096 - DNA, 22 bp, Mus musculus
acatatacatacacacacatat

SEQ ID NO: 224097 - DNA, 23 bp, Mus musculus
tgtgtgtatgtatatatgtgtgt

SEQ ID NO: 224098 - DNA, 18 bp, Mus musculus
aggagagttaagttctgt

SEQ ID NO: 224099 - DNA, 23 bp, Mus musculus
agtgtctccctgtgtctcacctt

SEQ ID NO: 224100 - DNA, 22 bp, Mus musculus
agtgtttgtacaaacatgaatg

SEQ ID NO: 224101 - DNA, 21 bp, Mus musculus
ctaagttcttcaagcagatga

SEQ ID NO: 224102 - DNA, 19 bp, Mus musculus
tatgtatgtgtatacctga

SEQ ID NO: 224103 - DNA, 23 bp, Mus musculus
tatgtatatgcattggctgcact

SEQ ID NO: 224104 - DNA, 20 bp, Mus musculus
tgtgtatatatgtatatgta

SEQ ID NO: 224105 - DNA, 22 bp, Mus musculus
agtggagcagagtatctactgt

SEQ ID NO: 224106 - DNA, 23 bp, Mus musculus
atagtgatgatcatgatgatggt

SEQ ID NO: 224107 - DNA, 23 bp, Mus musculus
tatgttttcatcagagcctccac

SEQ ID NO: 224108 - DNA, 21 bp, Mus musculus
tcctcagttctttgtctctca

SEQ ID NO: 224109 - DNA, 18 bp, Mus musculus
tatatgcacacacatata

SEQ ID NO: 224110 - DNA, 22 bp, Mus musculus
aggagagaagagagacagctct

SEQ ID NO: 224111 - DNA, 19 bp, Mus musculus
atatgtatatatgtgtatg

SEQ ID NO: 224112 - DNA, 23 bp, Mus musculus
tctgtctgtctgtgtgcatgtgc

SEQ ID NO: 224113 - DNA, 23 bp, Mus musculus
agatctgtttggatatcttcatt

SEQ ID NO: 224114 - DNA, 23 bp, Mus musculus
tctcagcctccctgagtgcctga

SEQ ID NO: 224115 - DNA, 20 bp, Mus musculus
tcatagaccaaaaggctctg

SEQ ID NO: 224116 - DNA, 23 bp, Mus musculus
atatgtgtatgtatgtatatatg

SEQ ID NO: 224117 - DNA, 22 bp, Mus musculus
tgtctctgactgtctatgcatg

SEQ ID NO: 224118 - DNA, 21 bp, Mus musculus
tgttggggattatcttgaaca

SEQ ID NO: 224119 - DNA, 23 bp, Mus musculus
aattctcagcctgtttctctgtg

SEQ ID NO: 224120 - DNA, 23 bp, Mus musculus
gtcttgtgtcactttcagtgtgc

SEQ ID NO: 224121 - DNA, 23 bp, Mus musculus
gagccatctctctagctctctga

SEQ ID NO: 224122 - DNA, 22 bp, Mus musculus
tgttttgtgaccaattatatgg

SEQ ID NO: 224123 - DNA, 23 bp, Mus musculus
agtgtctctctgtctctggcccc

SEQ ID NO: 224124 - DNA, 22 bp, Mus musculus
ttgttttgctttactattcttg

SEQ ID NO: 224125 - DNA, 22 bp, Mus musculus
gtctgtctgtctgtctgtctgt

SEQ ID NO: 224126 - DNA, 23 bp, Mus musculus
tttctgttatctagaaatcccat

SEQ ID NO: 224127 - DNA, 23 bp, Mus musculus
atgtgtgtgtgcatgtgcatgag

SEQ ID NO: 224128 - DNA, 23 bp, Mus musculus
tgtgttcatgtgcatgtagaaca

SEQ ID NO: 224129 - DNA, 21 bp, Mus musculus
tcagaattgtttagaagaatg

SEQ ID NO: 224130 - DNA, 18 bp, Mus musculus
aaatcattgtgtgggccg

SEQ ID NO: 224131 - DNA, 23 bp, Mus musculus
tgtgtgtgtgcatatgcatgtaa

SEQ ID NO: 224132 - DNA, 22 bp, Mus musculus
tgttttgtgaccaattatatgg

SEQ ID NO: 224133 - DNA, 20 bp, Mus musculus
tcagatgcagtgactgacgt

SEQ ID NO: 224134 - DNA, 23 bp, Mus musculus
caggaatgagatagtagagagcc

SEQ ID NO: 224135 - DNA, 21 bp, Mus musculus
atggctcagtggttaagagca

SEQ ID NO: 224136 - DNA, 18 bp, Mus musculus
ctgggtctctctgtgtgt

SEQ ID NO: 224137 - DNA, 23 bp, Mus musculus
ttcagacagtccatctgcttgtg

SEQ ID NO: 224138 - DNA, 23 bp, Mus musculus
tcactgcaagtggatctgaatgc

SEQ ID NO: 224139 - DNA, 22 bp, Mus musculus
tgttttgtgaccaattatatgg

SEQ ID NO: 224140 - DNA, 23 bp, Mus musculus
atctatgtatgtgtgtatgtaca

SEQ ID NO: 224141 - DNA, 22 bp, Mus musculus
tgtgtctctctgtgtgttcatc

SEQ ID NO: 224142 - DNA, 23 bp, Mus musculus
cacatatgtgtgtgcatgcacat

SEQ ID NO: 224143 - DNA, 23 bp, Mus musculus
gagaggaggaggttagtaagttg

SEQ ID NO: 224144 - DNA, 22 bp, Mus musculus
tgttttgtgaccaattatatgg

SEQ ID NO: 224145 - DNA, 23 bp, Mus musculus
tgtgtgtacatgtgcatgtgtgt

SEQ ID NO: 224146 - DNA, 19 bp, Mus musculus
tatgtctgcatgtgtatgt

SEQ ID NO: 224147 - DNA, 21 bp, Mus musculus
tgtgtgtctgagtgtctctgt

SEQ ID NO: 224148 - DNA, 20 bp, Mus musculus
ttaagagcactgactgctct

SEQ ID NO: 224149 - DNA, 22 bp, Mus musculus
tgtgtatatgtgtatgtgagtg

SEQ ID NO: 224150 - DNA, 21 bp, Mus musculus
tatgtctatttgtgtatgtgt

SEQ ID NO: 224151 - DNA, 18 bp, Mus musculus
aacacattttcattacag

SEQ ID NO: 224152 - DNA, 23 bp, Mus musculus
aacagactgtagtttggagattg

SEQ ID NO: 224153 - DNA, 23 bp, Mus musculus
ctatgtgtttgtatctgtgtatg

SEQ ID NO: 224154 - DNA, 23 bp, Mus musculus
tgtggtggtgtgtgtctgtaatc

SEQ ID NO: 224155 - DNA, 20 bp, Mus musculus
tcccatgtacctcacattgg

SEQ ID NO: 224156 - DNA, 23 bp, Mus musculus
tctgtctctgtgtgtgttcatag

SEQ ID NO: 224157 - DNA, 20 bp, Mus musculus
tagaccttggtattttagta

SEQ ID NO: 224158 - DNA, 20 bp, Mus musculus
ttctgtagtcagcacattgg

SEQ ID NO: 224159 - DNA, 20 bp, Mus musculus
gtgatgctgattgtatggtg

SEQ ID NO: 224160 - DNA, 23 bp, Mus musculus
tgtgtgcttatgaatatgtgtgt

SEQ ID NO: 224161 - DNA, 20 bp, Mus musculus
gtatatgtacatgtatatgt

SEQ ID NO: 224162 - DNA, 23 bp, Mus musculus
tgtgtgcctgtctgtctgtctgt

SEQ ID NO: 224163 - DNA, 23 bp, Mus musculus
tctctcccagtcacagacttcaa

SEQ ID NO: 224164 - DNA, 21 bp, Mus musculus
caaagaactgatggggcagtt

SEQ ID NO: 224165 - DNA, 23 bp, Mus musculus
ttactctgtctctcagttgctgg

SEQ ID NO: 224166 - DNA, 19 bp, Mus musculus
tgacaaggtaatcaggact

SEQ ID NO: 224167 - DNA, 23 bp, Mus musculus
ccctgtgcatgtagcttgtttgc

SEQ ID NO: 224168 - DNA, 23 bp, Mus musculus
tgtgcttcagagaacatagggaa

SEQ ID NO: 224169 - DNA, 23 bp, Mus musculus
tgcttggccttagtctctcagtt

SEQ ID NO: 224170 - DNA, 23 bp, Mus musculus
tgtctgtgtgtgtgtctatgtgc

SEQ ID NO: 224171 - DNA, 23 bp, Mus musculus
gggactcttttgtcgatctggac

SEQ ID NO: 224172 - DNA, 23 bp, Mus musculus
tttctgcagcaccaagtgaagag

SEQ ID NO: 224173 - DNA, 23 bp, Mus musculus
gtatgtatgtatgtatgtgtgtg

SEQ ID NO: 224174 - DNA, 23 bp, Mus musculus
tatggtggtgaagaagcctgtct

SEQ ID NO: 224175 - DNA, 21 bp, Mus musculus
tgcatatatatacatatgtgt

SEQ ID NO: 224176 - DNA, 23 bp, Mus musculus
atatgtgtgtatgtatatgtgtg

SEQ ID NO: 224177 - DNA, 22 bp, Mus musculus
tatcactgggaccctctatgac

SEQ ID NO: 224178 - DNA, 19 bp, Mus musculus
tcagttggaatggctgtct

SEQ ID NO: 224179 - DNA, 23 bp, Mus musculus
cctgtctgagtcactcagtgcat

SEQ ID NO: 224180 - DNA, 22 bp, Mus musculus
cagaggtcctgagttcaattcc

SEQ ID NO: 224181 - DNA, 22 bp, Mus musculus
agagcccctgataaactccaag

SEQ ID NO: 224182 - DNA, 18 bp, Mus musculus
tgactcctctttctgtgc

SEQ ID NO: 224183 - DNA, 23 bp, Mus musculus
ttctctgtgtgtgacatccaact

SEQ ID NO: 224184 - DNA, 23 bp, Mus musculus
tctgtctgtctcggtaacttttc

SEQ ID NO: 224185 - DNA, 23 bp, Mus musculus
tcacagtgcaggctgacctcaga

SEQ ID NO: 224186 - DNA, 20 bp, Mus musculus
gctgtgaccccagttctgtg

SEQ ID NO: 224187 - DNA, 23 bp, Mus musculus
ttatgtgtgtgtgcgtgtgtatg

SEQ ID NO: 224188 - DNA, 23 bp, Mus musculus
gtatgtatgtatgtgtgaaattg

SEQ ID NO: 224189 - DNA, 23 bp, Mus musculus
ccttagaataagatgtggcaaag

SEQ ID NO: 224190 - DNA, 19 bp, Mus musculus
ttgtctttcaggtttcggt

SEQ ID NO: 224191 - DNA, 23 bp, Mus musculus
tgtctgtctgtctgtctccgtct

SEQ ID NO: 224192 - DNA, 20 bp, Mus musculus
atatatcttgtgtgccgctg

SEQ ID NO: 224193 - DNA, 18 bp, Mus musculus
tgtgaccctctctggctc

SEQ ID NO: 224194 - DNA, 18 bp, Mus musculus
actcggtgctgactgaga

SEQ ID NO: 224195 - DNA, 23 bp, Mus musculus
gacctttgacagtagcacttcta

SEQ ID NO: 224196 - DNA, 23 bp, Mus musculus
atgttgcttgttaagttgaagga

SEQ ID NO: 224197 - DNA, 18 bp, Mus musculus
tcccatgctctgggcata

SEQ ID NO: 224198 - DNA, 23 bp, Mus musculus
tgctgtcatgtggggattgctgt

SEQ ID NO: 224199 - DNA, 23 bp, Mus musculus
ttctgagtgaggagacagagcag

SEQ ID NO: 224200 - DNA, 23 bp, Mus musculus
tgactctgtgtgtgtgcacatgt

SEQ ID NO: 224201 - DNA, 19 bp, Mus musculus
ccctgcacactctctctct

SEQ ID NO: 224202 - DNA, 23 bp, Mus musculus
ctgtggctcacactgactgtcat

SEQ ID NO: 224203 - DNA, 22 bp, Mus musculus
cttgttcaaggtgctgaacaac

SEQ ID NO: 224204 - DNA, 23 bp, Mus musculus
tcactgatgactgtgacctgaga

SEQ ID NO: 224205 - DNA, 23 bp, Mus musculus
atgtatatgtatatgtatatgta

SEQ ID NO: 224206 - DNA, 23 bp, Mus musculus
tctggctctgtgtggctctgcag

SEQ ID NO: 224207 - DNA, 23 bp, Mus musculus
tcataacatgcaacagtctcagc

SEQ ID NO: 224208 - DNA, 23 bp, Mus musculus
tcgggcagcactcactggtgtat

SEQ ID NO: 224209 - DNA, 20 bp, Mus musculus
acactgccactctctgtgtc

SEQ ID NO: 224210 - DNA, 23 bp, Mus musculus
tcacccactcactgtctgggact

SEQ ID NO: 224211 - DNA, 23 bp, Mus musculus
actaacaggaactgcatgtgaca

SEQ ID NO: 224212 - DNA, 20 bp, Mus musculus
tctgtgggggtgtctttggg

SEQ ID NO: 224213 - DNA, 23 bp, Mus musculus
tatatgtgtgtatatgttgtgat

SEQ ID NO: 224214 - DNA, 23 bp, Mus musculus
tgtggcatgtgtgtgtgttagtg

SEQ ID NO: 224215 - DNA, 23 bp, Mus musculus
agagcatttttgttcatttgttt

SEQ ID NO: 224216 - DNA, 20 bp, Mus musculus
gagcaaggggagacttgtgt

SEQ ID NO: 224217 - DNA, 20 bp, Mus musculus
tgcactttgtgtcaagagat

SEQ ID NO: 224218 - DNA, 21 bp, Mus musculus
atctgagcacagagtgtgctc

SEQ ID NO: 224219 - DNA, 23 bp, Mus musculus
gtgctcacagtgtagtcagtgtg

SEQ ID NO: 224220 - DNA, 23 bp, Mus musculus
tcacagtgtactcagtgtgctca

SEQ ID NO: 224221 - DNA, 23 bp, Mus musculus
cagtgtacacagtgtgcttacag

SEQ ID NO: 224222 - DNA, 23 bp, Mus musculus
agtgtgttcacagtgtgctcagt

SEQ ID NO: 224223 - DNA, 23 bp, Mus musculus
tcacagtgtactcagtgtgctca

SEQ ID NO: 224224 - DNA, 22 bp, Mus musculus
ctcacagtgtactcagtgtgct

SEQ ID NO: 224225 - DNA, 19 bp, Mus musculus
agtatgctcagtgtgctca

SEQ ID NO: 224226 - DNA, 23 bp, Mus musculus
tcacagtgtactcagtgtgctca

SEQ ID NO: 224227 - DNA, 21 bp, Mus musculus
agtgtgctcagtgtgctcaca

SEQ ID NO: 224228 - DNA, 20 bp, Mus musculus
acagtgtgctcagtgtgctc

SEQ ID NO: 224229 - DNA, 23 bp, Mus musculus
agtgtctctctctgggtgcgatt

SEQ ID NO: 224230 - DNA, 23 bp, Mus musculus
tgtatacctgtatatctatatct

SEQ ID NO: 224231 - DNA, 20 bp, Mus musculus
agagattgatagagatctgt

SEQ ID NO: 224232 - DNA, 23 bp, Mus musculus
tgtgtctatctgtctctgtatct

SEQ ID NO: 224233 - DNA, 21 bp, Mus musculus
tgggaccctcactgtctgtct

SEQ ID NO: 224234 - DNA, 23 bp, Mus musculus
ccctggctccctgtttgagtcat

SEQ ID NO: 224235 - DNA, 21 bp, Mus musculus
ctgaccttctgtgtctctctc

SEQ ID NO: 224236 - DNA, 23 bp, Mus musculus
tgtctgcctctgtcactctgtct

SEQ ID NO: 224237 - DNA, 23 bp, Mus musculus
cactgtgggtctgagtgactgtg

SEQ ID NO: 224238 - DNA, 23 bp, Mus musculus
acacaggatgcagagggaggttt

SEQ ID NO: 224239 - DNA, 23 bp, Mus musculus
catgagtgtgaatatggctgtgt

SEQ ID NO: 224240 - DNA, 23 bp, Mus musculus
tttctgtctgtgactgtccagtg

SEQ ID NO: 224241 - DNA, 23 bp, Mus musculus
catgtctgcctgtgtgggagtgt

SEQ ID NO: 224242 - DNA, 20 bp, Mus musculus
actgtccctctctgggcctc

SEQ ID NO: 224243 - DNA, 23 bp, Mus musculus
tgaaaacatagattatcaaaagt

SEQ ID NO: 224244 - DNA, 18 bp, Mus musculus
tgtttttatggagctgga

SEQ ID NO: 224245 - DNA, 21 bp, Mus musculus
agtcacccaccttaactttcc

SEQ ID NO: 224246 - DNA, 20 bp, Mus musculus
ttaatggttatagttttcag

SEQ ID NO: 224247 - DNA, 22 bp, Mus musculus
tatatgtgtatgtatatgatgt

SEQ ID NO: 224248 - DNA, 23 bp, Mus musculus
tctggcccactgaatcttgtttg

SEQ ID NO: 224249 - DNA, 23 bp, Mus musculus
tgtatgtatgtattcatgtgtgt

SEQ ID NO: 224250 - DNA, 19 bp, Mus musculus
tgtctatctgtctgtctgc

SEQ ID NO: 224251 - DNA, 23 bp, Mus musculus
tgtcagatcctatgtctgtctgt

SEQ ID NO: 224252 - DNA, 19 bp, Mus musculus
gtatggatgcatgtatgta

SEQ ID NO: 224253 - DNA, 23 bp, Mus musculus
taaacatgaacactgaaaaatgt

SEQ ID NO: 224254 - DNA, 18 bp, Mus musculus
tctgggtctctgtctctg

SEQ ID NO: 224255 - DNA, 23 bp, Mus musculus
tctctgtgtacacagtgagctct

SEQ ID NO: 224256 - DNA, 22 bp, Mus musculus
tgtgtcagggaaattataggct

SEQ ID NO: 224257 - DNA, 20 bp, Mus musculus
tatactttttttcttattga

SEQ ID NO: 224258 - DNA, 23 bp, Mus musculus
gatctctctgtctgtcactgtac

SEQ ID NO: 224259 - DNA, 23 bp, Mus musculus
ctctgtagtacagcttgaggtca

SEQ ID NO: 224260 - DNA, 22 bp, Mus musculus
tgttttgtgaccaattatatgg

SEQ ID NO: 224261 - DNA, 22 bp, Mus musculus
gtcagagtcacagagactgaga

SEQ ID NO: 224262 - DNA, 23 bp, Mus musculus
catgacagagcttttgatttata

SEQ ID NO: 224263 - DNA, 22 bp, Mus musculus
tgtatgtgtatgtatatgtata

SEQ ID NO: 224264 - DNA, 20 bp, Mus musculus
tgtgtgtacaaacacatgtg

SEQ ID NO: 224265 - DNA, 23 bp, Mus musculus
tctctctatctgtctctgcagaa

SEQ ID NO: 224266 - DNA, 19 bp, Mus musculus
aagaagagtggtattcagg

SEQ ID NO: 224267 - DNA, 18 bp, Mus musculus
atgttggtctgataggat

SEQ ID NO: 224268 - DNA, 22 bp, Mus musculus
ttctcagaggctctgtggctct

SEQ ID NO: 224269 - DNA, 20 bp, Mus musculus
agacacaagactgtgagcaa

SEQ ID NO: 224270 - DNA, 19 bp, Mus musculus
tgtccttgtgggaccccca

SEQ ID NO: 224271 - DNA, 23 bp, Mus musculus
ttgtcactccctgtgttatatct

SEQ ID NO: 224272 - DNA, 23 bp, Mus musculus
cacatttctggttatgttctgat

SEQ ID NO: 224273 - DNA, 22 bp, Mus musculus
tgtggtacttggatgaaatgat

SEQ ID NO: 224274 - DNA, 22 bp, Mus musculus
aggcatgaatttgtattgaatc

SEQ ID NO: 224275 - DNA, 23 bp, Mus musculus
agtggttctgagttgttgacaac

SEQ ID NO: 224276 - DNA, 23 bp, Mus musculus
tagtatgtgtgtgattatgtatg

SEQ ID NO: 224277 - DNA, 18 bp, Mus musculus
acatacacatatacatat

SEQ ID NO: 224278 - DNA, 19 bp, Mus musculus
tgatgtgttacatagttct

SEQ ID NO: 224279 - DNA, 23 bp, Mus musculus
tctcacctttctagtctggatca

SEQ ID NO: 224280 - DNA, 19 bp, Mus musculus
atctatgtatttatgtatc

SEQ ID NO: 224281 - DNA, 22 bp, Mus musculus
tgttttgtgaccaattatatgg

SEQ ID NO: 224282 - DNA, 23 bp, Mus musculus
catgtgtgtgtatgtactctagg

SEQ ID NO: 224283 - DNA, 18 bp, Mus musculus
caggatgtaagttgcttt

SEQ ID NO: 224284 - DNA, 23 bp, Mus musculus
tgtctacctgcctgtctgtctgt

SEQ ID NO: 224285 - DNA, 20 bp, Mus musculus
atcaatatcaccatgtggat

SEQ ID NO: 224286 - DNA, 22 bp, Mus musculus
ctgatgtaggcaaagccttcct

SEQ ID NO: 224287 - DNA, 23 bp, Mus musculus
tgtatgtatgtgtgtatgcttgt

SEQ ID NO: 224288 - DNA, 23 bp, Mus musculus
aggatgtttagttttgaagacac

SEQ ID NO: 224289 - DNA, 22 bp, Mus musculus
tgttatgcacacacacacgtgt

SEQ ID NO: 224290 - DNA, 23 bp, Mus musculus
gtatatgtatatgtatatgtgtg

SEQ ID NO: 224291 - DNA, 22 bp, Mus musculus
tatgatgcatgtgtatatgtat

SEQ ID NO: 224292 - DNA, 22 bp, Mus musculus
tcttgtgtgctataatagactt

SEQ ID NO: 224293 - DNA, 23 bp, Mus musculus
aaactcactcactttcatgaagc

SEQ ID NO: 224294 - DNA, 21 bp, Mus musculus
gtggcccatcatcttctgtgt

SEQ ID NO: 224295 - DNA, 19 bp, Mus musculus
ttaattgcatgtaagcggg

SEQ ID NO: 224296 - DNA, 23 bp, Mus musculus
acagacagacagacattacctac

SEQ ID NO: 224297 - DNA, 23 bp, Mus musculus
attacagtgaaaagcaaagcatt

SEQ ID NO: 224298 - DNA, 20 bp, Mus musculus
tattctttaaatatatatgt

SEQ ID NO: 224299 - DNA, 20 bp, Mus musculus
catacatacatatgcaaagg

SEQ ID NO: 224300 - DNA, 23 bp, Mus musculus
tgtatgtatgtatgtatgtattt

SEQ ID NO: 224301 - DNA, 19 bp, Mus musculus
tgtccagctctttgtccag

SEQ ID NO: 224302 - DNA, 18 bp, Mus musculus
tttagctatgttagctct

SEQ ID NO: 224303 - DNA, 23 bp, Mus musculus
agttcagagtggttgagttgagc

SEQ ID NO: 224304 - DNA, 20 bp, Mus musculus
cacagtgagtgttgatccac

SEQ ID NO: 224305 - DNA, 23 bp, Mus musculus
ctactgggaagtcagtgaggaga

SEQ ID NO: 224306 - DNA, 21 bp, Mus musculus
aggttcaggaaccttctccgt

SEQ ID NO: 224307 - DNA, 23 bp, Mus musculus
gtgtaagtatgtatgtatgtaag

SEQ ID NO: 224308 - DNA, 23 bp, Mus musculus
tatatatctgcatctacatctac

SEQ ID NO: 224309 - DNA, 20 bp, Mus musculus
agtgaaacgaatatgtatgt

SEQ ID NO: 224310 - DNA, 21 bp, Mus musculus
tatgtatgtatatatgtatga

SEQ ID NO: 224311 - DNA, 22 bp, Mus musculus
tgaatgcatatatataggtatg

SEQ ID NO: 224312 - DNA, 23 bp, Mus musculus
cctgtgacagtctcactctggtt

SEQ ID NO: 224313 - DNA, 23 bp, Mus musculus
tgtggctctggttgttttctcac

SEQ ID NO: 224314 - DNA, 20 bp, Mus musculus
acacagaagtatgtgagcag

SEQ ID NO: 224315 - DNA, 23 bp, Mus musculus
tctctctctctgtgtgtgtgtgt

SEQ ID NO: 224316 - DNA, 23 bp, Mus musculus
tcatgactgtggtatagtttgtt

SEQ ID NO: 224317 - DNA, 23 bp, Mus musculus
ctgccagtctgactctgacagag

SEQ ID NO: 224318 - DNA, 20 bp, Mus musculus
attcatctttggggcaggag

SEQ ID NO: 224319 - DNA, 23 bp, Mus musculus
taagagcactgactcctcttcca

SEQ ID NO: 224320 - DNA, 21 bp, Mus musculus
tggcagcctgcctgtatccca

SEQ ID NO: 224321 - DNA, 22 bp, Mus musculus
gtagaaggaagtggttctcttt

SEQ ID NO: 224322 - DNA, 23 bp, Mus musculus
aagcactgactgctcttccagag

SEQ ID NO: 224323 - DNA, 21 bp, Mus musculus
tgtgagtgtgtatgtgcattt

SEQ ID NO: 224324 - DNA, 23 bp, Mus musculus
acacatgtgtgtgtgtgagtgtg

SEQ ID NO: 224325 - DNA, 23 bp, Mus musculus
ctggctcactgactgtctcctag

SEQ ID NO: 224326 - DNA, 23 bp, Mus musculus
atactgctacagattgcttctcg

SEQ ID NO: 224327 - DNA, 21 bp, Mus musculus
attcatgtatcctcatctggc

SEQ ID NO: 224328 - DNA, 23 bp, Mus musculus
ttgtcctacatttgggaaacttc

SEQ ID NO: 224329 - DNA, 23 bp, Mus musculus
ttgacagtacagtgtgagcacag

SEQ ID NO: 224330 - DNA, 21 bp, Mus musculus
tacaatactctggaaaaagat

SEQ ID NO: 224331 - DNA, 19 bp, Mus musculus
tcactgtctctctttcatg

SEQ ID NO: 224332 - DNA, 21 bp, Mus musculus
tgtctgtctccctttgttctg

SEQ ID NO: 224333 - DNA, 23 bp, Mus musculus
tgacagctgagagtgtggaaagt

SEQ ID NO: 224334 - DNA, 23 bp, Mus musculus
tctccagctcctattatatgtct

SEQ ID NO: 224335 - DNA, 19 bp, Mus musculus
tatgtgtgtatgtatatat

SEQ ID NO: 224336 - DNA, 18 bp, Mus musculus
tatgtgtgtatgtatata

SEQ ID NO: 224337 - DNA, 23 bp, Mus musculus
ctctcagtctctaaccttattgt

SEQ ID NO: 224338 - DNA, 23 bp, Mus musculus
aagagcactgactgctcttccag

SEQ ID NO: 224339 - DNA, 22 bp, Mus musculus
ttatgtgaattggtgttttgcg

SEQ ID NO: 224340 - DNA, 20 bp, Mus musculus
aatacccatttctttgacca

SEQ ID NO: 224341 - DNA, 23 bp, Mus musculus
actgtgtctgactgtgtgccctg

SEQ ID NO: 224342 - DNA, 18 bp, Mus musculus
aatgttctctggcagcag

SEQ ID NO: 224343 - DNA, 21 bp, Mus musculus
gactctcactgtgtggctctg

SEQ ID NO: 224344 - DNA, 21 bp, Mus musculus
ttgtgagtctgtaactgtcag

SEQ ID NO: 224345 - DNA, 18 bp, Mus musculus
gcctgggaacttgcagtc

SEQ ID NO: 224346 - DNA, 22 bp, Mus musculus
tgcatagtgagctcatatctca

SEQ ID NO: 224347 - DNA, 18 bp, Mus musculus
cagagaaatggctcagca

SEQ ID NO: 224348 - DNA, 21 bp, Mus musculus
ttaagagcactgactgctctt

SEQ ID NO: 224349 - DNA, 23 bp, Mus musculus
ttcacaacaggtagtgtaacgct

SEQ ID NO: 224350 - DNA, 23 bp, Mus musculus
tctcactgagagtttgttcttca

SEQ ID NO: 224351 - DNA, 18 bp, Mus musculus
aggcttgaacaccgctgt

SEQ ID NO: 224352 - DNA, 21 bp, Mus musculus
gtctctgtgtggatgaggtgc

SEQ ID NO: 224353 - DNA, 20 bp, Mus musculus
agatttgaaggtggtgtggt

SEQ ID NO: 224354 - DNA, 23 bp, Mus musculus
tcagacactggctgagttctgct

SEQ ID NO: 224355 - DNA, 23 bp, Mus musculus
agccgcacagttagctggttact

SEQ ID NO: 224356 - DNA, 23 bp, Mus musculus
taaggcctattagtgtgagtgtg

SEQ ID NO: 224357 - DNA, 22 bp, Mus musculus
tcccacccacactcagagacta

SEQ ID NO: 224358 - DNA, 19 bp, Mus musculus
tgtctcagattctctctct

SEQ ID NO: 224359 - DNA, 23 bp, Mus musculus
tgtcagatgttacagtgctcact

SEQ ID NO: 224360 - DNA, 23 bp, Mus musculus
agtctcagtggaatctagttgtt

SEQ ID NO: 224361 - DNA, 22 bp, Mus musculus
tgtctgacactgtcacttgaag

SEQ ID NO: 224362 - DNA, 21 bp, Mus musculus
agacagcatccacagaaggtg

SEQ ID NO: 224363 - DNA, 23 bp, Mus musculus
tctgactgctcttccagaggtcc

SEQ ID NO: 224364 - DNA, 23 bp, Mus musculus
taaatgtaagttttcaatcgtgt

SEQ ID NO: 224365 - DNA, 23 bp, Mus musculus
acttattcttgtcattttgatga

SEQ ID NO: 224366 - DNA, 22 bp, Mus musculus
atcttacaagtactgaatctga

SEQ ID NO: 224367 - DNA, 23 bp, Mus musculus
ctgtctgtctgtctgtctacttc

SEQ ID NO: 224368 - DNA, 23 bp, Mus musculus
gtatctgtctgtctgtctatcta

SEQ ID NO: 224369 - DNA, 20 bp, Mus musculus
tctctctgtctctgggagag

SEQ ID NO: 224370 - DNA, 21 bp, Mus musculus
actggaactctgtctctgact

SEQ ID NO: 224371 - DNA, 21 bp, Mus musculus
taatgtatatatatgtgtgtg

SEQ ID NO: 224372 - DNA, 23 bp, Mus musculus
aagctgctgtctctctcttagtc

SEQ ID NO: 224373 - DNA, 23 bp, Mus musculus
ggaaggtgaagctgggctcgagg

SEQ ID NO: 224374 - DNA, 23 bp, Mus musculus
atatgtatgtatgtatgtatgta

SEQ ID NO: 224375 - DNA, 23 bp, Mus musculus
aggcagtgttctctagggatgta

SEQ ID NO: 224376 - DNA, 23 bp, Mus musculus
tttttggctgtggatgactagag

SEQ ID NO: 224377 - DNA, 23 bp, Mus musculus
gcttggaaagatgactcatagat

SEQ ID NO: 224378 - DNA, 23 bp, Mus musculus
tgtcagtgtctctctctgtcact

SEQ ID NO: 224379 - DNA, 23 bp, Mus musculus
gtgcatgtctgtgtataagaaat

SEQ ID NO: 224380 - DNA, 23 bp, Mus musculus
ttctgtgatcctggttgtgtcag

SEQ ID NO: 224381 - DNA, 18 bp, Mus musculus
actgcaaatacttatatg

SEQ ID NO: 224382 - DNA, 23 bp, Mus musculus
ttagtcttgcttggttatgaaaa

SEQ ID NO: 224383 - DNA, 22 bp, Mus musculus
tgttttgtgaccaattatatgg

SEQ ID NO: 224384 - DNA, 20 bp, Mus musculus
tagctgtgatgtcagctcag

SEQ ID NO: 224385 - DNA, 23 bp, Mus musculus
gtctctcagtctgacagtctgac

SEQ ID NO: 224386 - DNA, 22 bp, Mus musculus
gtgggtctcactctctctcagc

SEQ ID NO: 224387 - DNA, 18 bp, Mus musculus
tcacccacagattctcgc

SEQ ID NO: 224388 - DNA, 22 bp, Mus musculus
tgcctgcctccctgactggccc

SEQ ID NO: 224389 - DNA, 23 bp, Mus musculus
tttcacacacagcattgatgtga

SEQ ID NO: 224390 - DNA, 23 bp, Mus musculus
caggctctgactggctcactgtg

SEQ ID NO: 224391 - DNA, 23 bp, Mus musculus
ttggcgattcagaaagcccttcc

SEQ ID NO: 224392 - DNA, 21 bp, Mus musculus
aggcagacataggttgtagag

SEQ ID NO: 224393 - DNA, 22 bp, Mus musculus
tctcagatgcagaaagagccgt

SEQ ID NO: 224394 - DNA, 23 bp, Mus musculus
tctgtcactgtgtctcatagtgg

SEQ ID NO: 224395 - DNA, 23 bp, Mus musculus
tatctgtctgtgtgtctgtctct

SEQ ID NO: 224396 - DNA, 23 bp, Mus musculus
tccgtcagtccgtcagtcctggg

SEQ ID NO: 224397 - DNA, 21 bp, Mus musculus
tggttgatgatgacctggatg

SEQ ID NO: 224398 - DNA, 19 bp, Mus musculus
agaccactgactgctcttc

SEQ ID NO: 224399 - DNA, 18 bp, Mus musculus
agcaacattcaatgggct

SEQ ID NO: 224400 - DNA, 23 bp, Mus musculus
cagcctctgtctgtctgtctgtc

SEQ ID NO: 224401 - DNA, 21 bp, Mus musculus
tctgtcggtctgtctgtcttt

SEQ ID NO: 224402 - DNA, 23 bp, Mus musculus
acatgtatgagtgtgtcagatca

SEQ ID NO: 224403 - DNA, 23 bp, Mus musculus
tctgtctgtctgtctgtctgtct

SEQ ID NO: 224404 - DNA, 23 bp, Mus musculus
gtgcacagagttgagaaagacga

SEQ ID NO: 224405 - DNA, 23 bp, Mus musculus
ctctctgagcttgagtgttcttt

SEQ ID NO: 224406 - DNA, 23 bp, Mus musculus
tatatatgtgtagtagtttgaat

SEQ ID NO: 224407 - DNA, 23 bp, Mus musculus
ctgctgtgtctgtctctgggtcc

SEQ ID NO: 224408 - DNA, 22 bp, Mus musculus
ttctatgtgtgctttactttgg

SEQ ID NO: 224409 - DNA, 20 bp, Mus musculus
acacacacatgtatgtatgt

SEQ ID NO: 224410 - DNA, 23 bp, Mus musculus
tatgtgtatatgtatatatgtat

SEQ ID NO: 224411 - DNA, 22 bp, Mus musculus
atgtgaaactggaagtaattgg

SEQ ID NO: 224412 - DNA, 23 bp, Mus musculus
gtgtgtctgtctgtatatggtga

SEQ ID NO: 224413 - DNA, 22 bp, Mus musculus
aatagcactttgcagagccagt

SEQ ID NO: 224414 - DNA, 23 bp, Mus musculus
cacactgtctgtctgtctgtctt

SEQ ID NO: 224415 - DNA, 23 bp, Mus musculus
tcccagtcacatgtcctccagat

SEQ ID NO: 224416 - DNA, 23 bp, Mus musculus
atcttatggtttgtaaagaagct

SEQ ID NO: 224417 - DNA, 21 bp, Mus musculus
gtagagccagagagaataaag

SEQ ID NO: 224418 - DNA, 22 bp, Mus musculus
ttctctctgtctctgggagagt

SEQ ID NO: 224419 - DNA, 20 bp, Mus musculus
tttattggtgagagtggaga

SEQ ID NO: 224420 - DNA, 21 bp, Mus musculus
tttgtctatatgtttgtatgt

SEQ ID NO: 224421 - DNA, 23 bp, Mus musculus
atgaatacttgtggaactgattg

SEQ ID NO: 224422 - DNA, 23 bp, Mus musculus
cactgtctctgtccctctgtgcc

SEQ ID NO: 224423 - DNA, 23 bp, Mus musculus
ctagacaccagaaggtaaactga

SEQ ID NO: 224424 - DNA, 23 bp, Mus musculus
gtgtgtctgagtgtgtatatgcg

SEQ ID NO: 224425 - DNA, 23 bp, Mus musculus
tatgtacaccatatatttcgcat

SEQ ID NO: 224426 - DNA, 19 bp, Mus musculus
atatgtgtgtatatgtata

SEQ ID NO: 224427 - DNA, 21 bp, Mus musculus
tgcatgtgtgagtgtctgtgt

SEQ ID NO: 224428 - DNA, 23 bp, Mus musculus
ccagtctctgtctctcttgccag

SEQ ID NO: 224429 - DNA, 23 bp, Mus musculus
ctctggctcagacactggaaaag

SEQ ID NO: 224430 - DNA, 18 bp, Mus musculus
ctttctggttctgaaatg

SEQ ID NO: 224431 - DNA, 23 bp, Mus musculus
atgtgtatatatatgtatgtgta

SEQ ID NO: 224432 - DNA, 23 bp, Mus musculus
tgtatacacacacacatatatat

SEQ ID NO: 224433 - DNA, 23 bp, Mus musculus
tgtgagcgtgtctctctgtgtct

SEQ ID NO: 224434 - DNA, 23 bp, Mus musculus
aggtatcgaatatgtggatgagg

SEQ ID NO: 224435 - DNA, 23 bp, Mus musculus
ttatgtgcatatgtatacacatt

SEQ ID NO: 224436 - DNA, 23 bp, Mus musculus
tgtctcagtcagggtttgtattc

SEQ ID NO: 224437 - DNA, 22 bp, Mus musculus
aaacatcatgaccaagaagcaa

SEQ ID NO: 224438 - DNA, 19 bp, Mus musculus
tgaggatcttcagcagctg

SEQ ID NO: 224439 - DNA, 23 bp, Mus musculus
agagcactgtctgctcttccaga

SEQ ID NO: 224440 - DNA, 23 bp, Mus musculus
actggccctctctgcctctgtct

SEQ ID NO: 224441 - DNA, 22 bp, Mus musculus
atgtgtgtgcatttgcagtgtg

SEQ ID NO: 224442 - DNA, 22 bp, Mus musculus
cagagtgactgataggcctcac

SEQ ID NO: 224443 - DNA, 23 bp, Mus musculus
tcaggctccagtgacagctctct

SEQ ID NO: 224444 - DNA, 23 bp, Mus musculus
tgttctttgagtctgttcccaca

SEQ ID NO: 224445 - DNA, 23 bp, Mus musculus
tgactctgtctgtgtgggtgtgg

SEQ ID NO: 224446 - DNA, 19 bp, Mus musculus
atgcccttgcccttagcac

SEQ ID NO: 224447 - DNA, 18 bp, Mus musculus
aggctgaagagatggctc

SEQ ID NO: 224448 - DNA, 21 bp, Mus musculus
atgctgctacaaagtattttt

SEQ ID NO: 224449 - DNA, 23 bp, Mus musculus
ttggactcaatttctttatctgt

SEQ ID NO: 224450 - DNA, 22 bp, Mus musculus
ggtcttggtgcagtcttacatt

SEQ ID NO: 224451 - DNA, 23 bp, Mus musculus
tcattggaatttttgttgttcat

SEQ ID NO: 224452 - DNA, 23 bp, Mus musculus
gagggtctctgtgtgtctctctc

SEQ ID NO: 224453 - DNA, 21 bp, Mus musculus
atgtgtgcattcagaggaggt

SEQ ID NO: 224454 - DNA, 23 bp, Mus musculus
tctgtctttctctgactaatgct

SEQ ID NO: 224455 - DNA, 22 bp, Mus musculus
tgttttgtgaccaattatatgg

SEQ ID NO: 224456 - DNA, 21 bp, Mus musculus
acagctagtcttttctgtgat

SEQ ID NO: 224457 - DNA, 22 bp, Mus musculus
gatgactagagattttgaacat

SEQ ID NO: 224458 - DNA, 18 bp, Mus musculus
ttcctctattgtaaattc

SEQ ID NO: 224459 - DNA, 20 bp, Mus musculus
aaggctaaggaagtagagag

SEQ ID NO: 224460 - DNA, 21 bp, Mus musculus
tgtgtagtcctggctgtcctg

SEQ ID NO: 224461 - DNA, 23 bp, Mus musculus
acagttagtgtctctctctatcc

SEQ ID NO: 224462 - DNA, 23 bp, Mus musculus
tgtgctttcagcttctttacagt

SEQ ID NO: 224463 - DNA, 23 bp, Mus musculus
agcagcattgtacagggctatca

SEQ ID NO: 224464 - DNA, 23 bp, Mus musculus
acagtgatcagtgtcaggtgaga

SEQ ID NO: 224465 - DNA, 23 bp, Mus musculus
ctgtcacagtctctgtgagttca

SEQ ID NO: 224466 - DNA, 18 bp, Mus musculus
tcagtcttattgtgtctg

SEQ ID NO: 224467 - DNA, 23 bp, Mus musculus
aatagtatgtatgcatgtgtgtg

SEQ ID NO: 224468 - DNA, 23 bp, Mus musculus
tatcagtgagtgcatatcatgag

SEQ ID NO: 224469 - DNA, 22 bp, Mus musculus
agtctctatgataacttgttga

SEQ ID NO: 224470 - DNA, 23 bp, Mus musculus
tctctctgtctctgggagagttt

SEQ ID NO: 224471 - DNA, 23 bp, Mus musculus
tctgaaggtctgagagaattctg

SEQ ID NO: 224472 - DNA, 23 bp, Mus musculus
gtatgtttgtgtgcatgtgtatg

SEQ ID NO: 224473 - DNA, 23 bp, Mus musculus
taggtgacagatgtgtttctgaa

SEQ ID NO: 224474 - DNA, 22 bp, Mus musculus
taggggtaattcttttgtgtgt

SEQ ID NO: 224475 - DNA, 23 bp, Mus musculus
cagtcgaagactcactttgctgt

SEQ ID NO: 224476 - DNA, 23 bp, Mus musculus
gttcaattcccagcaaaccatat

SEQ ID NO: 224477 - DNA, 20 bp, Mus musculus
atacacatacacatatagta

SEQ ID NO: 224478 - DNA, 23 bp, Mus musculus
agtatgtatatgtatatgtatat

SEQ ID NO: 224479 - DNA, 20 bp, Mus musculus
gtcggtctctgtgtctatgt

SEQ ID NO: 224480 - DNA, 22 bp, Mus musculus
ttacagagaagagtgacagctg

SEQ ID NO: 224481 - DNA, 23 bp, Mus musculus
ttggtctgtgtcaccatcctgtg

SEQ ID NO: 224482 - DNA, 23 bp, Mus musculus
ctcacctactctgtgtctgggaa

SEQ ID NO: 224483 - DNA, 23 bp, Mus musculus
actcacacctattcagtctctca

SEQ ID NO: 224484 - DNA, 23 bp, Mus musculus
gtctgagagatgagattgaggag

SEQ ID NO: 224485 - DNA, 23 bp, Mus musculus
aacaatgaaattctgaaaacatc

SEQ ID NO: 224486 - DNA, 22 bp, Mus musculus
tgttttgtgaccaattatatgg

SEQ ID NO: 224487 - DNA, 23 bp, Mus musculus
cactgtcactatatgaaatagca

SEQ ID NO: 224488 - DNA, 20 bp, Mus musculus
gtctcttcttcacagaacat

SEQ ID NO: 224489 - DNA, 23 bp, Mus musculus
agagagctaatcatatggaaagt

SEQ ID NO: 224490 - DNA, 23 bp, Mus musculus
ttttcattatgaatgctgcattt

SEQ ID NO: 224491 - DNA, 23 bp, Mus musculus
tatgtgagtctctgtctcagaac

SEQ ID NO: 224492 - DNA, 18 bp, Mus musculus
attgtggttggttttcat

SEQ ID NO: 224493 - DNA, 23 bp, Mus musculus
tgaagagcttatagtatcgtgat

SEQ ID NO: 224494 - DNA, 23 bp, Mus musculus
aacagtgtactcttgagtgtgag

SEQ ID NO: 224495 - DNA, 23 bp, Mus musculus
tttttctttctctgcatgttgtt

SEQ ID NO: 224496 - DNA, 19 bp, Mus musculus
attccttttccatctgtag

SEQ ID NO: 224497 - DNA, 19 bp, Mus musculus
attccttttccatctgtag

SEQ ID NO: 224498 - DNA, 23 bp, Mus musculus
agaggaaaggttaagaaaatgag

SEQ ID NO: 224499 - DNA, 22 bp, Mus musculus
ttttgcttgttgatttagcttt

SEQ ID NO: 224500 - DNA, 22 bp, Mus musculus
tatgagtgagggattcatctga

SEQ ID NO: 224501 - DNA, 20 bp, Mus musculus
attttagttgatgcgctcct

SEQ ID NO: 224502 - DNA, 21 bp, Mus musculus
agcacatcagaaagttcgagt

SEQ ID NO: 224503 - DNA, 22 bp, Mus musculus
atgtcagccagctatgaagagg

SEQ ID NO: 224504 - DNA, 23 bp, Mus musculus
gagcatcagctgctggcatcatg

SEQ ID NO: 224505 - DNA, 20 bp, Mus musculus
tgtggaggtcaaaggaaacc

SEQ ID NO: 224506 - DNA, 23 bp, Mus musculus
ctttgtggtggcagtgtgtgtct

SEQ ID NO: 224507 - DNA, 23 bp, Mus musculus
tgcatatgtctatctttcatatg

SEQ ID NO: 224508 - DNA, 23 bp, Mus musculus
tatatatgaaagataaacatatg

SEQ ID NO: 224509 - DNA, 20 bp, Mus musculus
atatgcatatatacatatgt

SEQ ID NO: 224510 - DNA, 22 bp, Mus musculus
atatgtgtgtgtatgtgtatat

SEQ ID NO: 224511 - DNA, 18 bp, Mus musculus
tacatatatatacacata

SEQ ID NO: 224512 - DNA, 21 bp, Mus musculus
aatgcatttacagcacatata

SEQ ID NO: 224513 - DNA, 23 bp, Mus musculus
atgtatgtatgtatgtatgtatg

SEQ ID NO: 224514 - DNA, 19 bp, Mus musculus
agagcttctttctaaatca

SEQ ID NO: 224515 - DNA, 23 bp, Mus musculus
tgtgtctgacactcgcacttaat

SEQ ID NO: 224516 - DNA, 19 bp, Mus musculus
agactggagagatggctca

SEQ ID NO: 224517 - DNA, 23 bp, Mus musculus
tggtggacaactgtttgtgttgt

SEQ ID NO: 224518 - DNA, 23 bp, Mus musculus
tgagagcatgtctcttagttgat

SEQ ID NO: 224519 - DNA, 23 bp, Mus musculus
tctctctcaggctcttagttcag

SEQ ID NO: 224520 - DNA, 23 bp, Mus musculus
tgtctgtctgcatatgattgtgt

SEQ ID NO: 224521 - DNA, 23 bp, Mus musculus
aacattgacactgtttttcttta

SEQ ID NO: 224522 - DNA, 22 bp, Mus musculus
ttcaatgttgaactcatttggt

SEQ ID NO: 224523 - DNA, 23 bp, Mus musculus
gttacagcaagtggtttagatgt

SEQ ID NO: 224524 - DNA, 23 bp, Mus musculus
aacctgtgtcctttgcaagagct

SEQ ID NO: 224525 - DNA, 20 bp, Mus musculus
tgtggtagactaaggacaac

SEQ ID NO: 224526 - DNA, 18 bp, Mus musculus
taccgtgtaggtcctggt

SEQ ID NO: 224527 - DNA, 19 bp, Mus musculus
gtatgtatgtatgtgtgtg

SEQ ID NO: 224528 - DNA, 21 bp, Mus musculus
tgcatctccaattccaaggat

SEQ ID NO: 224529 - DNA, 23 bp, Mus musculus
gtatgtatgtgtgcatgtgtgtc

SEQ ID NO: 224530 - DNA, 23 bp, Mus musculus
gtatgtatgcatgtgtgtctgcg

SEQ ID NO: 224531 - DNA, 23 bp, Mus musculus
tttgtctgtgtatgtctgtgtcc

SEQ ID NO: 224532 - DNA, 18 bp, Mus musculus
tgtgtgtatgtgtgcagt

SEQ ID NO: 224533 - DNA, 20 bp, Mus musculus
tgtgtgcatatagtatgtgt

SEQ ID NO: 224534 - DNA, 23 bp, Mus musculus
tgagtgagtgagtgagtccgagt

SEQ ID NO: 224535 - DNA, 19 bp, Mus musculus
tctctctctctctctctgc

SEQ ID NO: 224536 - DNA, 22 bp, Mus musculus
ccatcagtctgtctattacagt

SEQ ID NO: 224537 - DNA, 23 bp, Mus musculus
acctgtcagtagaaagacagatg

SEQ ID NO: 224538 - DNA, 22 bp, Mus musculus
tgtgactagatggcttcctcta

SEQ ID NO: 224539 - DNA, 20 bp, Mus musculus
atatgtatatatgtatatgt

SEQ ID NO: 224540 - DNA, 21 bp, Mus musculus
tatatacacatatacatatac

SEQ ID NO: 224541 - DNA, 19 bp, Mus musculus
acttcctctgcacctgctg

SEQ ID NO: 224542 - DNA, 22 bp, Mus musculus
tgttttgtgaccaattatatgg

SEQ ID NO: 224543 - DNA, 21 bp, Mus musculus
atgtatgtatgcatgtatatg

SEQ ID NO: 224544 - DNA, 23 bp, Mus musculus
gtgtgtgtgtctgtctgtctgtc

SEQ ID NO: 224545 - DNA, 20 bp, Mus musculus
ttaagtggttaaggaccacg

SEQ ID NO: 224546 - DNA, 23 bp, Mus musculus
tctaactgcaacttgatatgtca

SEQ ID NO: 224547 - DNA, 23 bp, Mus musculus
gactggttgattgctgtgggagc

SEQ ID NO: 224548 - DNA, 23 bp, Mus musculus
agtccaaggtggtctgataggat

SEQ ID NO: 224549 - DNA, 23 bp, Mus musculus
actctgtatctctggatggccta

SEQ ID NO: 224550 - DNA, 18 bp, Mus musculus
agtgatgaaagtgaggag

SEQ ID NO: 224551 - DNA, 19 bp, Mus musculus
attgtccttcgggaaagct

SEQ ID NO: 224552 - DNA, 23 bp, Mus musculus
tgttgtgtgcagctgtgtgcatc

SEQ ID NO: 224553 - DNA, 23 bp, Mus musculus
atatgtgtgtgtatgtatatatg

SEQ ID NO: 224554 - DNA, 23 bp, Mus musculus
atgtatatatgtgtgtgtgtgta

SEQ ID NO: 224555 - DNA, 23 bp, Mus musculus
gatatagaactctcagctacctc

SEQ ID NO: 224556 - DNA, 18 bp, Mus musculus
aagttccaggacagctgg

SEQ ID NO: 224557 - DNA, 22 bp, Mus musculus
aactgtctactccctgggtcta

SEQ ID NO: 224558 - DNA, 22 bp, Mus musculus
tatatgtgtgtgtaaaacatgt

SEQ ID NO: 224559 - DNA, 23 bp, Mus musculus
ctgtatgtgtgtgtggtacagaa

SEQ ID NO: 224560 - DNA, 23 bp, Mus musculus
aagaggactgactgctcttccag

SEQ ID NO: 224561 - DNA, 23 bp, Mus musculus
tttgaaactgtttgctgagccag

SEQ ID NO: 224562 - DNA, 19 bp, Mus musculus
gagaggagactgggagttg

SEQ ID NO: 224563 - DNA, 23 bp, Mus musculus
atgtatgtggactctgtgtatgt

SEQ ID NO: 224564 - DNA, 23 bp, Mus musculus
tctaaataggaatccaaagattt

SEQ ID NO: 224565 - DNA, 23 bp, Mus musculus
tctttctatacttttcagtttcc

SEQ ID NO: 224566 - DNA, 23 bp, Mus musculus
taaactctgattttgtattttgg

SEQ ID NO: 224567 - DNA, 23 bp, Mus musculus
tgtcagactgactcaatctcctg

SEQ ID NO: 224568 - DNA, 23 bp, Mus musculus
ggcaatggttcatgtcagtctgt

SEQ ID NO: 224569 - DNA, 21 bp, Mus musculus
tcttttgctcagtctgatgaa

SEQ ID NO: 224570 - DNA, 20 bp, Mus musculus
atacacacacatatatatgt

SEQ ID NO: 224571 - DNA, 23 bp, Mus musculus
atttatgtgcatagtgtgtatgt

SEQ ID NO: 224572 - DNA, 20 bp, Mus musculus
aggcacaagaagtactcaac

SEQ ID NO: 224573 - DNA, 22 bp, Mus musculus
tatacacacacacatatatgac

SEQ ID NO: 224574 - DNA, 20 bp, Mus musculus
tatgttcactatatatattg

SEQ ID NO: 224575 - DNA, 20 bp, Mus musculus
gaggacactgtctgcagtca

SEQ ID NO: 224576 - DNA, 23 bp, Mus musculus
actctgtctgcatgtccatctgc

SEQ ID NO: 224577 - DNA, 23 bp, Mus musculus
ttgactaaagttgtagagagttg

SEQ ID NO: 224578 - DNA, 23 bp, Mus musculus
gtatgtgcatatgtgtgtgtgtg

SEQ ID NO: 224579 - DNA, 23 bp, Mus musculus
ttatcaaacagcagcctcagtga

SEQ ID NO: 224580 - DNA, 23 bp, Mus musculus
tttgaggtagcatgttctgtaaa

SEQ ID NO: 224581 - DNA, 23 bp, Mus musculus
tacactagtctggttattgattg

SEQ ID NO: 224582 - DNA, 20 bp, Mus musculus
atatacacacatatacatgt

SEQ ID NO: 224583 - DNA, 21 bp, Mus musculus
gaatgcatatttctatgtagc

SEQ ID NO: 224584 - DNA, 20 bp, Mus musculus
tgaagctgccagcttgttga

SEQ ID NO: 224585 - DNA, 19 bp, Mus musculus
gactgatgagactgggggt

SEQ ID NO: 224586 - DNA, 23 bp, Mus musculus
tatactgagagtggtattgtaat

SEQ ID NO: 224587 - DNA, 23 bp, Mus musculus
tcactgaaggcagtctggacagg

SEQ ID NO: 224588 - DNA, 23 bp, Mus musculus
tcagcatcgctctctacagctgt

SEQ ID NO: 224589 - DNA, 20 bp, Mus musculus
aagagcactgactgctcttc

SEQ ID NO: 224590 - DNA, 19 bp, Mus musculus
ttgactgctgggatctttc

SEQ ID NO: 224591 - DNA, 22 bp, Mus musculus
tgttttgtgaccaattatatgg

SEQ ID NO: 224592 - DNA, 21 bp, Mus musculus
atgtatgtgtgcatgtgtttg

SEQ ID NO: 224593 - DNA, 23 bp, Mus musculus
tgtatatgcatatgtatatgtat

SEQ ID NO: 224594 - DNA, 22 bp, Mus musculus
agtcatatcagaatgtatactg

SEQ ID NO: 224595 - DNA, 18 bp, Mus musculus
ggatcatgacttgcagtg

SEQ ID NO: 224596 - DNA, 20 bp, Mus musculus
acaggggtgtgattatctca

SEQ ID NO: 224597 - DNA, 23 bp, Mus musculus
ttaatgtagtaattcctaagaga

SEQ ID NO: 224598 - DNA, 23 bp, Mus musculus
tcaactttgcacattctgcctca

SEQ ID NO: 224599 - DNA, 22 bp, Mus musculus
tgttttgtgaccaattatatgg

SEQ ID NO: 224600 - DNA, 21 bp, Mus musculus
tgtctgtttgtttatatgtac

SEQ ID NO: 224601 - DNA, 23 bp, Mus musculus
gaaagtgagatgataatgacttc

SEQ ID NO: 224602 - DNA, 19 bp, Mus musculus
tgctgcctttgggaatgtt

SEQ ID NO: 224603 - DNA, 23 bp, Mus musculus
agaatagtgacttagttgatctt

SEQ ID NO: 224604 - DNA, 19 bp, Mus musculus
tgagttcatgagtacagtt

SEQ ID NO: 224605 - DNA, 22 bp, Mus musculus
tgttttgtgaccaattatatgg

SEQ ID NO: 224606 - DNA, 18 bp, Mus musculus
tcatttttgtcttacagt

SEQ ID NO: 224607 - DNA, 23 bp, Mus musculus
atatagctgatgtaggacaactg

SEQ ID NO: 224608 - DNA, 22 bp, Mus musculus
tgttttgtgaccaattatatgg

SEQ ID NO: 224609 - DNA, 21 bp, Mus musculus
tctcagtgaggcatttagttg

SEQ ID NO: 224610 - DNA, 23 bp, Mus musculus
tcatggtttgtctttgtggtatg

SEQ ID NO: 224611 - DNA, 23 bp, Mus musculus
gtgtctcagagttttctggtgga

SEQ ID NO: 224612 - DNA, 22 bp, Mus musculus
tgttttgtgaccaattatatgg

SEQ ID NO: 224613 - DNA, 19 bp, Mus musculus
atacatacatatgtgtgtg

SEQ ID NO: 224614 - DNA, 23 bp, Mus musculus
aagacctcagagttctgggatag

SEQ ID NO: 224615 - DNA, 23 bp, Mus musculus
agagctggttggttgtaatgttc

SEQ ID NO: 224616 - DNA, 19 bp, Mus musculus
acatttctgaggcttggtt

SEQ ID NO: 224617 - DNA, 23 bp, Mus musculus
tctcactctgtctgttgttttca

SEQ ID NO: 224618 - DNA, 20 bp, Mus musculus
tgaagacagtgacagagttt

SEQ ID NO: 224619 - DNA, 23 bp, Mus musculus
gtatgtatacatgtatgtatgta

SEQ ID NO: 224620 - DNA, 23 bp, Mus musculus
tgtgtgtgtgtgagtgtgcgtgt

SEQ ID NO: 224621 - DNA, 18 bp, Mus musculus
ttggtggttcactctctg

SEQ ID NO: 224622 - DNA, 23 bp, Mus musculus
tcactcactgtcttggattgtgt

SEQ ID NO: 224623 - DNA, 23 bp, Mus musculus
tctatctatctatctgtgtgtgt

SEQ ID NO: 224624 - DNA, 23 bp, Mus musculus
tatatatatatatggagagagag

SEQ ID NO: 224625 - DNA, 20 bp, Mus musculus
gtgagctggttgtctaggtg

SEQ ID NO: 224626 - DNA, 23 bp, Mus musculus
tcagtgtacagtctcagtgtaca

SEQ ID NO: 224627 - DNA, 19 bp, Mus musculus
agtacacagtctcagtaca

SEQ ID NO: 224628 - DNA, 23 bp, Mus musculus
tcacagaagactgactggtttga

SEQ ID NO: 224629 - DNA, 22 bp, Mus musculus
tttgtttgttgctgaggctgag

SEQ ID NO: 224630 - DNA, 23 bp, Mus musculus
ctgactcagactctggatagctg

SEQ ID NO: 224631 - DNA, 20 bp, Mus musculus
tgtgtgtgtatgtatatatg

SEQ ID NO: 224632 - DNA, 23 bp, Mus musculus
taataacagcaatttattgtatg

SEQ ID NO: 224633 - DNA, 19 bp, Mus musculus
tgtcagtcagtccgtctga

SEQ ID NO: 224634 - DNA, 22 bp, Mus musculus
tagattctaaactagtatggag

SEQ ID NO: 224635 - DNA, 20 bp, Mus musculus
ctgagagcaatagaactcac

SEQ ID NO: 224636 - DNA, 18 bp, Mus musculus
ttttgtcagcttttatgt

SEQ ID NO: 224637 - DNA, 20 bp, Mus musculus
tgctgtgtccttttgcagtg

SEQ ID NO: 224638 - DNA, 19 bp, Mus musculus
ttttctctttcaaagttct

SEQ ID NO: 224639 - DNA, 23 bp, Mus musculus
atctcagagaagggagtgtgagc

SEQ ID NO: 224640 - DNA, 23 bp, Mus musculus
ctcttctctctgtgtgtgcatca

SEQ ID NO: 224641 - DNA, 22 bp, Mus musculus
gagaagaacccgtcctggtgtg

SEQ ID NO: 224642 - DNA, 23 bp, Mus musculus
cagctcctcagttactggtggga

SEQ ID NO: 224643 - DNA, 20 bp, Mus musculus
ccatggtgatctgataggat

SEQ ID NO: 224644 - DNA, 20 bp, Mus musculus
tgttttgtgaccaatacatg

SEQ ID NO: 224645 - DNA, 23 bp, Mus musculus
tatttgcactttcaggaccggct

SEQ ID NO: 224646 - DNA, 23 bp, Mus musculus
ttattttgttattgaagatcagc

SEQ ID NO: 224647 - DNA, 21 bp, Mus musculus
taatccatggtgatctgatag

SEQ ID NO: 224648 - DNA, 21 bp, Mus musculus
atatgtatatgtatatgtgtg

SEQ ID NO: 224649 - DNA, 20 bp, Mus musculus
tatgtatatatcatatgcat

SEQ ID NO: 224650 - DNA, 19 bp, Mus musculus
atatgtatactatatgtac

SEQ ID NO: 224651 - DNA, 23 bp, Mus musculus
tttgaggtaggtgcttgtttaga

SEQ ID NO: 224652 - DNA, 21 bp, Mus musculus
aggagtgtggtttacttgtgt

SEQ ID NO: 224653 - DNA, 23 bp, Mus musculus
tgtgtgtatgtatgtatgtgtgt

SEQ ID NO: 224654 - DNA, 19 bp, Mus musculus
tgtatgctatagtaggggt

SEQ ID NO: 224655 - DNA, 21 bp, Mus musculus
tcccttagtgttgctttggct

SEQ ID NO: 224656 - DNA, 23 bp, Mus musculus
tctctgtgcctctctgtctgtct

SEQ ID NO: 224657 - DNA, 22 bp, Mus musculus
tgttttgtgaccaattatatgg

SEQ ID NO: 224658 - DNA, 23 bp, Mus musculus
ttactgtggtaatgttattcttg

SEQ ID NO: 224659 - DNA, 21 bp, Mus musculus
gatagtcgttttccttatgat

SEQ ID NO: 224660 - DNA, 22 bp, Mus musculus
tgttttgtgaccaattatatgg

SEQ ID NO: 224661 - DNA, 23 bp, Mus musculus
tatcagtgtatatgtatatgtgc

SEQ ID NO: 224662 - DNA, 21 bp, Mus musculus
tccatagtggtctgataggat

SEQ ID NO: 224663 - DNA, 21 bp, Mus musculus
atctgtctgagtcagcttctg

SEQ ID NO: 224664 - DNA, 20 bp, Mus musculus
tttctgggtctcactcagtc

SEQ ID NO: 224665 - DNA, 23 bp, Mus musculus
tgtgtgtgtgtgtgactgagaga

SEQ ID NO: 224666 - DNA, 23 bp, Mus musculus
ataacatccttaatgaagacaaa

SEQ ID NO: 224667 - DNA, 23 bp, Mus musculus
aagaacagatgtttgttcttgtt

SEQ ID NO: 224668 - DNA, 23 bp, Mus musculus
ctcgggagtaagtgtgtcattgt

SEQ ID NO: 224669 - DNA, 23 bp, Mus musculus
gcacgcacacactcacactcaag

SEQ ID NO: 224670 - DNA, 22 bp, Mus musculus
tgttttgtgaccaattatatgg

SEQ ID NO: 224671 - DNA, 23 bp, Mus musculus
tgcatgtatgtatgtatgcacat

SEQ ID NO: 224672 - DNA, 19 bp, Mus musculus
atgtatgtataaatgtaag

SEQ ID NO: 224673 - DNA, 23 bp, Mus musculus
tccaccaagtgtgtgtgtgtgtg

SEQ ID NO: 224674 - DNA, 23 bp, Mus musculus
agaggactgaagagatggctcag

SEQ ID NO: 224675 - DNA, 22 bp, Mus musculus
agctatgttgtgccattcaaca

SEQ ID NO: 224676 - DNA, 22 bp, Mus musculus
agagagttgagagagtccagga

SEQ ID NO: 224677 - DNA, 23 bp, Mus musculus
tacatgtgtgcatgtgtatgtgc

SEQ ID NO: 224678 - DNA, 23 bp, Mus musculus
tgtgtgactctggatgtggaggg

SEQ ID NO: 224679 - DNA, 23 bp, Mus musculus
gtgggatctgtctgtgtctgtgt

SEQ ID NO: 224680 - DNA, 21 bp, Mus musculus
tgagttctgggattgaaggtg

SEQ ID NO: 224681 - DNA, 23 bp, Mus musculus
tgcctgcctgtctgcctgcttgc

SEQ ID NO: 224682 - DNA, 23 bp, Mus musculus
ttcagtctctgtgcctctgtgag

SEQ ID NO: 224683 - DNA, 22 bp, Mus musculus
tgtatagatgcttgagtgaatg

SEQ ID NO: 224684 - DNA, 23 bp, Mus musculus
tgtccatctcactctctgtctct

SEQ ID NO: 224685 - DNA, 23 bp, Mus musculus
tctgtctgtctgtctgtttgggg

SEQ ID NO: 224686 - DNA, 23 bp, Mus musculus
tgtgtgtctgtctgtcattcatc

SEQ ID NO: 224687 - DNA, 21 bp, Mus musculus
tctctctgtctctgggagagt

SEQ ID NO: 224688 - DNA, 19 bp, Mus musculus
tttgtgactgattatatgg

SEQ ID NO: 224689 - DNA, 18 bp, Mus musculus
attgtcatttgagtgctc

SEQ ID NO: 224690 - DNA, 22 bp, Mus musculus
tgttttgtgaccaattatatgg

SEQ ID NO: 224691 - DNA, 22 bp, Mus musculus
ttttagagatttgttgaataca

SEQ ID NO: 224692 - DNA, 23 bp, Mus musculus
gctcactggctcactggctcact

SEQ ID NO: 224693 - DNA, 23 bp, Mus musculus
agtactgagagtggagatagagg

SEQ ID NO: 224694 - DNA, 20 bp, Mus musculus
atacacacacatatgcatta

SEQ ID NO: 224695 - DNA, 18 bp, Mus musculus
cctgagttcaaatgcagc

SEQ ID NO: 224696 - DNA, 22 bp, Mus musculus
tgtatgtatgtttgtatgtaca

SEQ ID NO: 224697 - DNA, 20 bp, Mus musculus
atacatacacatatacatgt

SEQ ID NO: 224698 - DNA, 22 bp, Mus musculus
tgacagtctcagaggatctggt

SEQ ID NO: 224699 - DNA, 18 bp, Mus musculus
acacagagaaatcctgtc

SEQ ID NO: 224700 - DNA, 23 bp, Mus musculus
aactgagtctctgaccctctggg

SEQ ID NO: 224701 - DNA, 23 bp, Mus musculus
acccaatcccctttgtctctctg

SEQ ID NO: 224702 - DNA, 23 bp, Mus musculus
gtctctctgtgtctgtatctccc

SEQ ID NO: 224703 - DNA, 21 bp, Mus musculus
ttacactgtattgtttatgga

SEQ ID NO: 224704 - DNA, 22 bp, Mus musculus
tctctgagccaggcttactgct

SEQ ID NO: 224705 - DNA, 23 bp, Mus musculus
agatagtcaggagaggtaggact

SEQ ID NO: 224706 - DNA, 23 bp, Mus musculus
aaatcaagtagttgggatctgta

SEQ ID NO: 224707 - DNA, 23 bp, Mus musculus
gtatgtatgtatttgtgtatgtg

SEQ ID NO: 224708 - DNA, 23 bp, Mus musculus
gcgagacactcagtggctctgat

SEQ ID NO: 224709 - DNA, 22 bp, Mus musculus
tatatgtatatgtatatgtata

SEQ ID NO: 224710 - DNA, 23 bp, Mus musculus
gtgtgtgtatgtgtatatgtgtg

SEQ ID NO: 224711 - DNA, 23 bp, Mus musculus
ctgtccctcagtgtctctgtcag

SEQ ID NO: 224712 - DNA, 18 bp, Mus musculus
ttcaccatctccttcttg

SEQ ID NO: 224713 - DNA, 22 bp, Mus musculus
gtcccaggctcgctctttggca

SEQ ID NO: 224714 - DNA, 21 bp, Mus musculus
gggagaccctctgtggctgtg

SEQ ID NO: 224715 - DNA, 20 bp, Mus musculus
actgaagacgtggctcagca

SEQ ID NO: 224716 - DNA, 23 bp, Mus musculus
actctctctgtagaccaggctgg

SEQ ID NO: 224717 - DNA, 23 bp, Mus musculus
cacagagatcagtctgtctctgc

SEQ ID NO: 224718 - DNA, 23 bp, Mus musculus
tggagagagaagtctcagaggac

SEQ ID NO: 224719 - DNA, 22 bp, Mus musculus
gctgacttgtgtctgggtctgg

SEQ ID NO: 224720 - DNA, 21 bp, Mus musculus
tcgaggcctggttggtagtgg

SEQ ID NO: 224721 - DNA, 23 bp, Mus musculus
ctcacacacactcagactgactg

SEQ ID NO: 224722 - DNA, 23 bp, Mus musculus
actcggttacctttgaacttgga

SEQ ID NO: 224723 - DNA, 23 bp, Mus musculus
aagagcactgactgctcttccag

SEQ ID NO: 224724 - DNA, 23 bp, Mus musculus
gtgtctgtgtgtgtgtgcatatg

SEQ ID NO: 224725 - DNA, 23 bp, Mus musculus
aactgactgctcttccagaggtc

SEQ ID NO: 224726 - DNA, 22 bp, Mus musculus
acacactctctctaactagttt

SEQ ID NO: 224727 - DNA, 18 bp, Mus musculus
tctatcgctttctagttg

SEQ ID NO: 224728 - DNA, 23 bp, Mus musculus
gctgtctcagactctttgtgcct

SEQ ID NO: 224729 - DNA, 21 bp, Mus musculus
tttcagtcacttcagtctggg

SEQ ID NO: 224730 - DNA, 22 bp, Mus musculus
acttgaatctggatgtggtggt

SEQ ID NO: 224731 - DNA, 19 bp, Mus musculus
tgacgtctgtcagtgtgtg

SEQ ID NO: 224732 - DNA, 23 bp, Mus musculus
agatctctgtgagtctggtttgg

SEQ ID NO: 224733 - DNA, 23 bp, Mus musculus
cagagagaatacactcagtgatc

SEQ ID NO: 224734 - DNA, 23 bp, Mus musculus
cttgtcagcctgactcactgtct

SEQ ID NO: 224735 - DNA, 23 bp, Mus musculus
ccagttagtgctcagcctgcagt

SEQ ID NO: 224736 - DNA, 23 bp, Mus musculus
gagagtgatgtgtccagttaaga

SEQ ID NO: 224737 - DNA, 20 bp, Mus musculus
cagacagtctctgtgcctgg

SEQ ID NO: 224738 - DNA, 21 bp, Mus musculus
tcagatgtgtgtgtgtgtgca

SEQ ID NO: 224739 - DNA, 21 bp, Mus musculus
tctatgtgctgtgtaaactag

SEQ ID NO: 224740 - DNA, 23 bp, Mus musculus
ttatgattcaagattgtgagcag

SEQ ID NO: 224741 - DNA, 23 bp, Mus musculus
ttctgtctcgctcagtttctgcc

SEQ ID NO: 224742 - DNA, 23 bp, Mus musculus
ctgtctctgactctgtgtctgtg

SEQ ID NO: 224743 - DNA, 22 bp, Mus musculus
tgttttgtgaccaattatatgg

SEQ ID NO: 224744 - DNA, 23 bp, Mus musculus
gggtattttattagctggttcct

SEQ ID NO: 224745 - DNA, 22 bp, Mus musculus
atggagtgtttgtttagagtgt

SEQ ID NO: 224746 - DNA, 23 bp, Mus musculus
gggtattttattagctggttcct

SEQ ID NO: 224747 - DNA, 23 bp, Mus musculus
atacaggctccctgattgccact

SEQ ID NO: 224748 - DNA, 22 bp, Mus musculus
tgttttgtgaccaattatatgg

SEQ ID NO: 224749 - DNA, 23 bp, Mus musculus
aaaagaccttatgaaatcacctt

SEQ ID NO: 224750 - DNA, 18 bp, Mus musculus
ttcctggagactctctga

SEQ ID NO: 224751 - DNA, 23 bp, Mus musculus
tgtgtatatgtatgtatatatct

SEQ ID NO: 224752 - DNA, 20 bp, Mus musculus
aagactacagatattgttgt

SEQ ID NO: 224753 - DNA, 21 bp, Mus musculus
tgtctgactgtgggtctctgt

SEQ ID NO: 224754 - DNA, 18 bp, Mus musculus
tccatggtggtatgatag

SEQ ID NO: 224755 - DNA, 22 bp, Mus musculus
tttatgaccaattatatggtca

SEQ ID NO: 224756 - DNA, 23 bp, Mus musculus
tgtacaatgtagacagtggtaca

SEQ ID NO: 224757 - DNA, 18 bp, Mus musculus
gaggttgaaggtagtatt

SEQ ID NO: 224758 - DNA, 20 bp, Mus musculus
atttgatggagatatcccat

SEQ ID NO: 224759 - DNA, 23 bp, Mus musculus
tcactctctgtatgatatctggg

SEQ ID NO: 224760 - DNA, 23 bp, Mus musculus
ttctctcttttggtgtgaagtct

SEQ ID NO: 224761 - DNA, 18 bp, Mus musculus
aaagtgaggcctgacttt

SEQ ID NO: 224762 - DNA, 20 bp, Mus musculus
aggcacacacaaactttata

SEQ ID NO: 224763 - DNA, 20 bp, Mus musculus
tgagtttgcattgagaatgt

SEQ ID NO: 224764 - DNA, 23 bp, Mus musculus
tgagtctgacacattaaagtgtc

SEQ ID NO: 224765 - DNA, 23 bp, Mus musculus
gtcatgtgcatttgtagatctgt

SEQ ID NO: 224766 - DNA, 23 bp, Mus musculus
gtgtctgtctgtctgtctgtctg

SEQ ID NO: 224767 - DNA, 20 bp, Mus musculus
tatgtatgtatgtgtgtatg

SEQ ID NO: 224768 - DNA, 22 bp, Mus musculus
tttaccacacacttgagcctct

SEQ ID NO: 224769 - DNA, 20 bp, Mus musculus
atatgtatatgtatgtgtgt

SEQ ID NO: 224770 - DNA, 20 bp, Mus musculus
agtcactggatgctgacagt

SEQ ID NO: 224771 - DNA, 23 bp, Mus musculus
tgtatgtatgcatgtatgtgtgt

SEQ ID NO: 224772 - DNA, 23 bp, Mus musculus
agaactgactgctcttccagagg

SEQ ID NO: 224773 - DNA, 23 bp, Mus musculus
agagcactgactgctcttcctga

SEQ ID NO: 224774 - DNA, 20 bp, Mus musculus
aagagcactgactgctcttc

SEQ ID NO: 224775 - DNA, 21 bp, Mus musculus
ttcaattctcagcaacgacat

SEQ ID NO: 224776 - DNA, 23 bp, Mus musculus
gctgcctgggtccgtcactggct

SEQ ID NO: 224777 - DNA, 19 bp, Mus musculus
ggggctgaagttctagtgg

SEQ ID NO: 224778 - DNA, 22 bp, Mus musculus
tgttttgtgaccaattatatgg

SEQ ID NO: 224779 - DNA, 22 bp, Mus musculus
ggggctgaagtactagtgagtc

SEQ ID NO: 224780 - DNA, 23 bp, Mus musculus
ctaccactacatgcatttctgat

SEQ ID NO: 224781 - DNA, 23 bp, Mus musculus
tctgcagtctctgtctccctgtc

SEQ ID NO: 224782 - DNA, 23 bp, Mus musculus
agcaaatggactgaggaagtttt

SEQ ID NO: 224783 - DNA, 18 bp, Mus musculus
ctgtcacgttctggtctc

SEQ ID NO: 224784 - DNA, 18 bp, Mus musculus
ctgtcacgttctggtctc

SEQ ID NO: 224785 - DNA, 23 bp, Mus musculus
gccattctgtctgtgtgtgtccc

SEQ ID NO: 224786 - DNA, 18 bp, Mus musculus
ctgtcacgttctggtctc

SEQ ID NO: 224787 - DNA, 22 bp, Mus musculus
tgttttgtgaccaattatatgg

SEQ ID NO: 224788 - DNA, 22 bp, Mus musculus
tgttttgtgaccaattatatgg

SEQ ID NO: 224789 - DNA, 22 bp, Mus musculus
aatgaaccagaaaatggtttga

SEQ ID NO: 224790 - DNA, 22 bp, Mus musculus
tgttttgtgaccaattatatgg

SEQ ID NO: 224791 - DNA, 23 bp, Mus musculus
tagtgcatggtgatctgatagga

SEQ ID NO: 224792 - DNA, 22 bp, Mus musculus
tgttttgtgacctattatgtgg

SEQ ID NO: 224793 - DNA, 19 bp, Mus musculus
ggtagtaaatagagatgtc

SEQ ID NO: 224794 - DNA, 22 bp, Mus musculus
ctttggatgaacaacagctgtt

SEQ ID NO: 224795 - DNA, 23 bp, Mus musculus
tccatggtggtctgataggattc

SEQ ID NO: 224796 - DNA, 22 bp, Mus musculus
tgttttgtgaccaattatatgg

SEQ ID NO: 224797 - DNA, 22 bp, Mus musculus
tgttttgtgaccaattatatgg

SEQ ID NO: 224798 - DNA, 21 bp, Mus musculus
ttttttgctgctatagttaag

SEQ ID NO: 224799 - DNA, 23 bp, Mus musculus
atgtgtgtatttgtacttgtgtg

SEQ ID NO: 224800 - DNA, 23 bp, Mus musculus
tgtgtactgtgtacatttcttgt

SEQ ID NO: 224801 - DNA, 23 bp, Mus musculus
caaatgagatcttgaagaaaagt

SEQ ID NO: 224802 - DNA, 23 bp, Mus musculus
agagatgtctcagtggttaagag

SEQ ID NO: 224803 - DNA, 23 bp, Mus musculus
tatatgcatgtatatatttgcat

SEQ ID NO: 224804 - DNA, 20 bp, Mus musculus
acatgtatatgcatatgatg

SEQ ID NO: 224805 - DNA, 23 bp, Mus musculus
tctgtctgtccctctgtcagctg

SEQ ID NO: 224806 - DNA, 23 bp, Mus musculus
ctgcctgcctgcctgcctgcctg

SEQ ID NO: 224807 - DNA, 23 bp, Mus musculus
cccttctgacattgcttttgctc

SEQ ID NO: 224808 - DNA, 22 bp, Mus musculus
cctgcttctgagagatagccct

SEQ ID NO: 224809 - DNA, 23 bp, Mus musculus
gtctgtcagtctctgtgcctctg

SEQ ID NO: 224810 - DNA, 21 bp, Mus musculus
aatgatcatggcacagcctca

SEQ ID NO: 224811 - DNA, 21 bp, Mus musculus
tatgtatatgtgtgtgtatat

SEQ ID NO: 224812 - DNA, 23 bp, Mus musculus
aactctgagggtgtttctcagca

SEQ ID NO: 224813 - DNA, 23 bp, Mus musculus
tctctgtctgtctgtctacaccc

SEQ ID NO: 224814 - DNA, 23 bp, Mus musculus
tgtgtgcaagcattgtgagagag

SEQ ID NO: 224815 - DNA, 18 bp, Mus musculus
agactcagtattgcatgc

SEQ ID NO: 224816 - DNA, 20 bp, Mus musculus
gcttggtcacagtagtgagt

SEQ ID NO: 224817 - DNA, 23 bp, Mus musculus
aagcattagtggctgttcttcca

SEQ ID NO: 224818 - DNA, 23 bp, Mus musculus
acaccatcttgttttctttacct

SEQ ID NO: 224819 - DNA, 22 bp, Mus musculus
ctcactctcatgctctgtgcta

SEQ ID NO: 224820 - DNA, 23 bp, Mus musculus
tctgtctgtctgtttagggacag

SEQ ID NO: 224821 - DNA, 18 bp, Mus musculus
agagtaatgtggagtaag

SEQ ID NO: 224822 - DNA, 20 bp, Mus musculus
tctcagtccattttatattt

SEQ ID NO: 224823 - DNA, 23 bp, Mus musculus
tatctctctgtctctgtctgtct

SEQ ID NO: 224824 - DNA, 23 bp, Mus musculus
ttcagtgttggtgacacagtctc

SEQ ID NO: 224825 - DNA, 23 bp, Mus musculus
tggctgtcctagaactcactatg

SEQ ID NO: 224826 - DNA, 23 bp, Mus musculus
cagtctctgcctcttgagtgctg

SEQ ID NO: 224827 - DNA, 23 bp, Mus musculus
gtgagcctctctcacacacacag

SEQ ID NO: 224828 - DNA, 22 bp, Mus musculus
cacagtctgtctgtctgtctct

SEQ ID NO: 224829 - DNA, 23 bp, Mus musculus
ggctcactctgtgtgtgtgtgta

SEQ ID NO: 224830 - DNA, 21 bp, Mus musculus
acacagttgaagccatcctgt

SEQ ID NO: 224831 - DNA, 23 bp, Mus musculus
aatacttaagatactgaatgatg

SEQ ID NO: 224832 - DNA, 23 bp, Mus musculus
gagcgctgactgctcttccagag

SEQ ID NO: 224833 - DNA, 19 bp, Mus musculus
actgcccggctattctaag

SEQ ID NO: 224834 - DNA, 20 bp, Mus musculus
ttttgtcagtttgtttttgt

SEQ ID NO: 224835 - DNA, 23 bp, Mus musculus
tcagtctctgtctcaggctatgt

SEQ ID NO: 224836 - DNA, 22 bp, Mus musculus
tctcagtgagtatatgagcata

SEQ ID NO: 224837 - DNA, 21 bp, Mus musculus
tcttaacttctaggtgggaga

SEQ ID NO: 224838 - DNA, 20 bp, Mus musculus
aagagcactgactgctcttc

SEQ ID NO: 224839 - DNA, 22 bp, Mus musculus
tttgtgtacatgtgtacatgtg

SEQ ID NO: 224840 - DNA, 21 bp, Mus musculus
tccatggtggtctgataggat

SEQ ID NO: 224841 - DNA, 22 bp, Mus musculus
tgttttgtgaccaattatatgg

SEQ ID NO: 224842 - DNA, 22 bp, Mus musculus
atggggagtggttatcttcaga

SEQ ID NO: 224843 - DNA, 22 bp, Mus musculus
gtcagttttgcttgtgtagaag

SEQ ID NO: 224844 - DNA, 20 bp, Mus musculus
actcaggctctggctctctt

SEQ ID NO: 224845 - DNA, 22 bp, Mus musculus
aggaccaaaaggagcagtttat

SEQ ID NO: 224846 - DNA, 23 bp, Mus musculus
atgaaactagagacacagctctg

SEQ ID NO: 224847 - DNA, 23 bp, Mus musculus
tagtccatggtgatttgatagga

SEQ ID NO: 224848 - DNA, 21 bp, Mus musculus
ttttatgaccagctatatggt

SEQ ID NO: 224849 - DNA, 23 bp, Mus musculus
tagtccatggtgatctgatagga

SEQ ID NO: 224850 - DNA, 23 bp, Mus musculus
ctttctcagtcacataaagtgtg

SEQ ID NO: 224851 - DNA, 22 bp, Mus musculus
gtccatggtggtctgataggat

SEQ ID NO: 224852 - DNA, 23 bp, Mus musculus
ttgtgaccaattatattgtcaat

SEQ ID NO: 224853 - DNA, 23 bp, Mus musculus
tcaatatttttgtatctgttgag

SEQ ID NO: 224854 - DNA, 23 bp, Mus musculus
tgtttgacagggtttgttgaggg

SEQ ID NO: 224855 - DNA, 21 bp, Mus musculus
tcactcaatggaatgcttgac

SEQ ID NO: 224856 - DNA, 23 bp, Mus musculus
tagtccatggtgatctgatagga

SEQ ID NO: 224857 - DNA, 22 bp, Mus musculus
atcacacccccttttcaagtcc

SEQ ID NO: 224858 - DNA, 19 bp, Mus musculus
tcacagaagagtgggtgga

SEQ ID NO: 224859 - DNA, 23 bp, Mus musculus
tttatgtgcatgtgtttgtgtgt

SEQ ID NO: 224860 - DNA, 23 bp, Mus musculus
caatatttttgtatctgttgaga

SEQ ID NO: 224861 - DNA, 23 bp, Mus musculus
gctgtctgtcacatgctctgtct

SEQ ID NO: 224862 - DNA, 22 bp, Mus musculus
tgttttgtgaccaattatatgg

SEQ ID NO: 224863 - DNA, 23 bp, Mus musculus
tatgtcaatgtctctctctcata

SEQ ID NO: 224864 - DNA, 23 bp, Mus musculus
atatctgcatctctatctctctc

SEQ ID NO: 224865 - DNA, 23 bp, Mus musculus
tagatatagatatagatacgggt

SEQ ID NO: 224866 - DNA, 23 bp, Mus musculus
attgtgacttcatagaatgagtt

SEQ ID NO: 224867 - DNA, 22 bp, Mus musculus
tgttttgtgaccaattatatgg

SEQ ID NO: 224868 - DNA, 23 bp, Mus musculus
atttttttgtagtgttagggagt

SEQ ID NO: 224869 - DNA, 22 bp, Mus musculus
tgttttgtgaccaattatatgg

SEQ ID NO: 224870 - DNA, 21 bp, Mus musculus
tttctctggaatagcatggca

SEQ ID NO: 224871 - DNA, 20 bp, Mus musculus
tgacagaaggcagtctgtag

SEQ ID NO: 224872 - DNA, 22 bp, Mus musculus
tgtaatcatcctacagtgaatc

SEQ ID NO: 224873 - DNA, 21 bp, Mus musculus
tctgtcctgaacagaagatag

SEQ ID NO: 224874 - DNA, 23 bp, Mus musculus
agactgtgggactgtgtttctgg

SEQ ID NO: 224875 - DNA, 18 bp, Mus musculus
ttgatctggtattgctag

SEQ ID NO: 224876 - DNA, 23 bp, Mus musculus
aatataagaacttgtgattgcag

SEQ ID NO: 224877 - DNA, 22 bp, Mus musculus
tgttttgtgaccaattatatgg

SEQ ID NO: 224878 - DNA, 23 bp, Mus musculus
ctgtgtctctgtttagtttctgt

SEQ ID NO: 224879 - DNA, 22 bp, Mus musculus
tgttttgtgaccaattatatgg

SEQ ID NO: 224880 - DNA, 21 bp, Mus musculus
taaggtacaaggttgttctgt

SEQ ID NO: 224881 - DNA, 20 bp, Mus musculus
tgtgtgtatgtgattttgaa

SEQ ID NO: 224882 - DNA, 23 bp, Mus musculus
agatattgcaaatgttcaggata

SEQ ID NO: 224883 - DNA, 22 bp, Mus musculus
tgttttgtgaccaattatatgg

SEQ ID NO: 224884 - DNA, 19 bp, Mus musculus
ctcttgcagggcaggtgca

SEQ ID NO: 224885 - DNA, 22 bp, Mus musculus
tgttttgtgaccaattatatgg

SEQ ID NO: 224886 - DNA, 23 bp, Mus musculus
gttgtggtagttccttctaaact

SEQ ID NO: 224887 - DNA, 22 bp, Mus musculus
tgttttgtgaccaattatatgg

SEQ ID NO: 224888 - DNA, 20 bp, Mus musculus
ttctggaactcactctgtag

SEQ ID NO: 224889 - DNA, 22 bp, Mus musculus
tgttttgtgaccaattatatgg

SEQ ID NO: 224890 - DNA, 22 bp, Mus musculus
tgtgtgtggtacacatatgcat

SEQ ID NO: 224891 - DNA, 23 bp, Mus musculus
tgtatgtatgtatgtatgtatgt

SEQ ID NO: 224892 - DNA, 22 bp, Mus musculus
tgttttgtgaccaattatatgg

SEQ ID NO: 224893 - DNA, 23 bp, Mus musculus
gtgggctggatctatctctggac

SEQ ID NO: 224894 - DNA, 22 bp, Mus musculus
tagtacatggtgatttgatagg

SEQ ID NO: 224895 - DNA, 22 bp, Mus musculus
tgttttgttaccaattatatgg

SEQ ID NO: 224896 - DNA, 23 bp, Mus musculus
gtatctgcatgttcatgtgtgtg

SEQ ID NO: 224897 - DNA, 20 bp, Mus musculus
tctgtctgagtcagctgctg

SEQ ID NO: 224898 - DNA, 23 bp, Mus musculus
tgtatgtatgtatgtgtatgtat

SEQ ID NO: 224899 - DNA, 22 bp, Mus musculus
acagacacacacatatatatgt

SEQ ID NO: 224900 - DNA, 18 bp, Mus musculus
atatgtgtgtgtctgtgt

SEQ ID NO: 224901 - DNA, 22 bp, Mus musculus
tgttttgtgaccaattatatgg

SEQ ID NO: 224902 - DNA, 23 bp, Mus musculus
tctgtctgtctgtctgtctgtct

SEQ ID NO: 224903 - DNA, 18 bp, Mus musculus
tgtgtctgtgtgtgggcc

SEQ ID NO: 224904 - DNA, 19 bp, Mus musculus
acagcacaggctttgctct

SEQ ID NO: 224905 - DNA, 23 bp, Mus musculus
gtctcagtgggtatgaattcctt

SEQ ID NO: 224906 - DNA, 23 bp, Mus musculus
tcactgaacacagagaggtcaag

SEQ ID NO: 224907 - DNA, 21 bp, Mus musculus
ttgactactgttcagtgtatg

SEQ ID NO: 224908 - DNA, 22 bp, Mus musculus
tgttttgtgaccaattatatgg

SEQ ID NO: 224909 - DNA, 23 bp, Mus musculus
atagtccttgtgattttcttgtt

SEQ ID NO: 224910 - DNA, 22 bp, Mus musculus
tgttttgtgaccaattatatgg

SEQ ID NO: 224911 - DNA, 23 bp, Mus musculus
actcactggctcagtgtttccct

SEQ ID NO: 224912 - DNA, 22 bp, Mus musculus
tgttttgtgaccaattatatgg

SEQ ID NO: 224913 - DNA, 22 bp, Mus musculus
ttttgagttaggatcattttgc

SEQ ID NO: 224914 - DNA, 22 bp, Mus musculus
tgttttgtgaccaattatatgg

SEQ ID NO: 224915 - DNA, 22 bp, Mus musculus
tgttttgtgaccaattatatgg

SEQ ID NO: 224916 - DNA, 20 bp, Mus musculus
agaattagagtttcttataa

SEQ ID NO: 224917 - DNA, 22 bp, Mus musculus
tttgtgactgagataaggaatt

SEQ ID NO: 224918 - DNA, 19 bp, Mus musculus
taattctgaatggttaaga

SEQ ID NO: 224919 - DNA, 22 bp, Mus musculus
atcatcttagccattctgactg

SEQ ID NO: 224920 - DNA, 23 bp, Mus musculus
ctctgccactctgtgtctctgtg

SEQ ID NO: 224921 - DNA, 22 bp, Mus musculus
tgttttgtgaccaattatatgg

SEQ ID NO: 224922 - DNA, 23 bp, Mus musculus
cagtctgtgactgtctttgtcct

SEQ ID NO: 224923 - DNA, 22 bp, Mus musculus
ttggtcagttattttgctgagt

SEQ ID NO: 224924 - DNA, 23 bp, Mus musculus
acatcagtgtctattgtggatgt

SEQ ID NO: 224925 - DNA, 22 bp, Mus musculus
atttgctatgaaatcatgtttg

SEQ ID NO: 224926 - DNA, 23 bp, Mus musculus
atctgtctgtctatttgtctgtc

SEQ ID NO: 224927 - DNA, 20 bp, Mus musculus
agagagaacacagagggcag

SEQ ID NO: 224928 - DNA, 22 bp, Mus musculus
tgttttgtgaccaattatatgg

SEQ ID NO: 224929 - DNA, 21 bp, Mus musculus
tttctgcttgggtgtattcat

SEQ ID NO: 224930 - DNA, 23 bp, Mus musculus
atatgttcttctgattagtgtgg

SEQ ID NO: 224931 - DNA, 23 bp, Mus musculus
ttgtaccttgtaaattgtgatat

SEQ ID NO: 224932 - DNA, 22 bp, Mus musculus
tgttttgtgaccaattatatgg

SEQ ID NO: 224933 - DNA, 23 bp, Mus musculus
agtccatggtgatctgataggtt

SEQ ID NO: 224934 - DNA, 22 bp, Mus musculus
acccattatatggtcaattttg

SEQ ID NO: 224935 - DNA, 23 bp, Mus musculus
tgtgtgtctgtttgtcaattcat

SEQ ID NO: 224936 - DNA, 20 bp, Mus musculus
acagaaagtagtctgcacag

SEQ ID NO: 224937 - DNA, 23 bp, Mus musculus
agtccatggtgatctgataggtt

SEQ ID NO: 224938 - DNA, 22 bp, Mus musculus
acccattatatggtcaattttg

SEQ ID NO: 224939 - DNA, 23 bp, Mus musculus
atctcattttgttgtagtattgc

SEQ ID NO: 224940 - DNA, 23 bp, Mus musculus
agtccatggtgatctgataggtt

SEQ ID NO: 224941 - DNA, 22 bp, Mus musculus
acccattatatggtcaattttg

SEQ ID NO: 224942 - DNA, 21 bp, Mus musculus
gatgtcagtgacaatgattcc

SEQ ID NO: 224943 - DNA, 22 bp, Mus musculus
tgttttgtgaccaattatatgg

SEQ ID NO: 224944 - DNA, 23 bp, Mus musculus
agtccatggtgatctgataggtt

SEQ ID NO: 224945 - DNA, 22 bp, Mus musculus
acccattatatggtcaattttg

SEQ ID NO: 224946 - DNA, 23 bp, Mus musculus
tgatgtctgagagcttacctgtt

SEQ ID NO: 224947 - DNA, 22 bp, Mus musculus
tctcttatggtagagttgggga

SEQ ID NO: 224948 - DNA, 22 bp, Mus musculus
tgttttgtgaccaattatatgg

SEQ ID NO: 224949 - DNA, 20 bp, Mus musculus
tcacagaactgagtgacttg

SEQ ID NO: 224950 - DNA, 23 bp, Mus musculus
tgatgtctgagagcttacctgtt

SEQ ID NO: 224951 - DNA, 22 bp, Mus musculus
tgttttgtgaccaattatatgg

SEQ ID NO: 224952 - DNA, 23 bp, Mus musculus
tctgtggttgttgcttctatatt

SEQ ID NO: 224953 - DNA, 23 bp, Mus musculus
tctgtggttgttgcttctatatt

SEQ ID NO: 224954 - DNA, 22 bp, Mus musculus
tttctgactgactatctctgtc

SEQ ID NO: 224955 - DNA, 20 bp, Mus musculus
catgaatgtagagggcctag

SEQ ID NO: 224956 - DNA, 23 bp, Mus musculus
tctgtggttgttgcttctatatt

SEQ ID NO: 224957 - DNA, 23 bp, Mus musculus
tctgtggttgttgcttctatatt

SEQ ID NO: 224958 - DNA, 23 bp, Mus musculus
tctgtggttgttgcttctatatt

SEQ ID NO: 224959 - DNA, 20 bp, Mus musculus
catgaatgtagagggcctag

SEQ ID NO: 224960 - DNA, 23 bp, Mus musculus
tctgtggttgttgcttctatatt

SEQ ID NO: 224961 - DNA, 23 bp, Mus musculus
tctgtggttgttgcttctatatt

SEQ ID NO: 224962 - DNA, 22 bp, Mus musculus
tccttgtcagaggagagtctgc

SEQ ID NO: 224963 - DNA, 23 bp, Mus musculus
tgatgtctgagagcttacctgtt

SEQ ID NO: 224964 - DNA, 22 bp, Mus musculus
tctcttatggtagagttgggga

SEQ ID NO: 224965 - DNA, 23 bp, Mus musculus
tctgtggttgttgcttctatatt

SEQ ID NO: 224966 - DNA, 23 bp, Mus musculus
tctgtggttgttgcttctatatt

SEQ ID NO: 224967 - DNA, 22 bp, Mus musculus
tgttttgtgaccaattatatgg

SEQ ID NO: 224968 - DNA, 23 bp, Mus musculus
cagtgcctgtgtcagtgcctgtg

SEQ ID NO: 224969 - DNA, 23 bp, Mus musculus
ttcagatccagtgattttgttgt

SEQ ID NO: 224970 - DNA, 21 bp, Mus musculus
tgattctttttgaaaaagatg

SEQ ID NO: 224971 - DNA, 23 bp, Mus musculus
actcactggctctgatactaaag

SEQ ID NO: 224972 - DNA, 22 bp, Mus musculus
agaagacccaggttcaattctc

SEQ ID NO: 224973 - DNA, 23 bp, Mus musculus
tgtctcagaggttaagagcactg

SEQ ID NO: 224974 - DNA, 23 bp, Mus musculus
gcctctctctgccagtgctcaca

SEQ ID NO: 224975 - DNA, 23 bp, Mus musculus
gcctctctctgccagtgctcaca

SEQ ID NO: 224976 - DNA, 23 bp, Mus musculus
tgcctctctctgccagtgctctc

SEQ ID NO: 224977 - DNA, 23 bp, Mus musculus
gcctctctctgccagtgctcaca

SEQ ID NO: 224978 - DNA, 23 bp, Mus musculus
gcctctctctgccagtgctcaca

SEQ ID NO: 224979 - DNA, 21 bp, Mus musculus
tatctagctcaagtggtggtg

SEQ ID NO: 224980 - DNA, 23 bp, Mus musculus
gcctctctctgccagtgctcaca

SEQ ID NO: 224981 - DNA, 23 bp, Mus musculus
tgcctctctctgccagtgctctc

SEQ ID NO: 224982 - DNA, 18 bp, Mus musculus
agtttgcttcccagtgtc

SEQ ID NO: 224983 - DNA, 22 bp, Mus musculus
tcaaacttgatgtggtggcgct

SEQ ID NO: 224984 - DNA, 22 bp, Mus musculus
tgtgcatgcatgtgtacgtgta

SEQ ID NO: 224985 - DNA, 20 bp, Mus musculus
gtgtgtggctttgaggtttc

SEQ ID NO: 224986 - DNA, 21 bp, Mus musculus
tccatggtggtctgataggat

SEQ ID NO: 224987 - DNA, 22 bp, Mus musculus
tgttttgtgaccaattatatgg

SEQ ID NO: 224988 - DNA, 23 bp, Mus musculus
gagtgtgtctgtggctctgacag

SEQ ID NO: 224989 - DNA, 23 bp, Mus musculus
gagtgtgtctgtggctctgacag

SEQ ID NO: 224990 - DNA, 18 bp, Mus musculus
tggtgcagggactggaga

SEQ ID NO: 224991 - DNA, 20 bp, Mus musculus
tctgtttttgttattctgag

SEQ ID NO: 224992 - DNA, 22 bp, Mus musculus
tgttttgtgaccaattatatgg

SEQ ID NO: 224993 - DNA, 18 bp, Mus musculus
accctttaggaggcttag

SEQ ID NO: 224994 - DNA, 22 bp, Mus musculus
tgtcaggatctggtagagcctc

SEQ ID NO: 224995 - DNA, 22 bp, Mus musculus
tgttttgtgaccaattatatgg

SEQ ID NO: 224996 - DNA, 22 bp, Mus musculus
tgttttgtgaccaattatatgg

SEQ ID NO: 224997 - DNA, 23 bp, Mus musculus
tctctgactgtgtcttatcactc

SEQ ID NO: 224998 - DNA, 23 bp, Mus musculus
acagctgtatttgtactcctggg

SEQ ID NO: 224999 - DNA, 23 bp, Mus musculus
agcatgtctattgtttttgtcct

SEQ ID NO: 225000 - DNA, 19 bp, Mus musculus
ataggtgtagtttctgata

SEQ ID NO: 225001 - DNA, 23 bp, Mus musculus
tagtgcatggtgatctgatagga

SEQ ID NO: 225002 - DNA, 21 bp, Mus musculus
tgttttgtgaccaattatgtg

SEQ ID NO: 225003 - DNA, 22 bp, Mus musculus
tgttttgtgaccaattatatgg

SEQ ID NO: 225004 - DNA, 23 bp, Mus musculus
gtatgtatgtatgtatgtatgta

SEQ ID NO: 225005 - DNA, 22 bp, Mus musculus
atatgtgcatgtatataccttt

SEQ ID NO: 225006 - DNA, 23 bp, Mus musculus
tactctgtgtctttttattgggg

SEQ ID NO: 225007 - DNA, 23 bp, Mus musculus
atgtgtatgagtatatgtatgtg

SEQ ID NO: 225008 - DNA, 21 bp, Mus musculus
actcagtaactgtttaaccag

SEQ ID NO: 225009 - DNA, 22 bp, Mus musculus
tgttttgtgaccaattatatgg

SEQ ID NO: 225010 - DNA, 22 bp, Mus musculus
tgttttgtgaccaattatatgg

SEQ ID NO: 225011 - DNA, 23 bp, Mus musculus
agcaatacttttatatttggagg

SEQ ID NO: 225012 - DNA, 23 bp, Mus musculus
tgttttgtgaccaattatatggt

SEQ ID NO: 225013 - DNA, 23 bp, Mus musculus
agactctctgagaggttactagt

SEQ ID NO: 225014 - DNA, 22 bp, Mus musculus
tgttttgtgaccaattatatgg

SEQ ID NO: 225015 - DNA, 23 bp, Mus musculus
tttggatttcttcaggatctgtt

SEQ ID NO: 225016 - DNA, 22 bp, Mus musculus
tgttttgtgaccaattatatgg

SEQ ID NO: 225017 - DNA, 22 bp, Mus musculus
tgttttgtgaccaattatatgg

SEQ ID NO: 225018 - DNA, 22 bp, Mus musculus
agatttacagacagaattccct

SEQ ID NO: 225019 - DNA, 20 bp, Mus musculus
ttctctgtgttaatcactgt

SEQ ID NO: 225020 - DNA, 23 bp, Mus musculus
tttcacatgaaggtttggagatg

SEQ ID NO: 225021 - DNA, 23 bp, Mus musculus
actgccagaggcacagtttaggg

SEQ ID NO: 225022 - DNA, 22 bp, Mus musculus
tgcagtagaatgttaattagat

SEQ ID NO: 225023 - DNA, 23 bp, Mus musculus
taatgtctctgccttagcactgt

SEQ ID NO: 225024 - DNA, 23 bp, Mus musculus
tgtatgtatatgtatatatgagt

SEQ ID NO: 225025 - DNA, 20 bp, Mus musculus
gcaagaaggacagttaggct

SEQ ID NO: 225026 - DNA, 23 bp, Mus musculus
tctgtacctctctgactgacagc

SEQ ID NO: 225027 - DNA, 23 bp, Mus musculus
agtcctagtcttgtgtctttctc

SEQ ID NO: 225028 - DNA, 19 bp, Mus musculus
ttgcatgtcctagaactca

SEQ ID NO: 225029 - DNA, 23 bp, Mus musculus
agggtctcacactgtggctcagg

SEQ ID NO: 225030 - DNA, 23 bp, Mus musculus
ttggaaatcactgtgtatcccag

SEQ ID NO: 225031 - DNA, 23 bp, Mus musculus
ctgcctctgtctctgtctccaga

SEQ ID NO: 225032 - DNA, 23 bp, Mus musculus
tgtgtgtctgtgtatgtacacag

SEQ ID NO: 225033 - DNA, 22 bp, Mus musculus
tttagtggtacatacttgtgat

SEQ ID NO: 225034 - DNA, 22 bp, Mus musculus
tgttttgtgaccaattatatgg

SEQ ID NO: 225035 - DNA, 23 bp, Mus musculus
gtgtactggatgttttgtctgtg

SEQ ID NO: 225036 - DNA, 21 bp, Mus musculus
tatgtggtaattcagatggca

SEQ ID NO: 225037 - DNA, 23 bp, Mus musculus
tgaccctgagattaagtcttatg

SEQ ID NO: 225038 - DNA, 23 bp, Mus musculus
ttggagtaagaggtaaagttcat

SEQ ID NO: 225039 - DNA, 20 bp, Mus musculus
acacacacacatatacatat

SEQ ID NO: 225040 - DNA, 20 bp, Mus musculus
atatatgtatatgtatgtgt

SEQ ID NO: 225041 - DNA, 18 bp, Mus musculus
agagcaagaaatccaatg

SEQ ID NO: 225042 - DNA, 23 bp, Mus musculus
tctctggatgtcttctgtatgtg

SEQ ID NO: 225043 - DNA, 22 bp, Mus musculus
tgcagcaggtactgttcacaca

SEQ ID NO: 225044 - DNA, 22 bp, Mus musculus
tgagaacatggtgacatgtact

SEQ ID NO: 225045 - DNA, 22 bp, Mus musculus
tgttttgtgaccaattatatgg

SEQ ID NO: 225046 - DNA, 22 bp, Mus musculus
tatgcatgcgtgcatgttagtg

SEQ ID NO: 225047 - DNA, 22 bp, Mus musculus
tgttttgtgaccaattatatgg

SEQ ID NO: 225048 - DNA, 21 bp, Mus musculus
atgtatacacacacacacata

SEQ ID NO: 225049 - DNA, 18 bp, Mus musculus
cattgaggtttctatttc

SEQ ID NO: 225050 - DNA, 23 bp, Mus musculus
aaaggagtaggaatactgtgagt

SEQ ID NO: 225051 - DNA, 22 bp, Mus musculus
tgttttgtgaccaattatatgg

SEQ ID NO: 225052 - DNA, 23 bp, Mus musculus
tagtccatggtgatctgatagga

SEQ ID NO: 225053 - DNA, 22 bp, Mus musculus
tgttttgtgaccaattatatgg

SEQ ID NO: 225054 - DNA, 22 bp, Mus musculus
tgttttgtgaccaattatatgg

SEQ ID NO: 225055 - DNA, 23 bp, Mus musculus
cactgcctccctccctgtctgtc

SEQ ID NO: 225056 - DNA, 22 bp, Mus musculus
atcataggatctgatgatgatt

SEQ ID NO: 225057 - DNA, 23 bp, Mus musculus
tatatgcaagtttagatctgtgt

SEQ ID NO: 225058 - DNA, 22 bp, Mus musculus
gttggtagtgatctgataggat

SEQ ID NO: 225059 - DNA, 23 bp, Mus musculus
tttgtgaccaattctattgtcaa

SEQ ID NO: 225060 - DNA, 22 bp, Mus musculus
actgttgagactttcttcttgt

SEQ ID NO: 225061 - DNA, 21 bp, Mus musculus
tgagaagaaggtattttcttg

SEQ ID NO: 225062 - DNA, 18 bp, Mus musculus
gagagggacacagagcct

SEQ ID NO: 225063 - DNA, 23 bp, Mus musculus
ttcatctgtgattttgttgaaca

SEQ ID NO: 225064 - DNA, 21 bp, Mus musculus
tccatggtggtcagataggat

SEQ ID NO: 225065 - DNA, 22 bp, Mus musculus
tgttttgtgaccaattatatgg

SEQ ID NO: 225066 - DNA, 23 bp, Mus musculus
cactcctactctcactgtcatgt

SEQ ID NO: 225067 - DNA, 22 bp, Mus musculus
tgttttgtgaccaattatatgg

SEQ ID NO: 225068 - DNA, 23 bp, Mus musculus
attagatgaggaattgtgtttaa

SEQ ID NO: 225069 - DNA, 20 bp, Mus musculus
atgtatatgtatatgtatgt

SEQ ID NO: 225070 - DNA, 18 bp, Mus musculus
attgttacaactggcagc

SEQ ID NO: 225071 - DNA, 21 bp, Mus musculus
tccatggtggtctgataggat

SEQ ID NO: 225072 - DNA, 22 bp, Mus musculus
tcttttgtgaccaattatatgg

SEQ ID NO: 225073 - DNA, 23 bp, Mus musculus
ttggatgtgttgttatgcatctg

SEQ ID NO: 225074 - DNA, 22 bp, Mus musculus
ttccaagttttccaagtgtcac

SEQ ID NO: 225075 - DNA, 23 bp, Mus musculus
gtctctgaatctgtttctgtcag

SEQ ID NO: 225076 - DNA, 18 bp, Mus musculus
aacctggtcagtccctgt

SEQ ID NO: 225077 - DNA, 19 bp, Mus musculus
tttcagggctgaccgtttg

SEQ ID NO: 225078 - DNA, 22 bp, Mus musculus
atatgtgtgtgtacatatactg

SEQ ID NO: 225079 - DNA, 23 bp, Mus musculus
aagtttctggaagatgtctgtgt

SEQ ID NO: 225080 - DNA, 22 bp, Mus musculus
tgttttgtgaccaattatatgg

SEQ ID NO: 225081 - DNA, 23 bp, Mus musculus
tagtccatgatgacctgatagga

SEQ ID NO: 225082 - DNA, 23 bp, Mus musculus
aatatttttgtatctgttaaggc

SEQ ID NO: 225083 - DNA, 21 bp, Mus musculus
tctctctctctctctccaggc

SEQ ID NO: 225084 - DNA, 22 bp, Mus musculus
aagtttggagtaagggctagga

SEQ ID NO: 225085 - DNA, 23 bp, Mus musculus
tgggtgcatgggtgtttatcttc

SEQ ID NO: 225086 - DNA, 23 bp, Mus musculus
atgaaagtggtaagctattgaga

SEQ ID NO: 225087 - DNA, 20 bp, Mus musculus
tgtgcctgacatatgtatgt

SEQ ID NO: 225088 - DNA, 18 bp, Mus musculus
tgagaggacaagctcggg

SEQ ID NO: 225089 - DNA, 18 bp, Mus musculus
tatctctatgtcatttag

SEQ ID NO: 225090 - DNA, 22 bp, Mus musculus
atcagtttttctttatctgagt

SEQ ID NO: 225091 - DNA, 20 bp, Mus musculus
tgaactctgactctctgtga

SEQ ID NO: 225092 - DNA, 23 bp, Mus musculus
aaactatatatatatatgtgtgt

SEQ ID NO: 225093 - DNA, 23 bp, Mus musculus
tgacgttgtatgttgtattagtt

SEQ ID NO: 225094 - DNA, 23 bp, Mus musculus
tagcagcatcagagttctgtggt

SEQ ID NO: 225095 - DNA, 22 bp, Mus musculus
tttcagtctatagtccaggttg

SEQ ID NO: 225096 - DNA, 23 bp, Mus musculus
aaacagcattgctcatttgttta

SEQ ID NO: 225097 - DNA, 20 bp, Mus musculus
acactaaatagatacagtag

SEQ ID NO: 225098 - DNA, 23 bp, Mus musculus
gtatgtgtgcatgtgcttgtgct

SEQ ID NO: 225099 - DNA, 22 bp, Mus musculus
atgtgtgcatgtgtgtgtgcgt

SEQ ID NO: 225100 - DNA, 21 bp, Mus musculus
ttgagtttctttctttataca

SEQ ID NO: 225101 - DNA, 20 bp, Mus musculus
ccctagatccacctgaatgt

SEQ ID NO: 225102 - DNA, 21 bp, Mus musculus
ttaagagcactgactgctctt

SEQ ID NO: 225103 - DNA, 22 bp, Mus musculus
tgttttgtgaccaattatatgg

SEQ ID NO: 225104 - DNA, 22 bp, Mus musculus
tgttttgtgaccaattatatgg

SEQ ID NO: 225105 - DNA, 21 bp, Mus musculus
ttcaatatttttgtatctgct

SEQ ID NO: 225106 - DNA, 20 bp, Mus musculus
tatatatgtatacatacata

SEQ ID NO: 225107 - DNA, 23 bp, Mus musculus
acacacacacaggttagggaggg

SEQ ID NO: 225108 - DNA, 23 bp, Mus musculus
cttgtctgtctgctaaggtggtt

SEQ ID NO: 225109 - DNA, 23 bp, Mus musculus
aatgtaaagatcattgtgtccgc

SEQ ID NO: 225110 - DNA, 22 bp, Mus musculus
atacgtatatatgtgtatgtgt

SEQ ID NO: 225111 - DNA, 19 bp, Mus musculus
tgtgtgtgtgtgtgtgtgt

SEQ ID NO: 225112 - DNA, 20 bp, Mus musculus
tatatttctttaggttgggg

SEQ ID NO: 225113 - DNA, 23 bp, Mus musculus
agtcaggttctgatttgggttag

SEQ ID NO: 225114 - DNA, 23 bp, Mus musculus
tctcaggatggtaatgtaatgga

SEQ ID NO: 225115 - DNA, 18 bp, Mus musculus
tgaatgaaacacacacac

SEQ ID NO: 225116 - DNA, 23 bp, Mus musculus
ttagtcagggtttctattcctgc

SEQ ID NO: 225117 - DNA, 19 bp, Mus musculus
aactctgtattttgattgg

SEQ ID NO: 225118 - DNA, 23 bp, Mus musculus
taagagcactgactgctcttcca

SEQ ID NO: 225119 - DNA, 22 bp, Mus musculus
atgtatatatatatatgtgtgt

SEQ ID NO: 225120 - DNA, 23 bp, Mus musculus
taaacacacacacatatatatgt

SEQ ID NO: 225121 - DNA, 22 bp, Mus musculus
tagcctattgttctctttctca

SEQ ID NO: 225122 - DNA, 18 bp, Mus musculus
ttgtatgtatatatgtat

SEQ ID NO: 225123 - DNA, 22 bp, Mus musculus
gtatgtatgtatgtatgtatgt

SEQ ID NO: 225124 - DNA, 20 bp, Mus musculus
aatggctttgaagataggag

SEQ ID NO: 225125 - DNA, 18 bp, Mus musculus
atgaaagaagtttaagca

SEQ ID NO: 225126 - DNA, 18 bp, Mus musculus
tgaggtagaagcatgcat

SEQ ID NO: 225127 - DNA, 23 bp, Mus musculus
ggctctctgtctctttctcaaag

SEQ ID NO: 225128 - DNA, 23 bp, Mus musculus
cactgtgtgagtgagactgactt

SEQ ID NO: 225129 - DNA, 21 bp, Mus musculus
tctggctctggctcttttctg

SEQ ID NO: 225130 - DNA, 20 bp, Mus musculus
tgagaggctgtttttgtagt

SEQ ID NO: 225131 - DNA, 22 bp, Mus musculus
acgcagtcacagtaagacttgt

SEQ ID NO: 225132 - DNA, 23 bp, Mus musculus
acactttggtcttctttgttctt

SEQ ID NO: 225133 - DNA, 22 bp, Mus musculus
tgttttgtgaccaattatatgg

SEQ ID NO: 225134 - DNA, 23 bp, Mus musculus
atcctcagacagcttagcttcag

SEQ ID NO: 225135 - DNA, 23 bp, Mus musculus
aatgtgcatgtgcatgtttgtgt

SEQ ID NO: 225136 - DNA, 22 bp, Mus musculus
atagggtatgcttgtatataca

SEQ ID NO: 225137 - DNA, 21 bp, Mus musculus
aacacactcactctatcccgt

SEQ ID NO: 225138 - DNA, 23 bp, Mus musculus
tgctgagagtggagatagaggtc

SEQ ID NO: 225139 - DNA, 22 bp, Mus musculus
tgttttgtgaccaattatatgg

SEQ ID NO: 225140 - DNA, 23 bp, Mus musculus
tgctgagagtggagatagaggtc

SEQ ID NO: 225141 - DNA, 20 bp, Mus musculus
tggagcgggatctcttaagc

SEQ ID NO: 225142 - DNA, 20 bp, Mus musculus
tctgtcagtcagtctgcctg

SEQ ID NO: 225143 - DNA, 18 bp, Mus musculus
ccactgggtttgtgtctg

SEQ ID NO: 225144 - DNA, 21 bp, Mus musculus
tctgaaatgtcattttgatgt

SEQ ID NO: 225145 - DNA, 22 bp, Mus musculus
tgttttgtgaccaattatatgg

SEQ ID NO: 225146 - DNA, 21 bp, Mus musculus
tgcatatatgtactttatgta

SEQ ID NO: 225147 - DNA, 23 bp, Mus musculus
ctattgcactgtctgtgtcactg

SEQ ID NO: 225148 - DNA, 21 bp, Mus musculus
tgcctctcaccctgtttccca

SEQ ID NO: 225149 - DNA, 20 bp, Mus musculus
acacacatacacacacatat

SEQ ID NO: 225150 - DNA, 20 bp, Mus musculus
tcagtggttgaattattacc

SEQ ID NO: 225151 - DNA, 23 bp, Mus musculus
tcggcctcagtttgaggtgtgtg

SEQ ID NO: 225152 - DNA, 23 bp, Mus musculus
cagtctctctgtgagttcaaggc

SEQ ID NO: 225153 - DNA, 23 bp, Mus musculus
tttatgtaagggttacttggaca

SEQ ID NO: 225154 - DNA, 18 bp, Mus musculus
gagtttggctgggtatag

SEQ ID NO: 225155 - DNA, 23 bp, Mus musculus
tctcagtgtctgtataacatctg

SEQ ID NO: 225156 - DNA, 19 bp, Mus musculus
tcctacaagtcttgcctca

SEQ ID NO: 225157 - DNA, 21 bp, Mus musculus
gggcctcactctgtgagtctg

SEQ ID NO: 225158 - DNA, 23 bp, Mus musculus
tgttctctgtagattctgaacac

SEQ ID NO: 225159 - DNA, 21 bp, Mus musculus
agagtagaaacaaggattggg

SEQ ID NO: 225160 - DNA, 21 bp, Mus musculus
tccatggtggtctgataggat

SEQ ID NO: 225161 - DNA, 23 bp, Mus musculus
ttatcagtggaagttttctggtc

SEQ ID NO: 225162 - DNA, 19 bp, Mus musculus
tttgaggagctagagagat

SEQ ID NO: 225163 - DNA, 23 bp, Mus musculus
ctgactgctcttgcagaggtcct

SEQ ID NO: 225164 - DNA, 22 bp, Mus musculus
tgtgtcactctgtgtgcgggct

SEQ ID NO: 225165 - DNA, 22 bp, Mus musculus
tgttttgtgaccaattatatgg

SEQ ID NO: 225166 - DNA, 23 bp, Mus musculus
tgtgagtagaatgcagtttggaa

SEQ ID NO: 225167 - DNA, 19 bp, Mus musculus
aaacagagagagaatgagc

SEQ ID NO: 225168 - DNA, 21 bp, Mus musculus
tctgtctcagtcagctgttgg

SEQ ID NO: 225169 - DNA, 22 bp, Mus musculus
tgttttgtgaccaattatatgg

SEQ ID NO: 225170 - DNA, 20 bp, Mus musculus
tgcctgtctgtcatcatggt

SEQ ID NO: 225171 - DNA, 22 bp, Mus musculus
tgtataagtgattttgttgtgg

SEQ ID NO: 225172 - DNA, 23 bp, Mus musculus
acaatcactctcatacagttgac

SEQ ID NO: 225173 - DNA, 22 bp, Mus musculus
tgttttgtgaccaattatatgg

SEQ ID NO: 225174 - DNA, 19 bp, Mus musculus
tgtctggtgatcaggactt

SEQ ID NO: 225175 - DNA, 23 bp, Mus musculus
tggtggtctgatagaatacatgg

SEQ ID NO: 225176 - DNA, 20 bp, Mus musculus
tatttttgtatctattgagg

SEQ ID NO: 225177 - DNA, 23 bp, Mus musculus
ttaagagcactgactgctcttcc

SEQ ID NO: 225178 - DNA, 23 bp, Mus musculus
tatgcatctctgtgtctctgtct

SEQ ID NO: 225179 - DNA, 21 bp, Mus musculus
tgattgtgcacatggagatca

SEQ ID NO: 225180 - DNA, 22 bp, Mus musculus
tccatggtggtctgataggatg

SEQ ID NO: 225181 - DNA, 22 bp, Mus musculus
tgttttgtgaccaattatatgg

SEQ ID NO: 225182 - DNA, 22 bp, Mus musculus
taagagcactgactgctcttct

SEQ ID NO: 225183 - DNA, 22 bp, Mus musculus
ggctatggttcaagaatgatta

SEQ ID NO: 225184 - DNA, 21 bp, Mus musculus
tactgactgctcttccagagg

SEQ ID NO: 225185 - DNA, 19 bp, Mus musculus
ttatcacaaggctatacaa

SEQ ID NO: 225186 - DNA, 22 bp, Mus musculus
atatgtatgtatatatatgtat

SEQ ID NO: 225187 - DNA, 22 bp, Mus musculus
tgttttgtgaccaattatatgg

SEQ ID NO: 225188 - DNA, 22 bp, Mus musculus
tgttttgtgaccaattatatgg

SEQ ID NO: 225189 - DNA, 23 bp, Mus musculus
aaccagagaattaatgatgagtt

SEQ ID NO: 225190 - DNA, 21 bp, Mus musculus
tcaggctctgtcagagcctct

SEQ ID NO: 225191 - DNA, 23 bp, Mus musculus
tgtaacaccatctgcttctggat

SEQ ID NO: 225192 - DNA, 22 bp, Mus musculus
atatgcatgtatgtatgtgtga

SEQ ID NO: 225193 - DNA, 22 bp, Mus musculus
tgttttgtgaccaattatatgg

SEQ ID NO: 225194 - DNA, 19 bp, Mus musculus
aaaggtactgagttcaaat

SEQ ID NO: 225195 - DNA, 23 bp, Mus musculus
tgtgtgtttcacagtctctctct

SEQ ID NO: 225196 - DNA, 21 bp, Mus musculus
tccgtggtgatctgataggat

SEQ ID NO: 225197 - DNA, 23 bp, Mus musculus
ttttgtgaccaattctatggtca

SEQ ID NO: 225198 - DNA, 22 bp, Mus musculus
tgttttgtgaccaattatatgg

SEQ ID NO: 225199 - DNA, 23 bp, Mus musculus
tctctctcacacagatatgtcag

SEQ ID NO: 225200 - DNA, 23 bp, Mus musculus
actggagagcaaatgaatcctta

SEQ ID NO: 225201 - DNA, 21 bp, Mus musculus
atatgtaggagttccagtctt

SEQ ID NO: 225202 - DNA, 22 bp, Mus musculus
tgttttgtgaccaattatatgg

SEQ ID NO: 225203 - DNA, 22 bp, Mus musculus
tgttttgtgaccaattatatgg

SEQ ID NO: 225204 - DNA, 21 bp, Mus musculus
atatgtgtatatgtatatatg

SEQ ID NO: 225205 - DNA, 23 bp, Mus musculus
tgtctgtgagtctctgcctctgc

SEQ ID NO: 225206 - DNA, 22 bp, Mus musculus
tgttttgtgaccaattatatgg

SEQ ID NO: 225207 - DNA, 23 bp, Mus musculus
aaagaataactaaagccatgcat

SEQ ID NO: 225208 - DNA, 23 bp, Mus musculus
gatgtgtcgctccctgattggct

SEQ ID NO: 225209 - DNA, 19 bp, Mus musculus
catggtggtctgataggat

SEQ ID NO: 225210 - DNA, 22 bp, Mus musculus
tgttttgtgaccaattatatgg

SEQ ID NO: 225211 - DNA, 22 bp, Mus musculus
tgttttgtgaccaattatatgg

SEQ ID NO: 225212 - DNA, 19 bp, Mus musculus
atggtggtctgataggatg

SEQ ID NO: 225213 - DNA, 22 bp, Mus musculus
tgttttgtgaccaattatatgg

SEQ ID NO: 225214 - DNA, 23 bp, Mus musculus
tgtcaggctctgtcagagcctct

SEQ ID NO: 225215 - DNA, 21 bp, Mus musculus
acacttcttggcattcacagt

SEQ ID NO: 225216 - DNA, 23 bp, Mus musculus
tagtgcatggtgatctgatagga

SEQ ID NO: 225217 - DNA, 22 bp, Mus musculus
tgttttgtgacctattatgtgg

SEQ ID NO: 225218 - DNA, 18 bp, Mus musculus
gctggcactctgtattcc

SEQ ID NO: 225219 - DNA, 21 bp, Mus musculus
aatatagtctgggtctgttct

SEQ ID NO: 225220 - DNA, 23 bp, Mus musculus
caatatttttgtatctgttgagg

SEQ ID NO: 225221 - DNA, 22 bp, Mus musculus
tgttttgtgaccaattatatgg

SEQ ID NO: 225222 - DNA, 23 bp, Mus musculus
tgtgtctgtgtctgtctgtcacc

SEQ ID NO: 225223 - DNA, 23 bp, Mus musculus
agactgagctcagagaccacatt

SEQ ID NO: 225224 - DNA, 23 bp, Mus musculus
tgtgcatatgcatattatatgca

SEQ ID NO: 225225 - DNA, 23 bp, Mus musculus
tgttacagcatctggaagtggca

SEQ ID NO: 225226 - DNA, 18 bp, Mus musculus
tagaagatatagtgatca

SEQ ID NO: 225227 - DNA, 19 bp, Mus musculus
tgtagtagtagcttgtaat

SEQ ID NO: 225228 - DNA, 22 bp, Mus musculus
tgttttgtgaccaattatatgg

SEQ ID NO: 225229 - DNA, 22 bp, Mus musculus
aactctggaaaacctgcctttg

SEQ ID NO: 225230 - DNA, 21 bp, Mus musculus
gagagagagacagacagacag

SEQ ID NO: 225231 - DNA, 23 bp, Mus musculus
ggagaggctctgtcagtgcctga

SEQ ID NO: 225232 - DNA, 23 bp, Mus musculus
tatatgtgtgtgtgtgtgcgtgt

SEQ ID NO: 225233 - DNA, 21 bp, Mus musculus
ttatcatatgttgatagttca

SEQ ID NO: 225234 - DNA, 22 bp, Mus musculus
tgttttgtgaccaattatatgg

SEQ ID NO: 225235 - DNA, 23 bp, Mus musculus
ttctatgttgttgatgggctgaa

SEQ ID NO: 225236 - DNA, 23 bp, Mus musculus
gaatattaatgtagttaggggat

SEQ ID NO: 225237 - DNA, 20 bp, Mus musculus
atatgtgtatatgtatatgt

SEQ ID NO: 225238 - DNA, 22 bp, Mus musculus
atgtgtgcatgtttgtgtacac

SEQ ID NO: 225239 - DNA, 22 bp, Mus musculus
acacacacacacatacaggagt

SEQ ID NO: 225240 - DNA, 23 bp, Mus musculus
ggagagttctcagggtccaggtt

SEQ ID NO: 225241 - DNA, 20 bp, Mus musculus
ttgagactgtggctcctcct

SEQ ID NO: 225242 - DNA, 23 bp, Mus musculus
gctctgtggctctctccttccca

SEQ ID NO: 225243 - DNA, 22 bp, Mus musculus
tgttttgtgaccaattatatgg

SEQ ID NO: 225244 - DNA, 23 bp, Mus musculus
gttagcatgttcaagtctttgga

SEQ ID NO: 225245 - DNA, 23 bp, Mus musculus
agactctctgggtccctgtgtct

SEQ ID NO: 225246 - DNA, 18 bp, Mus musculus
aaagcatggatgaatgac

SEQ ID NO: 225247 - DNA, 22 bp, Mus musculus
tgttttgtgaccaattatatgg

SEQ ID NO: 225248 - DNA, 23 bp, Mus musculus
tgttttgtgaccaattatgttgt

SEQ ID NO: 225249 - DNA, 22 bp, Mus musculus
tgttttgtgaccaattatatgg

SEQ ID NO: 225250 - DNA, 22 bp, Mus musculus
atcagtgaagagagtgtgtatt

SEQ ID NO: 225251 - DNA, 23 bp, Mus musculus
tctcaaaggatttcaaatgtcta

SEQ ID NO: 225252 - DNA, 23 bp, Mus musculus
tctctctctctctctctcaaaca

SEQ ID NO: 225253 - DNA, 23 bp, Mus musculus
aaacatagttcttcatatgtcca

SEQ ID NO: 225254 - DNA, 22 bp, Mus musculus
tgttttgtgaccaattatatgg

SEQ ID NO: 225255 - DNA, 23 bp, Mus musculus
taatagtcaatgtatggtgtatg

SEQ ID NO: 225256 - DNA, 23 bp, Mus musculus
agagaagttactcagcagacctt

SEQ ID NO: 225257 - DNA, 22 bp, Mus musculus
tgttttgtgaccaattatatgg

SEQ ID NO: 225258 - DNA, 21 bp, Mus musculus
cagagtctcatcttccagaat

SEQ ID NO: 225259 - DNA, 23 bp, Mus musculus
tgagagatgtgtgtctccactag

SEQ ID NO: 225260 - DNA, 23 bp, Mus musculus
ctcagtctctgattcatgtttgc

SEQ ID NO: 225261 - DNA, 23 bp, Mus musculus
tctctgcttcactatctgtatct

SEQ ID NO: 225262 - DNA, 18 bp, Mus musculus
ttggctatgtgaacgatt

SEQ ID NO: 225263 - DNA, 23 bp, Mus musculus
actcttctgatatagttcttgtt

SEQ ID NO: 225264 - DNA, 22 bp, Mus musculus
tgttttgtgaccaattatatgg

SEQ ID NO: 225265 - DNA, 22 bp, Mus musculus
tctgtgtgtctgtgtgtgcaag

SEQ ID NO: 225266 - DNA, 21 bp, Mus musculus
tgcatgtggaaagagtgtgtg

SEQ ID NO: 225267 - DNA, 19 bp, Mus musculus
agtggtttgtgagcagatt

SEQ ID NO: 225268 - DNA, 23 bp, Mus musculus
tattgactgtcacaaacctttgt

SEQ ID NO: 225269 - DNA, 23 bp, Mus musculus
tatgtgtggttgtcagttcttgg

SEQ ID NO: 225270 - DNA, 21 bp, Mus musculus
tgacttgtgcctgtgattcct

SEQ ID NO: 225271 - DNA, 22 bp, Mus musculus
agatcactaggtccaatccact

SEQ ID NO: 225272 - DNA, 23 bp, Mus musculus
tagtccatgatggtctgatagga

SEQ ID NO: 225273 - DNA, 23 bp, Mus musculus
caatatttttgtatctgttgagg

SEQ ID NO: 225274 - DNA, 20 bp, Mus musculus
tgtctgtcttgtgaacatgt

SEQ ID NO: 225275 - DNA, 22 bp, Mus musculus
tgtcagagtgaacagtaggcag

SEQ ID NO: 225276 - DNA, 23 bp, Mus musculus
tgtgtgtgtctctgtgtgcttgt

SEQ ID NO: 225277 - DNA, 22 bp, Mus musculus
tgttttgtgaccaattatatgg

SEQ ID NO: 225278 - DNA, 23 bp, Mus musculus
tatatgcatgtgtacatgtatgt

SEQ ID NO: 225279 - DNA, 18 bp, Mus musculus
tatatatgtgtatatgta

SEQ ID NO: 225280 - DNA, 22 bp, Mus musculus
tgttttgtgaccaattatatgg

SEQ ID NO: 225281 - DNA, 23 bp, Mus musculus
tggctctggctctggctctggct

SEQ ID NO: 225282 - DNA, 23 bp, Mus musculus
tcttttaatgcctggtactgagg

SEQ ID NO: 225283 - DNA, 22 bp, Mus musculus
tgttttgtgaccaattatatgg

SEQ ID NO: 225284 - DNA, 23 bp, Mus musculus
tcatgatatactttggcatctgt

SEQ ID NO: 225285 - DNA, 23 bp, Mus musculus
tctctgtgcctctgtctctctct

SEQ ID NO: 225286 - DNA, 22 bp, Mus musculus
tgttttgtgaccaattatatgg

SEQ ID NO: 225287 - DNA, 23 bp, Mus musculus
tcactcaggaaaagatatggata

SEQ ID NO: 225288 - DNA, 20 bp, Mus musculus
agttcatttattgttgtaca

SEQ ID NO: 225289 - DNA, 18 bp, Mus musculus
gaatgtgtgcaagttctt

SEQ ID NO: 225290 - DNA, 23 bp, Mus musculus
aacacactttgtatatctgtgta

SEQ ID NO: 225291 - DNA, 23 bp, Mus musculus
tgtgtgtgtgtatgtgcatgtgg

SEQ ID NO: 225292 - DNA, 23 bp, Mus musculus
ggtttcagtctctgtgtgtgtga

SEQ ID NO: 225293 - DNA, 18 bp, Mus musculus
acacacacaacacaaacc

SEQ ID NO: 225294 - DNA, 22 bp, Mus musculus
gacagttgggagtcagcacagg

SEQ ID NO: 225295 - DNA, 19 bp, Mus musculus
agcccatgagtctttactg

SEQ ID NO: 225296 - DNA, 20 bp, Mus musculus
ttcacaaaccccttagtgta

SEQ ID NO: 225297 - DNA, 21 bp, Mus musculus
catctctctggtctagttctc

SEQ ID NO: 225298 - DNA, 21 bp, Mus musculus
ttatcatggcagacacagtgc

SEQ ID NO: 225299 - DNA, 22 bp, Mus musculus
taacatcatgctcagtgatgaa

SEQ ID NO: 225300 - DNA, 23 bp, Mus musculus
atcagtgggataagaaagtgtgt

SEQ ID NO: 225301 - DNA, 23 bp, Mus musculus
gtctgtgcatgctttttgtgact

SEQ ID NO: 225302 - DNA, 23 bp, Mus musculus
tcctgactgctcttccagaggtc

SEQ ID NO: 225303 - DNA, 23 bp, Mus musculus
ttactagtattgcagttttccct

SEQ ID NO: 225304 - DNA, 23 bp, Mus musculus
aggaaggcttagtagtgtgtcat

SEQ ID NO: 225305 - DNA, 19 bp, Mus musculus
tactggaaggtcaaagtat

SEQ ID NO: 225306 - DNA, 21 bp, Mus musculus
ttactcagtgagcttatgatg

SEQ ID NO: 225307 - DNA, 18 bp, Mus musculus
tgtgctttatcttgggag

SEQ ID NO: 225308 - DNA, 21 bp, Mus musculus
tatgtgcatatacatatatgt

SEQ ID NO: 225309 - DNA, 20 bp, Mus musculus
atatgtatacatatacatct

SEQ ID NO: 225310 - DNA, 23 bp, Mus musculus
tgactgtagagagtgctctgacc

SEQ ID NO: 225311 - DNA, 20 bp, Mus musculus
gaaatgttttgtttaaaaag

SEQ ID NO: 225312 - DNA, 23 bp, Mus musculus
aacctgcatctctctctctctct

SEQ ID NO: 225313 - DNA, 23 bp, Mus musculus
tctctctctctctcacacacaca

SEQ ID NO: 225314 - DNA, 23 bp, Mus musculus
aacctgcatctctctctctctct

SEQ ID NO: 225315 - DNA, 23 bp, Mus musculus
aacctgcatctctctctctctct

SEQ ID NO: 225316 - DNA, 23 bp, Mus musculus
aacctgcatctctctctctctct

SEQ ID NO: 225317 - DNA, 23 bp, Mus musculus
cagagcatgtctctctctctatg

SEQ ID NO: 225318 - DNA, 23 bp, Mus musculus
cacacagtttgtctctctctgtg

SEQ ID NO: 225319 - DNA, 23 bp, Mus musculus
tgtgtgtctgcatgtgcatgtgc

SEQ ID NO: 225320 - DNA, 23 bp, Mus musculus
tatgcatatatatctgtatatgt

SEQ ID NO: 225321 - DNA, 22 bp, Mus musculus
tgttttgtgaccaattatatgg

SEQ ID NO: 225322 - DNA, 20 bp, Mus musculus
ctgtccattgatgaaagtgg

SEQ ID NO: 225323 - DNA, 23 bp, Mus musculus
gccaggcagtctctctctgtcac

SEQ ID NO: 225324 - DNA, 22 bp, Mus musculus
tgttttgtgaccaattatatgg

SEQ ID NO: 225325 - DNA, 23 bp, Mus musculus
tagtccatggtgatctgatagga

SEQ ID NO: 225326 - DNA, 18 bp, Mus musculus
tccatggtgatctgatgt

SEQ ID NO: 225327 - DNA, 23 bp, Mus musculus
gatcaaatatatggtcaattatg

SEQ ID NO: 225328 - DNA, 23 bp, Mus musculus
gtgaggtagatgcatgtattagt

SEQ ID NO: 225329 - DNA, 23 bp, Mus musculus
ctgtgacaaacaccaaaccaatt

SEQ ID NO: 225330 - DNA, 18 bp, Mus musculus
ttccagcttgaggggatt

SEQ ID NO: 225331 - DNA, 20 bp, Mus musculus
gtctagttcttgaatttagt

SEQ ID NO: 225332 - DNA, 22 bp, Mus musculus
tgttttgtgaccaattatatgg

SEQ ID NO: 225333 - DNA, 23 bp, Mus musculus
tgctgagagtggagatagaggtc

SEQ ID NO: 225334 - DNA, 21 bp, Mus musculus
agcttagtacattcaaaagag

SEQ ID NO: 225335 - DNA, 23 bp, Mus musculus
tcttgagttattgttttactgat

SEQ ID NO: 225336 - DNA, 22 bp, Mus musculus
tacaagtagaggggaaagttga

SEQ ID NO: 225337 - DNA, 23 bp, Mus musculus
tatgtatgtatgtatatatgtat

SEQ ID NO: 225338 - DNA, 18 bp, Mus musculus
tcagtgggttatgacagt

SEQ ID NO: 225339 - DNA, 21 bp, Mus musculus
aactcactgatcacactgtgg

SEQ ID NO: 225340 - DNA, 19 bp, Mus musculus
ttcactttccttgttgaac

SEQ ID NO: 225341 - DNA, 21 bp, Mus musculus
tgtgtcgctccctgattggct

SEQ ID NO: 225342 - DNA, 21 bp, Mus musculus
tgtgtcgctccctgattggct

SEQ ID NO: 225343 - DNA, 23 bp, Mus musculus
ggttctcagaggaatcttgactg

SEQ ID NO: 225344 - DNA, 21 bp, Mus musculus
tggctggcactctgtattcca

SEQ ID NO: 225345 - DNA, 21 bp, Mus musculus
tatttgtttctgtgaaaacag

SEQ ID NO: 225346 - DNA, 23 bp, Mus musculus
ttagtccttggtgattgtatagg

SEQ ID NO: 225347 - DNA, 22 bp, Mus musculus
tgttttgtgaccaattatatgg

SEQ ID NO: 225348 - DNA, 22 bp, Mus musculus
tgttttgtgaccaattatatgg

SEQ ID NO: 225349 - DNA, 21 bp, Mus musculus
tgtgtcgctccctgattggct

SEQ ID NO: 225350 - DNA, 23 bp, Mus musculus
tctcagtctctctctctgcatcc

SEQ ID NO: 225351 - DNA, 18 bp, Mus musculus
gctggcactctgtattcc

SEQ ID NO: 225352 - DNA, 20 bp, Mus musculus
taccacactgataaccatag

SEQ ID NO: 225353 - DNA, 21 bp, Mus musculus
tttctgcatctaatgagatga

SEQ ID NO: 225354 - DNA, 23 bp, Mus musculus
ctctctctttgccactgcatcaa

SEQ ID NO: 225355 - DNA, 23 bp, Mus musculus
tgagatttgaaattgttgttgag

SEQ ID NO: 225356 - DNA, 23 bp, Mus musculus
tagtccatgatgatctgatagtt

SEQ ID NO: 225357 - DNA, 21 bp, Mus musculus
ttgaccaattatatggtcagt

SEQ ID NO: 225358 - DNA, 23 bp, Mus musculus
ttttactaaggaaatgaagagtc

SEQ ID NO: 225359 - DNA, 23 bp, Mus musculus
tgtgaggtagtatctgtctctat

SEQ ID NO: 225360 - DNA, 22 bp, Mus musculus
tgttttgtgaccaattatatgg

SEQ ID NO: 225361 - DNA, 20 bp, Mus musculus
ctgttcacacacacacacac

SEQ ID NO: 225362 - DNA, 20 bp, Mus musculus
tggtggtctgataggattca

SEQ ID NO: 225363 - DNA, 20 bp, Mus musculus
aaatatttcatgaagtagaa

SEQ ID NO: 225364 - DNA, 22 bp, Mus musculus
tgttttgtgaccaattatatgg

SEQ ID NO: 225365 - DNA, 22 bp, Mus musculus
tgttttgtgaccaattatatgg

SEQ ID NO: 225366 - DNA, 23 bp, Mus musculus
ggtcagtgtttatgttgctcctt

SEQ ID NO: 225367 - DNA, 21 bp, Mus musculus
tttgtctctctctgtcttagg

SEQ ID NO: 225368 - DNA, 23 bp, Mus musculus
ggaatctcaagtcattttgattt

SEQ ID NO: 225369 - DNA, 23 bp, Mus musculus
gtcagtctctgagtgtcaccaag

SEQ ID NO: 225370 - DNA, 22 bp, Mus musculus
tgttttgtgaccaattatatgg

SEQ ID NO: 225371 - DNA, 23 bp, Mus musculus
ttttttctgaatatgttgttctg

SEQ ID NO: 225372 - DNA, 22 bp, Mus musculus
tgttttgtgaccaattatatgg

SEQ ID NO: 225373 - DNA, 20 bp, Mus musculus
tattcctatatgtgcatata

SEQ ID NO: 225374 - DNA, 23 bp, Mus musculus
ttatcctccatcagaaatctcag

SEQ ID NO: 225375 - DNA, 22 bp, Mus musculus
gtgtcctgaaacttagtgtaca

SEQ ID NO: 225376 - DNA, 22 bp, Mus musculus
aatgctaacaaatgctttgtca

SEQ ID NO: 225377 - DNA, 23 bp, Mus musculus
tagtccatggtgatctgatagga

SEQ ID NO: 225378 - DNA, 21 bp, Mus musculus
tgttttgttaccaattatatg

SEQ ID NO: 225379 - DNA, 23 bp, Mus musculus
ttaaggatagatttgaaaagttg

SEQ ID NO: 225380 - DNA, 21 bp, Mus musculus
tgtgtatgtatgtatatatat

SEQ ID NO: 225381 - DNA, 19 bp, Mus musculus
atgcatatatacatgaatc

SEQ ID NO: 225382 - DNA, 23 bp, Mus musculus
tagtccaaggtgatctgatagga

SEQ ID NO: 225383 - DNA, 23 bp, Mus musculus
gtgtgtgtgtgtgtgtgtacacg

SEQ ID NO: 225384 - DNA, 23 bp, Mus musculus
tatgtgtgtgtgtgtgtgtacac

SEQ ID NO: 225385 - DNA, 23 bp, Mus musculus
tctactctgtttgatcttgtgtc

SEQ ID NO: 225386 - DNA, 23 bp, Mus musculus
tgtcagggtcgttttgatctgta

SEQ ID NO: 225387 - DNA, 23 bp, Mus musculus
aatcactgtgtaaatctctctgg

SEQ ID NO: 225388 - DNA, 23 bp, Mus musculus
gtgtatgtgtgtttgtatatatg

SEQ ID NO: 225389 - DNA, 23 bp, Mus musculus
atgtattgtgtatgtattatgtg

SEQ ID NO: 225390 - DNA, 22 bp, Mus musculus
tatatatgctaatcaaatctgt

SEQ ID NO: 225391 - DNA, 22 bp, Mus musculus
gcgcgtgtgtgtgtgcgtgtgt

SEQ ID NO: 225392 - DNA, 23 bp, Mus musculus
aagaagcagcagataatggtaat

SEQ ID NO: 225393 - DNA, 22 bp, Mus musculus
tttttgtgacatgttaacttgg

SEQ ID NO: 225394 - DNA, 23 bp, Mus musculus
cttgtcattttcttattctattc

SEQ ID NO: 225395 - DNA, 22 bp, Mus musculus
tgagtactagcctaaggcagaa

SEQ ID NO: 225396 - DNA, 23 bp, Mus musculus
acagtatcagataaagattagat

SEQ ID NO: 225397 - DNA, 23 bp, Mus musculus
ctctgtctgtctgtctgtctgtc

SEQ ID NO: 225398 - DNA, 21 bp, Mus musculus
ttaggcttgatactggaaaga

SEQ ID NO: 225399 - DNA, 23 bp, Mus musculus
tttttgcagtagtattcatttga

SEQ ID NO: 225400 - DNA, 18 bp, Mus musculus
aggattatgactatgcag

SEQ ID NO: 225401 - DNA, 23 bp, Mus musculus
agaggtcagtgtcactgtcagtg

SEQ ID NO: 225402 - DNA, 22 bp, Mus musculus
tgttttgtgaccaattatatgg

SEQ ID NO: 225403 - DNA, 19 bp, Mus musculus
acagctggtcaattcgcat

SEQ ID NO: 225404 - DNA, 23 bp, Mus musculus
tcaggtccttggttgtattgtac

SEQ ID NO: 225405 - DNA, 22 bp, Mus musculus
tgttttgtgaccaattatatgg

SEQ ID NO: 225406 - DNA, 23 bp, Mus musculus
tattatgatgatgatgatgatga

SEQ ID NO: 225407 - DNA, 19 bp, Mus musculus
aattctctctctaactctc

SEQ ID NO: 225408 - DNA, 22 bp, Mus musculus
tgttttgtgaccaattatatgg

SEQ ID NO: 225409 - DNA, 22 bp, Mus musculus
tgacacagcagagagagatgag

SEQ ID NO: 225410 - DNA, 23 bp, Mus musculus
aacccaaactctgtctgctgact

SEQ ID NO: 225411 - DNA, 23 bp, Mus musculus
cactctgtgactctgttagttca

SEQ ID NO: 225412 - DNA, 23 bp, Mus musculus
catttcacacagtgctttcttgt

SEQ ID NO: 225413 - DNA, 23 bp, Mus musculus
agtacaggatttcatatgagtga

SEQ ID NO: 225414 - DNA, 23 bp, Mus musculus
tctgtctgtctgtgtccctagtc

SEQ ID NO: 225415 - DNA, 22 bp, Mus musculus
tgttttgtgaccaattatatgg

SEQ ID NO: 225416 - DNA, 19 bp, Mus musculus
atgtgtatgatatgtgtat

SEQ ID NO: 225417 - DNA, 19 bp, Mus musculus
ttttatgtatatgaatgtg

SEQ ID NO: 225418 - DNA, 20 bp, Mus musculus
ttttgcttatttatgcattt

SEQ ID NO: 225419 - DNA, 22 bp, Mus musculus
tatcacaaagtagtttattgag

SEQ ID NO: 225420 - DNA, 22 bp, Mus musculus
taattacttctttcagagtcag

SEQ ID NO: 225421 - DNA, 23 bp, Mus musculus
gaatcatctgagagtcaaatttc

SEQ ID NO: 225422 - DNA, 18 bp, Mus musculus
aaacacacatttatactt

SEQ ID NO: 225423 - DNA, 18 bp, Mus musculus
tttgggaccctttcttgt

SEQ ID NO: 225424 - DNA, 19 bp, Mus musculus
aacaaaagtagaatcagca

SEQ ID NO: 225425 - DNA, 23 bp, Mus musculus
tgtgtgaatgtgtgtctgtgtgt

SEQ ID NO: 225426 - DNA, 23 bp, Mus musculus
tagtccatggtgatatgatagga

SEQ ID NO: 225427 - DNA, 22 bp, Mus musculus
tgttttgtgaccaattatatgg

SEQ ID NO: 225428 - DNA, 23 bp, Mus musculus
gcctcagaggctctgtggctctc

SEQ ID NO: 225429 - DNA, 23 bp, Mus musculus
tgtctgtgtttgtgtctgtgaga

SEQ ID NO: 225430 - DNA, 23 bp, Mus musculus
actgtgtctctgtttagttcctg

SEQ ID NO: 225431 - DNA, 21 bp, Mus musculus
atctgtgcattgatgagagtg

SEQ ID NO: 225432 - DNA, 23 bp, Mus musculus
tttatgcttgtagaatctaacaa

SEQ ID NO: 225433 - DNA, 20 bp, Mus musculus
tgtgtctttctctttattgt

SEQ ID NO: 225434 - DNA, 20 bp, Mus musculus
atgagagaacattgactgct

SEQ ID NO: 225435 - DNA, 19 bp, Mus musculus
aaagttcaatatgtcatca

SEQ ID NO: 225436 - DNA, 22 bp, Mus musculus
cttagtccatggtgatctgata

SEQ ID NO: 225437 - DNA, 23 bp, Mus musculus
tatctacatctacatatatgtat

SEQ ID NO: 225438 - DNA, 23 bp, Mus musculus
gtaaattggatagttaacaaaag

SEQ ID NO: 225439 - DNA, 23 bp, Mus musculus
acctagatggttctattgttctg

SEQ ID NO: 225440 - DNA, 22 bp, Mus musculus
tgttttgtgaccaattatatgg

SEQ ID NO: 225441 - DNA, 22 bp, Mus musculus
tgttttgtgaccaattatatgg

SEQ ID NO: 225442 - DNA, 22 bp, Mus musculus
tgttttgtgaccaattatatgg

SEQ ID NO: 225443 - DNA, 21 bp, Mus musculus
tgtgtgtgtgtatatatgcat

SEQ ID NO: 225444 - DNA, 19 bp, Mus musculus
tgtgtatgtatgcatatac

SEQ ID NO: 225445 - DNA, 23 bp, Mus musculus
tatatgtatatgtacatgtatat

SEQ ID NO: 225446 - DNA, 23 bp, Mus musculus
tgtctctgtcatacatgattgta

SEQ ID NO: 225447 - DNA, 18 bp, Mus musculus
ccatggaccaattcatgt

SEQ ID NO: 225448 - DNA, 18 bp, Mus musculus
tgtgtgtgtataagcata

SEQ ID NO: 225449 - DNA, 23 bp, Mus musculus
tatggtgtatgcatatgtacata

SEQ ID NO: 225450 - DNA, 22 bp, Mus musculus
tatatgcatatgttttgtgcat

SEQ ID NO: 225451 - DNA, 23 bp, Mus musculus
tgtatgtatatgtgtatgtgtat

SEQ ID NO: 225452 - DNA, 19 bp, Mus musculus
aattgccactggaagtcct

SEQ ID NO: 225453 - DNA, 23 bp, Mus musculus
tagtgcatggtgatctgataggg

SEQ ID NO: 225454 - DNA, 22 bp, Mus musculus
tgttttgtgaccaattatatgg

SEQ ID NO: 225455 - DNA, 22 bp, Mus musculus
acaggaatttaatagtaattta

SEQ ID NO: 225456 - DNA, 18 bp, Mus musculus
atgcatgtatgtgttatg

SEQ ID NO: 225457 - DNA, 23 bp, Mus musculus
tattgtgtgtatatgtgtatgtg

SEQ ID NO: 225458 - DNA, 22 bp, Mus musculus
tgttttgtgaccaattatatgg

SEQ ID NO: 225459 - DNA, 23 bp, Mus musculus
agtcaggctcagtggctcactgt

SEQ ID NO: 225460 - DNA, 23 bp, Mus musculus
ctgtctctgtcagtccattagca

SEQ ID NO: 225461 - DNA, 23 bp, Mus musculus
tcatcactgaaggaagtcaggac

SEQ ID NO: 225462 - DNA, 19 bp, Mus musculus
agagagatagagatataga

SEQ ID NO: 225463 - DNA, 23 bp, Mus musculus
aactggtcagtgtgtagtgattg

SEQ ID NO: 225464 - DNA, 22 bp, Mus musculus
tgtctctgtcagtgacttcttg

SEQ ID NO: 225465 - DNA, 21 bp, Mus musculus
aaaacatgtttagctatgcaa

SEQ ID NO: 225466 - DNA, 23 bp, Mus musculus
ttttaacaatttgtttatatcag

SEQ ID NO: 225467 - DNA, 22 bp, Mus musculus
gtaactggtttagtattcaatg

SEQ ID NO: 225468 - DNA, 20 bp, Mus musculus
atagtgtgtgtatatgtata

SEQ ID NO: 225469 - DNA, 21 bp, Mus musculus
tatatagatagatatatagat

SEQ ID NO: 225470 - DNA, 22 bp, Mus musculus
tgttttgtgaccaattatatgg

SEQ ID NO: 225471 - DNA, 22 bp, Mus musculus
ctctctcagtcactgcatctac

SEQ ID NO: 225472 - DNA, 23 bp, Mus musculus
tttgtctgtctcagtatctccat

SEQ ID NO: 225473 - DNA, 23 bp, Mus musculus
agtgtcagtttgtcaaatacccc

SEQ ID NO: 225474 - DNA, 22 bp, Mus musculus
tgttttgtgaccaattatatgg

SEQ ID NO: 225475 - DNA, 23 bp, Mus musculus
aaatgtgaatttctttttgtcag

SEQ ID NO: 225476 - DNA, 21 bp, Mus musculus
acagaaagcatcacatgggga

SEQ ID NO: 225477 - DNA, 23 bp, Mus musculus
agttgtcagcctccaggagtgtg

SEQ ID NO: 225478 - DNA, 21 bp, Mus musculus
gcactgtggagagttggcagg

SEQ ID NO: 225479 - DNA, 18 bp, Mus musculus
agacatgatacacacatc

SEQ ID NO: 225480 - DNA, 22 bp, Mus musculus
tgttttgtgaccaattatatgg

SEQ ID NO: 225481 - DNA, 22 bp, Mus musculus
cacagccaaaaacttttcctag

SEQ ID NO: 225482 - DNA, 20 bp, Mus musculus
tatcatagttattgtaaatg

SEQ ID NO: 225483 - DNA, 22 bp, Mus musculus
tacatgtacatatatatacatg

SEQ ID NO: 225484 - DNA, 21 bp, Mus musculus
tccatggtggtctgataggat

SEQ ID NO: 225485 - DNA, 23 bp, Mus musculus
tagtgcatgatgatctgagagga

SEQ ID NO: 225486 - DNA, 23 bp, Mus musculus
tgttaccaattatatggtcattt

SEQ ID NO: 225487 - DNA, 19 bp, Mus musculus
tcttgggtattctgatctt

SEQ ID NO: 225488 - DNA, 23 bp, Mus musculus
atcattgagtgcataccatgtgt

SEQ ID NO: 225489 - DNA, 23 bp, Mus musculus
tctgtctctgtatgtgtatatcc

SEQ ID NO: 225490 - DNA, 21 bp, Mus musculus
tccatggtggtctgataggat

SEQ ID NO: 225491 - DNA, 22 bp, Mus musculus
tgttttgtgaccaattatatgg

SEQ ID NO: 225492 - DNA, 23 bp, Mus musculus
gtctctcatactgtttatgtttt

SEQ ID NO: 225493 - DNA, 23 bp, Mus musculus
tcactcactctcagtttgaacag

SEQ ID NO: 225494 - DNA, 18 bp, Mus musculus
ttagaggtatgtcattga

SEQ ID NO: 225495 - DNA, 20 bp, Mus musculus
atatgtatatatgtatacct

SEQ ID NO: 225496 - DNA, 23 bp, Mus musculus
tgtttgtctgtctttttgtaggc

SEQ ID NO: 225497 - DNA, 23 bp, Mus musculus
tcccagagacaactcactggggt

SEQ ID NO: 225498 - DNA, 19 bp, Mus musculus
aagagagccatcttttcag

SEQ ID NO: 225499 - DNA, 23 bp, Mus musculus
ctgagggtcagtctgtccctctg

SEQ ID NO: 225500 - DNA, 19 bp, Mus musculus
aatactgtggcagttggat

SEQ ID NO: 225501 - DNA, 18 bp, Mus musculus
tgcatgtgtctatctgca

SEQ ID NO: 225502 - DNA, 23 bp, Mus musculus
atgtgtatgagcatgtgcatgca

SEQ ID NO: 225503 - DNA, 20 bp, Mus musculus
agagtcaggactcagggcgt

SEQ ID NO: 225504 - DNA, 22 bp, Mus musculus
tgttttgtgaccaattatatgg

SEQ ID NO: 225505 - DNA, 23 bp, Mus musculus
atggtggtctgataggatgtatg

SEQ ID NO: 225506 - DNA, 22 bp, Mus musculus
tgttttgtgaccaattatatgg

SEQ ID NO: 225507 - DNA, 22 bp, Mus musculus
tgttttgtgaccaattatatgg

SEQ ID NO: 225508 - DNA, 23 bp, Mus musculus
taggttgcttcatcaagccttga

SEQ ID NO: 225509 - DNA, 23 bp, Mus musculus
tgtctgtctgtctctcatattcc

SEQ ID NO: 225510 - DNA, 23 bp, Mus musculus
tctgtgaaattttagaaagctat

SEQ ID NO: 225511 - DNA, 23 bp, Mus musculus
tgtgtctccgtttagtttctgtt

SEQ ID NO: 225512 - DNA, 22 bp, Mus musculus
tgttttgtgaccaattatatgg

SEQ ID NO: 225513 - DNA, 23 bp, Mus musculus
tctgtgagtccttaggatactga

SEQ ID NO: 225514 - DNA, 23 bp, Mus musculus
tcatctgagaagtgagtgtacac

SEQ ID NO: 225515 - DNA, 21 bp, Mus musculus
atagaacgcaggtgtttgcat

SEQ ID NO: 225516 - DNA, 18 bp, Mus musculus
tatatatgtatgtgtgtg

SEQ ID NO: 225517 - DNA, 23 bp, Mus musculus
tggctgtgtctctctcagcctgg

SEQ ID NO: 225518 - DNA, 20 bp, Mus musculus
tgagaacctcagcttcaggt

SEQ ID NO: 225519 - DNA, 23 bp, Mus musculus
gtggcactgtgtgtgtgtgtgtg

SEQ ID NO: 225520 - DNA, 23 bp, Mus musculus
gtctccgtctctccgtctctggt

SEQ ID NO: 225521 - DNA, 21 bp, Mus musculus
tcctggaactcactctgtctc

SEQ ID NO: 225522 - DNA, 23 bp, Mus musculus
actgagggtatgttgagttgatg

SEQ ID NO: 225523 - DNA, 22 bp, Mus musculus
ttttgatttccaaagtatatgt

SEQ ID NO: 225524 - DNA, 23 bp, Mus musculus
tgagcagaagctagtttgagaac

SEQ ID NO: 225525 - DNA, 22 bp, Mus musculus
tttctctgactgacttccttga

SEQ ID NO: 225526 - DNA, 22 bp, Mus musculus
tcaggaggtagagacaggcagt

SEQ ID NO: 225527 - DNA, 23 bp, Mus musculus
taaatgttcaatacgtatgcttg

SEQ ID NO: 225528 - DNA, 23 bp, Mus musculus
gtgcctgtgagtgtgcctgcctg

SEQ ID NO: 225529 - DNA, 22 bp, Mus musculus
tgttttgtgaccaattatatgg

SEQ ID NO: 225530 - DNA, 22 bp, Mus musculus
tcagatgaaggtgatcaggttt

SEQ ID NO: 225531 - DNA, 18 bp, Mus musculus
tacatgcatgcgtgtgtg

SEQ ID NO: 225532 - DNA, 23 bp, Mus musculus
ttactaatgcattttttttgttt

SEQ ID NO: 225533 - DNA, 23 bp, Mus musculus
agtctctgtgtctgtccctcctg

SEQ ID NO: 225534 - DNA, 22 bp, Mus musculus
tgaggtaggagctagtttagga

SEQ ID NO: 225535 - DNA, 23 bp, Mus musculus
ttaagtcagacccagtctctctg

SEQ ID NO: 225536 - DNA, 23 bp, Mus musculus
tgttcttactgtctctgactgtg

SEQ ID NO: 225537 - DNA, 23 bp, Mus musculus
gtgtgtcagtactcctgggagag

SEQ ID NO: 225538 - DNA, 21 bp, Mus musculus
aatggctagatcatatactgt

SEQ ID NO: 225539 - DNA, 22 bp, Mus musculus
tttgcctgtgtatgatgttttc

SEQ ID NO: 225540 - DNA, 23 bp, Mus musculus
gtgtgtctgtgtgtgtctttccc

SEQ ID NO: 225541 - DNA, 23 bp, Mus musculus
caagtgagagtgtgctcactcgg

SEQ ID NO: 225542 - DNA, 22 bp, Mus musculus
tgaccttgaagctagattagtt

SEQ ID NO: 225543 - DNA, 20 bp, Mus musculus
tgcctgaagactgtgagcac

SEQ ID NO: 225544 - DNA, 21 bp, Mus musculus
tgctgactgctcttccagagg

SEQ ID NO: 225545 - DNA, 18 bp, Mus musculus
agcatgctggtgagatgg

SEQ ID NO: 225546 - DNA, 23 bp, Mus musculus
tagtgcatgtatgtgtgtgtgta

SEQ ID NO: 225547 - DNA, 23 bp, Mus musculus
catctatgtatgtatgtatgtat

SEQ ID NO: 225548 - DNA, 19 bp, Mus musculus
tgtatacatgcatgtatgt

SEQ ID NO: 225549 - DNA, 23 bp, Mus musculus
gatgtgtcactgtcacttaactt

SEQ ID NO: 225550 - DNA, 23 bp, Mus musculus
taagaggaaggtaatcctttgct

SEQ ID NO: 225551 - DNA, 23 bp, Mus musculus
tgtgcatgctgtctcagtttctc

SEQ ID NO: 225552 - DNA, 22 bp, Mus musculus
tgttttgtgaccaattatatgg

SEQ ID NO: 225553 - DNA, 18 bp, Mus musculus
acagagcatgtctttcag

SEQ ID NO: 225554 - DNA, 23 bp, Mus musculus
ggtctcttagacactctgacagc

SEQ ID NO: 225555 - DNA, 22 bp, Mus musculus
ttccatatgtatctgtatatgt

SEQ ID NO: 225556 - DNA, 22 bp, Mus musculus
ggtatgtatacatgtatgtagg

SEQ ID NO: 225557 - DNA, 22 bp, Mus musculus
tgttttgtgaccaattatatgg

SEQ ID NO: 225558 - DNA, 23 bp, Mus musculus
gagacgctctgtcagtgcctgac

SEQ ID NO: 225559 - DNA, 19 bp, Mus musculus
tgtgtgtgtgtgtgtgcgt

SEQ ID NO: 225560 - DNA, 23 bp, Mus musculus
ggaagatatgaagtttggaggaa

SEQ ID NO: 225561 - DNA, 22 bp, Mus musculus
actctcagtctctgatggtttt

SEQ ID NO: 225562 - DNA, 23 bp, Mus musculus
ctctctctctctctctctgtata

SEQ ID NO: 225563 - DNA, 23 bp, Mus musculus
tagtgcatggtgatctgatagga

SEQ ID NO: 225564 - DNA, 21 bp, Mus musculus
tgttttgtgacctattatgtg

SEQ ID NO: 225565 - DNA, 20 bp, Mus musculus
tgactgaacagagtgtggcc

SEQ ID NO: 225566 - DNA, 23 bp, Mus musculus
atagatagatattgaaaccatat

SEQ ID NO: 225567 - DNA, 20 bp, Mus musculus
tctgagacagcatttttttt

SEQ ID NO: 225568 - DNA, 21 bp, Mus musculus
tctgtctgtgtgtattctatt

SEQ ID NO: 225569 - DNA, 20 bp, Mus musculus
tttgtagaccaggctggctt

SEQ ID NO: 225570 - DNA, 23 bp, Mus musculus
acagagctctgcctgactgtctc

SEQ ID NO: 225571 - DNA, 23 bp, Mus musculus
tccttctgttctgtatatgttgt

SEQ ID NO: 225572 - DNA, 23 bp, Mus musculus
atgtatgcatgtatgtatgtatg

SEQ ID NO: 225573 - DNA, 23 bp, Mus musculus
tctctctgcgtctctgtctgtgt

SEQ ID NO: 225574 - DNA, 22 bp, Mus musculus
tgttttgtgaccaattatatgg

SEQ ID NO: 225575 - DNA, 18 bp, Mus musculus
tagcaccactgttggtgt

SEQ ID NO: 225576 - DNA, 23 bp, Mus musculus
ttctttatttctttagttgtgtc

SEQ ID NO: 225577 - DNA, 19 bp, Mus musculus
atttgaaagtatttgataa

SEQ ID NO: 225578 - DNA, 23 bp, Mus musculus
atctctagtctcttagatcttgt

SEQ ID NO: 225579 - DNA, 20 bp, Mus musculus
tcagttgattgtcttcccaa

SEQ ID NO: 225580 - DNA, 23 bp, Mus musculus
tgaaaactcagtgctaaacaaga

SEQ ID NO: 225581 - DNA, 23 bp, Mus musculus
atagatatagatatgtgtgtgtg

SEQ ID NO: 225582 - DNA, 22 bp, Mus musculus
tgttttgtgaccaattatatgg

SEQ ID NO: 225583 - DNA, 21 bp, Mus musculus
gagtgctctgaagtctctcac

SEQ ID NO: 225584 - DNA, 23 bp, Mus musculus
tctctctgattctctctctcaga

SEQ ID NO: 225585 - DNA, 23 bp, Mus musculus
aacagcaccttgagcagccatga

SEQ ID NO: 225586 - DNA, 22 bp, Mus musculus
ttggtacatgtcagcctgctca

SEQ ID NO: 225587 - DNA, 22 bp, Mus musculus
tgttttgtgaccaattatatgg

SEQ ID NO: 225588 - DNA, 22 bp, Mus musculus
tgttttgtgaccaattatatgg

SEQ ID NO: 225589 - DNA, 22 bp, Mus musculus
ttgacagaagtgagtcaccagg

SEQ ID NO: 225590 - DNA, 22 bp, Mus musculus
atcaccacaatctgcaagaaga

SEQ ID NO: 225591 - DNA, 19 bp, Mus musculus
atttctctgatgatggact

SEQ ID NO: 225592 - DNA, 23 bp, Mus musculus
agtaatcagtttaatgcttaatg

SEQ ID NO: 225593 - DNA, 22 bp, Mus musculus
ttggagtgtgctagcatcctgt

SEQ ID NO: 225594 - DNA, 23 bp, Mus musculus
tgaatgccagaggataacttgtg

SEQ ID NO: 225595 - DNA, 21 bp, Mus musculus
tgtgtgaagatagccagctca

SEQ ID NO: 225596 - DNA, 23 bp, Mus musculus
tgacattctaggttgatatcttt

SEQ ID NO: 225597 - DNA, 23 bp, Mus musculus
tctccatctgtctgagtcagctg

SEQ ID NO: 225598 - DNA, 22 bp, Mus musculus
tgttttgtgaccaattatatgg

SEQ ID NO: 225599 - DNA, 21 bp, Mus musculus
tgttgtaacattggtctttct

SEQ ID NO: 225600 - DNA, 20 bp, Mus musculus
ttgtatgagagtatgttgta

SEQ ID NO: 225601 - DNA, 22 bp, Mus musculus
tgtatatatgtatgtatatatg

SEQ ID NO: 225602 - DNA, 23 bp, Mus musculus
ggacaccccctgaagagtgggat

SEQ ID NO: 225603 - DNA, 22 bp, Mus musculus
tgttttgtgaccaattatatgg

SEQ ID NO: 225604 - DNA, 23 bp, Mus musculus
tattctatgtttttgttaagctt

SEQ ID NO: 225605 - DNA, 22 bp, Mus musculus
tgttttgtgaccaattatatgg

SEQ ID NO: 225606 - DNA, 23 bp, Mus musculus
ttcactactgaatttcttgtgct

SEQ ID NO: 225607 - DNA, 22 bp, Mus musculus
cacagaatattttcttgtctgt

SEQ ID NO: 225608 - DNA, 22 bp, Mus musculus
atacataatatatatatgtgtg

SEQ ID NO: 225609 - DNA, 20 bp, Mus musculus
tatgtctatatgtctatatg

SEQ ID NO: 225610 - DNA, 23 bp, Mus musculus
tatatgagaggattttttgtgaa

SEQ ID NO: 225611 - DNA, 22 bp, Mus musculus
tgttttgtgaccaattatatgg

SEQ ID NO: 225612 - DNA, 22 bp, Mus musculus
tgttttgtgaccaattatatgg

SEQ ID NO: 225613 - DNA, 18 bp, Mus musculus
tagactcatgtatttgaa

SEQ ID NO: 225614 - DNA, 23 bp, Mus musculus
tgtgtgcatctgcatctgtattg

SEQ ID NO: 225615 - DNA, 23 bp, Mus musculus
tgtgtctctgtttagtttctgtt

SEQ ID NO: 225616 - DNA, 23 bp, Mus musculus
tgacctggaagtgagaaaaggct

SEQ ID NO: 225617 - DNA, 19 bp, Mus musculus
tatgtatgtacgtgtgtat

SEQ ID NO: 225618 - DNA, 22 bp, Mus musculus
tgttttgtgaccaattatatgg

SEQ ID NO: 225619 - DNA, 23 bp, Mus musculus
tcagtgtccactgtctgtgtctg

SEQ ID NO: 225620 - DNA, 23 bp, Mus musculus
gtctgtctgtctctgtcccactt

SEQ ID NO: 225621 - DNA, 22 bp, Mus musculus
tgttttgtgaccaattatatgg

SEQ ID NO: 225622 - DNA, 23 bp, Mus musculus
tgtgtgagtgtgtttatgtatta

SEQ ID NO: 225623 - DNA, 21 bp, Mus musculus
tatgagcactgactgctcttc

SEQ ID NO: 225624 - DNA, 22 bp, Mus musculus
tgttttgtgaccaattatatgg

SEQ ID NO: 225625 - DNA, 23 bp, Mus musculus
tgagtgaacactgagagaactag

SEQ ID NO: 225626 - DNA, 23 bp, Mus musculus
ttcatttctgattttgttaattt

SEQ ID NO: 225627 - DNA, 23 bp, Mus musculus
attagaatggcaggtaatgaact

SEQ ID NO: 225628 - DNA, 20 bp, Mus musculus
tgtcctgtatatatgtctta

SEQ ID NO: 225629 - DNA, 23 bp, Mus musculus
tgtgtgtatatatatatgtgtgc

SEQ ID NO: 225630 - DNA, 22 bp, Mus musculus
tgttttgtgaccaattatatgg

SEQ ID NO: 225631 - DNA, 22 bp, Mus musculus
tgttttgtgaccaattatatgg

SEQ ID NO: 225632 - DNA, 22 bp, Mus musculus
gaaacttgtcaacgtccaggca

SEQ ID NO: 225633 - DNA, 23 bp, Mus musculus
atgacactggaagagttgagagt

SEQ ID NO: 225634 - DNA, 23 bp, Mus musculus
ttgtgcatgtatgtacatattca

SEQ ID NO: 225635 - DNA, 21 bp, Mus musculus
gtatgtatacaagtgtgtgca

SEQ ID NO: 225636 - DNA, 23 bp, Mus musculus
tatttattgtacgtgtgtgagtg

SEQ ID NO: 225637 - DNA, 22 bp, Mus musculus
tgttttgtgaccaattatatgg

SEQ ID NO: 225638 - DNA, 22 bp, Mus musculus
atttatgtggatatagattgta

SEQ ID NO: 225639 - DNA, 20 bp, Mus musculus
ttgaaactgcaagccctgtg

SEQ ID NO: 225640 - DNA, 23 bp, Mus musculus
tctctgtgttaatttgtgcatgg

SEQ ID NO: 225641 - DNA, 22 bp, Mus musculus
tgttttgtgaccaattatatgg

SEQ ID NO: 225642 - DNA, 23 bp, Mus musculus
acacactgtgacatactagtttc

SEQ ID NO: 225643 - DNA, 21 bp, Mus musculus
atgtgtgtgtatgtgatgtat

SEQ ID NO: 225644 - DNA, 23 bp, Mus musculus
caatgtctgtcagcataccatgt

SEQ ID NO: 225645 - DNA, 23 bp, Mus musculus
agaggaatctgaggaagtagtag

SEQ ID NO: 225646 - DNA, 22 bp, Mus musculus
tgttctgtattcaaggtcattg

SEQ ID NO: 225647 - DNA, 23 bp, Mus musculus
tctctgagtctctgaaatataac

SEQ ID NO: 225648 - DNA, 23 bp, Mus musculus
tctgtgagtccatgagtgtagtt

SEQ ID NO: 225649 - DNA, 22 bp, Mus musculus
tgttttgtgaccaattatatgg

SEQ ID NO: 225650 - DNA, 22 bp, Mus musculus
tgttttgtgaccaattatatgg

SEQ ID NO: 225651 - DNA, 22 bp, Mus musculus
aaagacagaatgcttaggtagt

SEQ ID NO: 225652 - DNA, 23 bp, Mus musculus
tagtccgtgatgatctgatagaa

SEQ ID NO: 225653 - DNA, 23 bp, Mus musculus
tgtccctgagcctgttgtctgtc

SEQ ID NO: 225654 - DNA, 19 bp, Mus musculus
tgggacagggactcctcag

SEQ ID NO: 225655 - DNA, 23 bp, Mus musculus
tctctcttgctctcagtgtcctt

SEQ ID NO: 225656 - DNA, 22 bp, Mus musculus
tgttttgtgaccaattatatgg

SEQ ID NO: 225657 - DNA, 20 bp, Mus musculus
tacatcagaggtaaagtgga

SEQ ID NO: 225658 - DNA, 23 bp, Mus musculus
tccctgcctgtctgtctgtatgt

SEQ ID NO: 225659 - DNA, 22 bp, Mus musculus
tgttttgtgaccaattatatgg

SEQ ID NO: 225660 - DNA, 22 bp, Mus musculus
tgttttgtgaccaattatatgg

SEQ ID NO: 225661 - DNA, 19 bp, Mus musculus
cttgtaactctttagcagt

SEQ ID NO: 225662 - DNA, 22 bp, Mus musculus
ttgagaactagtacttattgag

SEQ ID NO: 225663 - DNA, 23 bp, Mus musculus
tatttactggtattcaaatcttc

SEQ ID NO: 225664 - DNA, 21 bp, Mus musculus
aactgcatgcttatgcacaga

SEQ ID NO: 225665 - DNA, 22 bp, Mus musculus
tgttttgtgaccaattatatgg

SEQ ID NO: 225666 - DNA, 23 bp, Mus musculus
tgtggctaacaatgtattgtctc

SEQ ID NO: 225667 - DNA, 22 bp, Mus musculus
taatgcagtctcaggtcccaca

SEQ ID NO: 225668 - DNA, 23 bp, Mus musculus
tgctagcttcagagttagtgtac

SEQ ID NO: 225669 - DNA, 22 bp, Mus musculus
tgttttgtgaccaattatatgg

SEQ ID NO: 225670 - DNA, 23 bp, Mus musculus
tgtgtatgtgtgtgtctgtgtgt

SEQ ID NO: 225671 - DNA, 22 bp, Mus musculus
tctgagcctgtgacagtgggtc

SEQ ID NO: 225672 - DNA, 18 bp, Mus musculus
agctcacagactgtggag

SEQ ID NO: 225673 - DNA, 22 bp, Mus musculus
tgttttgtgaccaattatatgg

SEQ ID NO: 225674 - DNA, 23 bp, Mus musculus
tagtgcatggtgatctgatagga

SEQ ID NO: 225675 - DNA, 19 bp, Mus musculus
tttgtgacctattatgtgg

SEQ ID NO: 225676 - DNA, 22 bp, Mus musculus
tgttttgtgaccaattatatgg

SEQ ID NO: 225677 - DNA, 23 bp, Mus musculus
ttgctgagactcatatgctaagg

SEQ ID NO: 225678 - DNA, 22 bp, Mus musculus
tgttttgtgaccaattatatgg

SEQ ID NO: 225679 - DNA, 21 bp, Mus musculus
ctgtgtgtgtgtctgtctgtc

SEQ ID NO: 225680 - DNA, 22 bp, Mus musculus
aatagcttcatatatgtgtgtg

SEQ ID NO: 225681 - DNA, 23 bp, Mus musculus
tgcctgcctgcctgtctgtctgt

SEQ ID NO: 225682 - DNA, 19 bp, Mus musculus
atatctctgcacattggaa

SEQ ID NO: 225683 - DNA, 21 bp, Mus musculus
aagcttctttgatgaagatag

SEQ ID NO: 225684 - DNA, 21 bp, Mus musculus
aatgcagatgtctagctatgt

SEQ ID NO: 225685 - DNA, 23 bp, Mus musculus
accatatgtgcatgagttgtgtt

SEQ ID NO: 225686 - DNA, 22 bp, Mus musculus
tgttttgtgaccaattatatgg

SEQ ID NO: 225687 - DNA, 23 bp, Mus musculus
gtcagtgacacagactctgagaa

SEQ ID NO: 225688 - DNA, 23 bp, Mus musculus
cttgctctctctgactgtggctt

SEQ ID NO: 225689 - DNA, 23 bp, Mus musculus
tatgtatgtatatgtatatgtat

SEQ ID NO: 225690 - DNA, 22 bp, Mus musculus
tgttttgtgaccaattatatgg

SEQ ID NO: 225691 - DNA, 23 bp, Mus musculus
atgtgtgtgtgcatgtgcatgtg

SEQ ID NO: 225692 - DNA, 23 bp, Mus musculus
gtgtgtgcatgtgtatgtgtgtg

SEQ ID NO: 225693 - DNA, 22 bp, Mus musculus
tcattgggtgatgatggacatt

SEQ ID NO: 225694 - DNA, 22 bp, Mus musculus
tgttttgtgaccaattatatgg

SEQ ID NO: 225695 - DNA, 23 bp, Mus musculus
gtctctgattctctctgcttctg

SEQ ID NO: 225696 - DNA, 21 bp, Mus musculus
tgagtagagagttgatcagtt

SEQ ID NO: 225697 - DNA, 23 bp, Mus musculus
tgtgtgtgcatgtgcatgtgtgt

SEQ ID NO: 225698 - DNA, 23 bp, Mus musculus
atgaatgtatatatgtatgaagt

SEQ ID NO: 225699 - DNA, 21 bp, Mus musculus
tttcccattttattcctgtct

SEQ ID NO: 225700 - DNA, 21 bp, Mus musculus
tccatggtgatctgataggat

SEQ ID NO: 225701 - DNA, 21 bp, Mus musculus
tccatggtgatctgataggat

SEQ ID NO: 225702 - DNA, 23 bp, Mus musculus
ttattttgcaaatcatatgtttt

SEQ ID NO: 225703 - DNA, 23 bp, Mus musculus
aaaagtcagaaaggaacacatgt

SEQ ID NO: 225704 - DNA, 22 bp, Mus musculus
tgttttgtgaccaattatatgg

SEQ ID NO: 225705 - DNA, 22 bp, Mus musculus
tgttttgtgaccaattatatgg

SEQ ID NO: 225706 - DNA, 22 bp, Mus musculus
atcactttttctaattctgtga

SEQ ID NO: 225707 - DNA, 21 bp, Mus musculus
tagtggtatatgtatgtatgt

SEQ ID NO: 225708 - DNA, 23 bp, Mus musculus
atgtgtgtgtatgtatatatata

SEQ ID NO: 225709 - DNA, 22 bp, Mus musculus
tgttttgtgaccaattatatgg

SEQ ID NO: 225710 - DNA, 21 bp, Mus musculus
ccctgcaattgtttcccaatg

SEQ ID NO: 225711 - DNA, 23 bp, Mus musculus
tgtgtgcgtctgtctgtcattta

SEQ ID NO: 225712 - DNA, 18 bp, Mus musculus
tgtgtgtgtatgcaatat

SEQ ID NO: 225713 - DNA, 22 bp, Mus musculus
tgttttgtgaccaattatatgg

SEQ ID NO: 225714 - DNA, 22 bp, Mus musculus
cttagtccatggtgttctgata

SEQ ID NO: 225715 - DNA, 22 bp, Mus musculus
tgttttgtgaccaattatatgg

SEQ ID NO: 225716 - DNA, 22 bp, Mus musculus
tgttttgtgaccaattatatgg

SEQ ID NO: 225717 - DNA, 22 bp, Mus musculus
cattaatatgtgcatttgtata

SEQ ID NO: 225718 - DNA, 23 bp, Mus musculus
tctatgtgatgaagactatgtga

SEQ ID NO: 225719 - DNA, 22 bp, Mus musculus
tgttttgtgaccaattatatgg

SEQ ID NO: 225720 - DNA, 23 bp, Mus musculus
tattctaaatatgaaatactgtg

SEQ ID NO: 225721 - DNA, 23 bp, Mus musculus
tttacaatctacagtttcaggtt

SEQ ID NO: 225722 - DNA, 18 bp, Mus musculus
tagaccaggctgtcctcg

SEQ ID NO: 225723 - DNA, 23 bp, Mus musculus
tgtctatgtctgtctttcctctc

SEQ ID NO: 225724 - DNA, 22 bp, Mus musculus
tgttttgtgaccaattatatgg

SEQ ID NO: 225725 - DNA, 20 bp, Mus musculus
tttagacactgctatttctc

SEQ ID NO: 225726 - DNA, 21 bp, Mus musculus
acagcttaatttaagagaatg

SEQ ID NO: 225727 - DNA, 23 bp, Mus musculus
ctgtgtctctgtttagtttctgt

SEQ ID NO: 225728 - DNA, 23 bp, Mus musculus
tgatctctttttgttcttgaatt

SEQ ID NO: 225729 - DNA, 23 bp, Mus musculus
acttgaaatacaatgttgaatag

SEQ ID NO: 225730 - DNA, 23 bp, Mus musculus
gctgagaagctgcctgcatgatg

SEQ ID NO: 225731 - DNA, 23 bp, Mus musculus
tttctctctgtctctgggagagt

SEQ ID NO: 225732 - DNA, 23 bp, Mus musculus
tagtccatggtgatctgatagga

SEQ ID NO: 225733 - DNA, 23 bp, Mus musculus
tagtccatggtgatctgatagga

SEQ ID NO: 225734 - DNA, 23 bp, Mus musculus
tatagttttgtacatcttgtgtg

SEQ ID NO: 225735 - DNA, 20 bp, Mus musculus
tatgacagactgtatcttct

SEQ ID NO: 225736 - DNA, 23 bp, Mus musculus
tagttatatgtggatcccttttg

SEQ ID NO: 225737 - DNA, 18 bp, Mus musculus
ttgagattgtggtagggt

SEQ ID NO: 225738 - DNA, 22 bp, Mus musculus
tgttttgtgaccaattatatgg

SEQ ID NO: 225739 - DNA, 23 bp, Mus musculus
aagactggtaatgttgatcttga

SEQ ID NO: 225740 - DNA, 22 bp, Mus musculus
tgttttgtgaccaattatatgg

SEQ ID NO: 225741 - DNA, 23 bp, Mus musculus
acacacacacaaaaggatggtct

SEQ ID NO: 225742 - DNA, 23 bp, Mus musculus
tgtgtttgtgtctctctatgtgt

SEQ ID NO: 225743 - DNA, 21 bp, Mus musculus
agaccttgttttctaggactg

SEQ ID NO: 225744 - DNA, 23 bp, Mus musculus
aatacttagtttttgttttgctt

SEQ ID NO: 225745 - DNA, 19 bp, Mus musculus
ggtagattaagacagagtt

SEQ ID NO: 225746 - DNA, 23 bp, Mus musculus
gtatatatgtgtatgtatatgtg

SEQ ID NO: 225747 - DNA, 23 bp, Mus musculus
tacatacacacacatatatatgt

SEQ ID NO: 225748 - DNA, 19 bp, Mus musculus
agccactgtattaggcatg

SEQ ID NO: 225749 - DNA, 23 bp, Mus musculus
tgtgtacatgcatgtgtgtgtat

SEQ ID NO: 225750 - DNA, 21 bp, Mus musculus
tagtcctacatgtatgtatgt

SEQ ID NO: 225751 - DNA, 23 bp, Mus musculus
gacagctcactgtgcacacagag

SEQ ID NO: 225752 - DNA, 21 bp, Mus musculus
cacagggcacagtgactcaga

SEQ ID NO: 225753 - DNA, 23 bp, Mus musculus
cttataagttgatttcttttgaa

SEQ ID NO: 225754 - DNA, 23 bp, Mus musculus
ggagatttactagtagttcctac

SEQ ID NO: 225755 - DNA, 18 bp, Mus musculus
atgcgtgtgtgtgtgtgt

SEQ ID NO: 225756 - DNA, 23 bp, Mus musculus
cttataagttgatttcttttgaa

SEQ ID NO: 225757 - DNA, 22 bp, Mus musculus
ggagatttactagtagttccta

SEQ ID NO: 225758 - DNA, 23 bp, Mus musculus
cgtggtgatttgaatagatgcat

SEQ ID NO: 225759 - DNA, 23 bp, Mus musculus
aatatttttgtatctgttgaggc

SEQ ID NO: 225760 - DNA, 19 bp, Mus musculus
ttgttctttgagacagggt

SEQ ID NO: 225761 - DNA, 19 bp, Mus musculus
atatgtgtatatgcatatg

SEQ ID NO: 225762 - DNA, 21 bp, Mus musculus
tatatgtatatatacatatgt

SEQ ID NO: 225763 - DNA, 23 bp, Mus musculus
ttcacactctgtgtgtttgcttc

SEQ ID NO: 225764 - DNA, 20 bp, Mus musculus
caaccgtctgtcatgggatc

SEQ ID NO: 225765 - DNA, 23 bp, Mus musculus
tccatggtggtctgataggatgg

SEQ ID NO: 225766 - DNA, 23 bp, Mus musculus
ttttgtgaccaattctatggtca

SEQ ID NO: 225767 - DNA, 21 bp, Mus musculus
tgaaatgaaaagaagactgtc

SEQ ID NO: 225768 - DNA, 21 bp, Mus musculus
agtcatttctgtcgtagaagt

SEQ ID NO: 225769 - DNA, 23 bp, Mus musculus
agagaagtgagtcagatctccta

SEQ ID NO: 225770 - DNA, 18 bp, Mus musculus
tttctgtgtgtgtgtgtg

SEQ ID NO: 225771 - DNA, 23 bp, Mus musculus
ttatgtttgctatacatacatat

SEQ ID NO: 225772 - DNA, 20 bp, Mus musculus
ataacatatgtatacacaca

SEQ ID NO: 225773 - DNA, 23 bp, Mus musculus
ctggcccagtcagtccctctcag

SEQ ID NO: 225774 - DNA, 19 bp, Mus musculus
tggagctgtctctggaggt

SEQ ID NO: 225775 - DNA, 23 bp, Mus musculus
ttggaagaacaactagtgttgtt

SEQ ID NO: 225776 - DNA, 20 bp, Mus musculus
tatttttgttttcaaaagat

SEQ ID NO: 225777 - DNA, 23 bp, Mus musculus
atgtcactgaggatgggttttga

SEQ ID NO: 225778 - DNA, 23 bp, Mus musculus
gtgtgtttgtcacttcaatattt

SEQ ID NO: 225779 - DNA, 23 bp, Mus musculus
aatgacaggtttactgtacattg

SEQ ID NO: 225780 - DNA, 22 bp, Mus musculus
cagtcttaggccatggtggtct

SEQ ID NO: 225781 - DNA, 23 bp, Mus musculus
tttgtgaccaattctatggtcaa

SEQ ID NO: 225782 - DNA, 23 bp, Mus musculus
actaggcattcattcttttattg

SEQ ID NO: 225783 - DNA, 21 bp, Mus musculus
tcacagtctcacttactggca

SEQ ID NO: 225784 - DNA, 23 bp, Mus musculus
tcagtctgagtacttcagaagct

SEQ ID NO: 225785 - DNA, 23 bp, Mus musculus
aactctctgaggaagtagtttgt

SEQ ID NO: 225786 - DNA, 23 bp, Mus musculus
agtctgacactagagcctgtgct

SEQ ID NO: 225787 - DNA, 23 bp, Mus musculus
tgggtgtggagagacatgctgtt

SEQ ID NO: 225788 - DNA, 22 bp, Mus musculus
tgttttgtgaccaattatatgg

SEQ ID NO: 225789 - DNA, 23 bp, Mus musculus
atcagataggatgcatgtgaata

SEQ ID NO: 225790 - DNA, 22 bp, Mus musculus
ttcaatatttttgtatctgttg

SEQ ID NO: 225791 - DNA, 23 bp, Mus musculus
cttttctctgtcagcctcacgct

SEQ ID NO: 225792 - DNA, 20 bp, Mus musculus
catatgcatacatgggagat

SEQ ID NO: 225793 - DNA, 22 bp, Mus musculus
atacttgtagatatataaactt

SEQ ID NO: 225794 - DNA, 23 bp, Mus musculus
tgtctgtctgtctgcctgtcttg

SEQ ID NO: 225795 - DNA, 22 bp, Mus musculus
gcactgactgctcttccagagg

SEQ ID NO: 225796 - DNA, 22 bp, Mus musculus
agcacctgctgtaacagctcac

SEQ ID NO: 225797 - DNA, 22 bp, Mus musculus
tgttttgtgaccaattatatgg

SEQ ID NO: 225798 - DNA, 23 bp, Mus musculus
gggactgtctctgactctgtcct

SEQ ID NO: 225799 - DNA, 19 bp, Mus musculus
agtccttgggtatagctcc

SEQ ID NO: 225800 - DNA, 20 bp, Mus musculus
gtgtccatacctaatgactg

SEQ ID NO: 225801 - DNA, 21 bp, Mus musculus
ctctggctctgactgtgtcag

SEQ ID NO: 225802 - DNA, 20 bp, Mus musculus
tgttatatactgtatctgta

SEQ ID NO: 225803 - DNA, 23 bp, Mus musculus
gacttctatggtattccacctgt

SEQ ID NO: 225804 - DNA, 23 bp, Mus musculus
atatgtgtgtatgtatatatgtg

SEQ ID NO: 225805 - DNA, 18 bp, Mus musculus
tcctttaaaaataagtat

SEQ ID NO: 225806 - DNA, 23 bp, Mus musculus
atgtatgtatgtatgtattaatg

SEQ ID NO: 225807 - DNA, 20 bp, Mus musculus
tgtatgtatgtatgtatgta

SEQ ID NO: 225808 - DNA, 23 bp, Mus musculus
caggacattacagactcttgctg

SEQ ID NO: 225809 - DNA, 23 bp, Mus musculus
tgtgatcctggttgtgtcagaac

SEQ ID NO: 225810 - DNA, 23 bp, Mus musculus
tttgtagttaatgtagttgaaaa

SEQ ID NO: 225811 - DNA, 22 bp, Mus musculus
tgtgtgtgtgtgtacatgtata

SEQ ID NO: 225812 - DNA, 23 bp, Mus musculus
tctgtctctcagtgaattatggc

SEQ ID NO: 225813 - DNA, 23 bp, Mus musculus
cacgcactgtgtttgccttacat

SEQ ID NO: 225814 - DNA, 22 bp, Mus musculus
tccacttgtggtgatgttctag

SEQ ID NO: 225815 - DNA, 23 bp, Mus musculus
aatgcttgtatgtatgtatgtat

SEQ ID NO: 225816 - DNA, 22 bp, Mus musculus
agtcactttgtgatttgtgtat

SEQ ID NO: 225817 - DNA, 21 bp, Mus musculus
tatgcatatgtatatgtatgt

SEQ ID NO: 225818 - DNA, 23 bp, Mus musculus
tgagtccctctctgtgtgtcctt

SEQ ID NO: 225819 - DNA, 20 bp, Mus musculus
tatatgtatatctatatctc

SEQ ID NO: 225820 - DNA, 23 bp, Mus musculus
tgtgatgagtagttcgtggcagg

SEQ ID NO: 225821 - DNA, 20 bp, Mus musculus
atagctcaactcagtggcac

SEQ ID NO: 225822 - DNA, 23 bp, Mus musculus
aaagcactgggattcaaaggcct

SEQ ID NO: 225823 - DNA, 23 bp, Mus musculus
agacagtagtggggctggagaga

SEQ ID NO: 225824 - DNA, 23 bp, Mus musculus
tagtccatggtgatctgatagga

SEQ ID NO: 225825 - DNA, 19 bp, Mus musculus
tatgacagattatatgatc

SEQ ID NO: 225826 - DNA, 23 bp, Mus musculus
gggtctctgtcactcttaggtgt

SEQ ID NO: 225827 - DNA, 23 bp, Mus musculus
gaactaagtctatgtgctagagg

SEQ ID NO: 225828 - DNA, 18 bp, Mus musculus
tatctcaagctgtactgg

SEQ ID NO: 225829 - DNA, 23 bp, Mus musculus
gacactgagtaaacatggaccag

SEQ ID NO: 225830 - DNA, 18 bp, Mus musculus
tgaatgaactgaattgga

SEQ ID NO: 225831 - DNA, 18 bp, Mus musculus
atgatggtctgataggat

SEQ ID NO: 225832 - DNA, 22 bp, Mus musculus
tgttttgtgaccaattatatgg

SEQ ID NO: 225833 - DNA, 19 bp, Mus musculus
tgagtatatgtgagagaga

SEQ ID NO: 225834 - DNA, 22 bp, Mus musculus
tgttttgtgaccaattatatgg

SEQ ID NO: 225835 - DNA, 21 bp, Mus musculus
ttttgtgaccgattatatggg

SEQ ID NO: 225836 - DNA, 23 bp, Mus musculus
gtggtgatcagataggatgcata

SEQ ID NO: 225837 - DNA, 22 bp, Mus musculus
tgttttgtaaccaattatatgg

SEQ ID NO: 225838 - DNA, 18 bp, Mus musculus
atcactctgagtcagctg

SEQ ID NO: 225839 - DNA, 23 bp, Mus musculus
gtgtttaagcaagaccatgtgca

SEQ ID NO: 225840 - DNA, 19 bp, Mus musculus
ttgtcagtctgggagactt

SEQ ID NO: 225841 - DNA, 23 bp, Mus musculus
ttcacagtctggtacttcattac

SEQ ID NO: 225842 - DNA, 22 bp, Mus musculus
tgttttgtgaccaattatatgg

SEQ ID NO: 225843 - DNA, 23 bp, Mus musculus
ttcatggtggtctgataggatgc

SEQ ID NO: 225844 - DNA, 22 bp, Mus musculus
tcatgtaacactgcagatatgt

SEQ ID NO: 225845 - DNA, 23 bp, Mus musculus
tatatctgtagtaatctaaagct

SEQ ID NO: 225846 - DNA, 18 bp, Mus musculus
tgagctacttggttcttt

SEQ ID NO: 225847 - DNA, 23 bp, Mus musculus
tgtgtgtgtctctctgtgtactt

SEQ ID NO: 225848 - DNA, 22 bp, Mus musculus
tgttttgtgaccaattatatgg

SEQ ID NO: 225849 - DNA, 23 bp, Mus musculus
gttcatgttcattgcttttctat

SEQ ID NO: 225850 - DNA, 20 bp, Mus musculus
atccaccagctaaattatgg

SEQ ID NO: 225851 - DNA, 23 bp, Mus musculus
tgagttaggacagggtctcctca

SEQ ID NO: 225852 - DNA, 23 bp, Mus musculus
tctctcttgctctcagtgtcctt

SEQ ID NO: 225853 - DNA, 22 bp, Mus musculus
gtgtgtgtgtgtgtgtgtatcc

SEQ ID NO: 225854 - DNA, 23 bp, Mus musculus
gtaaacatatgagtgtgtgtgta

SEQ ID NO: 225855 - DNA, 18 bp, Mus musculus
ttcagtcagttctcagca

SEQ ID NO: 225856 - DNA, 22 bp, Mus musculus
tgttttgtgaccaattatatgg

SEQ ID NO: 225857 - DNA, 22 bp, Mus musculus
tgttttgtgaccaattatatgg

SEQ ID NO: 225858 - DNA, 23 bp, Mus musculus
ctgtgcaagatttttgtagtagg

SEQ ID NO: 225859 - DNA, 23 bp, Mus musculus
tgtctgtctgtctgtctgtctgt

SEQ ID NO: 225860 - DNA, 23 bp, Mus musculus
acagtctctctctttaatttctg

SEQ ID NO: 225861 - DNA, 23 bp, Mus musculus
ttgacattgatgagagtgtggtg

SEQ ID NO: 225862 - DNA, 22 bp, Mus musculus
tatgtacatatgtatacttata

SEQ ID NO: 225863 - DNA, 23 bp, Mus musculus
tttggtatctgtcagatgtttgt

SEQ ID NO: 225864 - DNA, 23 bp, Mus musculus
tggttgagtggtctattgatcta

SEQ ID NO: 225865 - DNA, 23 bp, Mus musculus
gagctttggtattctgttttgaa

SEQ ID NO: 225866 - DNA, 23 bp, Mus musculus
tggaagtgtagagaaaatgttgt

SEQ ID NO: 225867 - DNA, 23 bp, Mus musculus
atgtatgtacgtgtgcttgtgtg

SEQ ID NO: 225868 - DNA, 23 bp, Mus musculus
tagtccatggtgatttgatagga

SEQ ID NO: 225869 - DNA, 22 bp, Mus musculus
cagatctctgtgtgagtgatta

SEQ ID NO: 225870 - DNA, 19 bp, Mus musculus
ttgaaggactttatttttt

SEQ ID NO: 225871 - DNA, 19 bp, Mus musculus
aagagactgctatattagg

SEQ ID NO: 225872 - DNA, 23 bp, Mus musculus
caaagtgagaggaagctgtttct

SEQ ID NO: 225873 - DNA, 23 bp, Mus musculus
aggccatgatggtctgataggat

SEQ ID NO: 225874 - DNA, 22 bp, Mus musculus
tgttttgtgaccaattatatgg

SEQ ID NO: 225875 - DNA, 23 bp, Mus musculus
ttgctgtctctagtatcctggta

SEQ ID NO: 225876 - DNA, 23 bp, Mus musculus
ccctgagaccctgagaccctgag

SEQ ID NO: 225877 - DNA, 18 bp, Mus musculus
ctcccatctgggtgccaa

SEQ ID NO: 225878 - DNA, 22 bp, Mus musculus
tgttttgtgaccaattatatgg

SEQ ID NO: 225879 - DNA, 23 bp, Mus musculus
tgtttctgtctgtgtgagtctgt

SEQ ID NO: 225880 - DNA, 23 bp, Mus musculus
gatatggtctatctgagaggtca

SEQ ID NO: 225881 - DNA, 21 bp, Mus musculus
tttctgagaggtcatggtgtg

SEQ ID NO: 225882 - DNA, 22 bp, Mus musculus
tgttttgtgaccaattatatgg

SEQ ID NO: 225883 - DNA, 23 bp, Mus musculus
gatatggtctatctgagaggtca

SEQ ID NO: 225884 - DNA, 21 bp, Mus musculus
tttctgagaggtcatggtgtg

SEQ ID NO: 225885 - DNA, 23 bp, Mus musculus
tagtgcatggtgatctgatagga

SEQ ID NO: 225886 - DNA, 22 bp, Mus musculus
tgttttgtgacctattatgtgg

SEQ ID NO: 225887 - DNA, 22 bp, Mus musculus
atatctgaatggttatgatgtg

SEQ ID NO: 225888 - DNA, 23 bp, Mus musculus
gatatggtctatctgagaggtca

SEQ ID NO: 225889 - DNA, 21 bp, Mus musculus
tttctgagaggtcatggtgtg

SEQ ID NO: 225890 - DNA, 23 bp, Mus musculus
tagtgcatggtgatctgatagga

SEQ ID NO: 225891 - DNA, 22 bp, Mus musculus
tgttttgtgacctattatgtgg

SEQ ID NO: 225892 - DNA, 23 bp, Mus musculus
gatatggtctatctgagaggtca

SEQ ID NO: 225893 - DNA, 21 bp, Mus musculus
tttctgagaggtcatggtgtg

SEQ ID NO: 225894 - DNA, 23 bp, Mus musculus
tagtgcatggtgatctgatagga

SEQ ID NO: 225895 - DNA, 23 bp, Mus musculus
tgttttgtgacctattatgtggt

SEQ ID NO: 225896 - DNA, 23 bp, Mus musculus
gatatggtctatctgagaggtca

SEQ ID NO: 225897 - DNA, 21 bp, Mus musculus
tttctgagaggtcatggtgtg

SEQ ID NO: 225898 - DNA, 18 bp, Mus musculus
ctcccatctgggtgccaa

SEQ ID NO: 225899 - DNA, 23 bp, Mus musculus
ttgggtctgtggattgtagtgtg

SEQ ID NO: 225900 - DNA, 18 bp, Mus musculus
ctcccatctgggtgccaa

SEQ ID NO: 225901 - DNA, 23 bp, Mus musculus
tgtttctgtctgtgtgagtctgt

SEQ ID NO: 225902 - DNA, 23 bp, Mus musculus
ttgctgtctctagtatcctggta

SEQ ID NO: 225903 - DNA, 23 bp, Mus musculus
tgagaccctgagaccctgagacc

SEQ ID NO: 225904 - DNA, 23 bp, Mus musculus
ttgggtctgtggattgtagtgtg

SEQ ID NO: 225905 - DNA, 23 bp, Mus musculus
ttgctgtctctagtatcctggta

SEQ ID NO: 225906 - DNA, 23 bp, Mus musculus
tgagaccctgagaccctgagacc

SEQ ID NO: 225907 - DNA, 18 bp, Mus musculus
ctcccatctgggtgccaa

SEQ ID NO: 225908 - DNA, 22 bp, Mus musculus
tagagagtagagagtcagtgca

SEQ ID NO: 225909 - DNA, 19 bp, Mus musculus
aagacgaaatgatgtaatt

SEQ ID NO: 225910 - DNA, 23 bp, Mus musculus
tgactactgtttttctagaaatg

SEQ ID NO: 225911 - DNA, 23 bp, Mus musculus
tatgtatatgtgagtgtatgtat

SEQ ID NO: 225912 - DNA, 23 bp, Mus musculus
atacacacacatatacatatatg

SEQ ID NO: 225913 - DNA, 22 bp, Mus musculus
tgttttgtgaccaattatatgg

SEQ ID NO: 225914 - DNA, 22 bp, Mus musculus
tgttttgtgaccaattatatgg

SEQ ID NO: 225915 - DNA, 22 bp, Mus musculus
tgttttgtgaccaattatatgg

SEQ ID NO: 225916 - DNA, 18 bp, Mus musculus
ctctagagccagcactga

SEQ ID NO: 225917 - DNA, 19 bp, Mus musculus
ttatttggacataatgtgg

SEQ ID NO: 225918 - DNA, 22 bp, Mus musculus
ttttctgctgtagtctggctga

SEQ ID NO: 225919 - DNA, 23 bp, Mus musculus
acttgacagaagacagactctac

SEQ ID NO: 225920 - DNA, 21 bp, Mus musculus
tatcttcatgagataggattt

SEQ ID NO: 225921 - DNA, 23 bp, Mus musculus
tgtttggttatctatgtcttgct

SEQ ID NO: 225922 - DNA, 23 bp, Mus musculus
tcagccccaggagcacatgtagt

SEQ ID NO: 225923 - DNA, 23 bp, Mus musculus
tgtctgtctgtgtctgtttatgg

SEQ ID NO: 225924 - DNA, 22 bp, Mus musculus
tcagtactatatgtcaaggttt

SEQ ID NO: 225925 - DNA, 22 bp, Mus musculus
tgaggtagtaagttgtattgtt

SEQ ID NO: 225926 - DNA, 23 bp, Mus musculus
tacaacttactactttccttggt

SEQ ID NO: 225927 - DNA, 22 bp, Mus musculus
tgctctctgaggttacagattc

SEQ ID NO: 225928 - DNA, 23 bp, Mus musculus
ctgtctttgttccttgtatagtt

SEQ ID NO: 225929 - DNA, 23 bp, Mus musculus
tgactgcactctgtaactcaggc

SEQ ID NO: 225930 - DNA, 23 bp, Mus musculus
ctgagtgtgtctgtgtttcattt

SEQ ID NO: 225931 - DNA, 23 bp, Mus musculus
gtatgtacgtacgtatacatatg

SEQ ID NO: 225932 - DNA, 22 bp, Mus musculus
cagtgagcatcagcaactccat

SEQ ID NO: 225933 - DNA, 23 bp, Mus musculus
atgtgacactggattggatagca

SEQ ID NO: 225934 - DNA, 23 bp, Mus musculus
atgtatgtatatgtatgtgtatg

SEQ ID NO: 225935 - DNA, 23 bp, Mus musculus
tatgtgtatatatatgtgtgtgt

SEQ ID NO: 225936 - DNA, 18 bp, Mus musculus
cagaggttctgagttcta

SEQ ID NO: 225937 - DNA, 22 bp, Mus musculus
ttctgagtatgttatagttgtg

SEQ ID NO: 225938 - DNA, 21 bp, Mus musculus
tatgaaacaggtcctgcagtc

SEQ ID NO: 225939 - DNA, 22 bp, Mus musculus
atgctcagtggcttagttgtga

SEQ ID NO: 225940 - DNA, 23 bp, Mus musculus
ttttgcactggtttacattggca

SEQ ID NO: 225941 - DNA, 23 bp, Mus musculus
agctgctttgaaaaggggtaaga

SEQ ID NO: 225942 - DNA, 23 bp, Mus musculus
ctgtgtctctgtttagtttctgt

SEQ ID NO: 225943 - DNA, 21 bp, Mus musculus
atctgtccattgatgagagtg

SEQ ID NO: 225944 - DNA, 23 bp, Mus musculus
aacactgtctctgtgtcagccac

SEQ ID NO: 225945 - DNA, 22 bp, Mus musculus
tgttttgtgaccaattatatgg

SEQ ID NO: 225946 - DNA, 21 bp, Mus musculus
tgaatgactgaccagagagag

SEQ ID NO: 225947 - DNA, 23 bp, Mus musculus
cgtcactgtctctgagtgtgtat

SEQ ID NO: 225948 - DNA, 21 bp, Mus musculus
atgagaagatatatttttgtt

SEQ ID NO: 225949 - DNA, 23 bp, Mus musculus
tgtctgtacatatgtgtagatat

SEQ ID NO: 225950 - DNA, 22 bp, Mus musculus
tttctcaatctctctgtctgtg

SEQ ID NO: 225951 - DNA, 19 bp, Mus musculus
tctatttgaatagctcttg

SEQ ID NO: 225952 - DNA, 21 bp, Mus musculus
tatctgcacataatacttaga

SEQ ID NO: 225953 - DNA, 23 bp, Mus musculus
gtggggtagtatgttgtatattt

SEQ ID NO: 225954 - DNA, 18 bp, Mus musculus
tattggaagataatgcat

SEQ ID NO: 225955 - DNA, 19 bp, Mus musculus
tggcaagttttagcaaagt

SEQ ID NO: 225956 - DNA, 22 bp, Mus musculus
atataccatagttattttttct

SEQ ID NO: 225957 - DNA, 22 bp, Mus musculus
tgttttgtgaccaattatatgg

SEQ ID NO: 225958 - DNA, 23 bp, Mus musculus
gttacagcacctggaagtggtac

SEQ ID NO: 225959 - DNA, 23 bp, Mus musculus
actgtgaagaggttagcaatttt

SEQ ID NO: 225960 - DNA, 20 bp, Mus musculus
ccatggtgatctgataggat

SEQ ID NO: 225961 - DNA, 23 bp, Mus musculus
tgttttgcaaccaattatatggt

SEQ ID NO: 225962 - DNA, 23 bp, Mus musculus
aagttctgagtttttgaagagac

SEQ ID NO: 225963 - DNA, 23 bp, Mus musculus
ccaaccaccatttgtgtgtgcat

SEQ ID NO: 225964 - DNA, 23 bp, Mus musculus
gtgcatttgtgtgtgtgcacatg

SEQ ID NO: 225965 - DNA, 23 bp, Mus musculus
aaagtgctagttaacatttgtca

SEQ ID NO: 225966 - DNA, 20 bp, Mus musculus
tttcagataaatgtgaaagg

SEQ ID NO: 225967 - DNA, 21 bp, Mus musculus
tgactctgtctctttcttctg

SEQ ID NO: 225968 - DNA, 23 bp, Mus musculus
gtttaatcatactgaacaaaatg

SEQ ID NO: 225969 - DNA, 23 bp, Mus musculus
aaaagcactgactgctcttccag

SEQ ID NO: 225970 - DNA, 19 bp, Mus musculus
agttaaggataggtgatag

SEQ ID NO: 225971 - DNA, 23 bp, Mus musculus
atcagtctgcaactttattcttt

SEQ ID NO: 225972 - DNA, 23 bp, Mus musculus
gtatgtatgtatgtgtgtatgta

SEQ ID NO: 225973 - DNA, 23 bp, Mus musculus
tgtgtctgtgtctgtgttatgtg

SEQ ID NO: 225974 - DNA, 23 bp, Mus musculus
atgtaaagtgaataagtatatat

SEQ ID NO: 225975 - DNA, 20 bp, Mus musculus
aatctgttatttctttggag

SEQ ID NO: 225976 - DNA, 18 bp, Mus musculus
tactactcacctcatggt

SEQ ID NO: 225977 - DNA, 20 bp, Mus musculus
aagccagaggttcactttgg

SEQ ID NO: 225978 - DNA, 23 bp, Mus musculus
aaatattatggtggatgatgaag

SEQ ID NO: 225979 - DNA, 23 bp, Mus musculus
tgtctctgactgactctgttgcc

SEQ ID NO: 225980 - DNA, 23 bp, Mus musculus
actcaacatccttcagtctggtg

SEQ ID NO: 225981 - DNA, 22 bp, Mus musculus
aacacctctagtttggtgttag

SEQ ID NO: 225982 - DNA, 23 bp, Mus musculus
tgcaggctgtgtcagtctctgtg

SEQ ID NO: 225983 - DNA, 23 bp, Mus musculus
tctgaatccatttgtaatgttaa

SEQ ID NO: 225984 - DNA, 18 bp, Mus musculus
tatggatatatatgcata

SEQ ID NO: 225985 - DNA, 22 bp, Mus musculus
tgttttgtgaccaattatatgg

SEQ ID NO: 225986 - DNA, 21 bp, Mus musculus
aaagtgcttccaaattgcaag

SEQ ID NO: 225987 - DNA, 23 bp, Mus musculus
ttctctcactctgacttagtgct

SEQ ID NO: 225988 - DNA, 22 bp, Mus musculus
tgttttgtgaccaattatatgg

SEQ ID NO: 225989 - DNA, 23 bp, Mus musculus
tcagcctcacactgtctgtcgag

SEQ ID NO: 225990 - DNA, 23 bp, Mus musculus
tgtatatgtatatgtatatgtat

SEQ ID NO: 225991 - DNA, 22 bp, Mus musculus
taggcatttgtaatagaatctg

SEQ ID NO: 225992 - DNA, 22 bp, Mus musculus
ctcagtttctgttgttatgtct

SEQ ID NO: 225993 - DNA, 23 bp, Mus musculus
atatgtgaaaatctttaaatctg

SEQ ID NO: 225994 - DNA, 23 bp, Mus musculus
agtactgactgctcttccagagg

SEQ ID NO: 225995 - DNA, 21 bp, Mus musculus
cactgactgctcttccagagg

SEQ ID NO: 225996 - DNA, 23 bp, Mus musculus
cttactctctgactcacttttaa

SEQ ID NO: 225997 - DNA, 23 bp, Mus musculus
tgtgtctcagtgcctcacttggg

SEQ ID NO: 225998 - DNA, 21 bp, Mus musculus
tgtagtagtctttgtgtgtga

SEQ ID NO: 225999 - DNA, 23 bp, Mus musculus
agtctacaaggactactgtgttt

SEQ ID NO: 226000 - DNA, 22 bp, Mus musculus
atgaaaagtgaatgtatatgca

SEQ ID NO: 226001 - DNA, 23 bp, Mus musculus
cactttacatttctatctgtatg

SEQ ID NO: 226002 - DNA, 23 bp, Mus musculus
ccaaagccattctgtctctgtct

SEQ ID NO: 226003 - DNA, 23 bp, Mus musculus
gaatttcaaattgaatttgtttg

SEQ ID NO: 226004 - DNA, 23 bp, Mus musculus
tctgagatgagtcacagcaatgg

SEQ ID NO: 226005 - DNA, 23 bp, Mus musculus
ccagcttcattcagcccgtgtgt

SEQ ID NO: 226006 - DNA, 23 bp, Mus musculus
tctctggggaatatatatgtgta

SEQ ID NO: 226007 - DNA, 18 bp, Mus musculus
tgagcttctagcttgttt

SEQ ID NO: 226008 - DNA, 22 bp, Mus musculus
tgttttgtgaccaattatatgg

SEQ ID NO: 226009 - DNA, 23 bp, Mus musculus
tgtgtctgtctctgagttctggc

SEQ ID NO: 226010 - DNA, 21 bp, Mus musculus
caggtgctgtgtgtgtatata

SEQ ID NO: 226011 - DNA, 23 bp, Mus musculus
tgtgtgactatggaaggagaaag

SEQ ID NO: 226012 - DNA, 22 bp, Mus musculus
tgttttgtgaccaattatatgg

SEQ ID NO: 226013 - DNA, 22 bp, Mus musculus
atatagagtaaactcttcctga

SEQ ID NO: 226014 - DNA, 23 bp, Mus musculus
atggtgctggagaagcagctgag

SEQ ID NO: 226015 - DNA, 23 bp, Mus musculus
gcagcagagagaaatcacaaagc

SEQ ID NO: 226016 - DNA, 22 bp, Mus musculus
gagagcagtgtgtgcacactgg

SEQ ID NO: 226017 - DNA, 23 bp, Mus musculus
tcagtggctcagttagtgctttc

SEQ ID NO: 226018 - DNA, 23 bp, Mus musculus
tctgtctgtctgtctgtctgtct

SEQ ID NO: 226019 - DNA, 23 bp, Mus musculus
tttgaagagagaactcagaggcc

SEQ ID NO: 226020 - DNA, 23 bp, Mus musculus
tttctgcctgtatttcaagctaa

SEQ ID NO: 226021 - DNA, 22 bp, Mus musculus
aggttggcttgaatttacagca

SEQ ID NO: 226022 - DNA, 21 bp, Mus musculus
atgtgcttcatgtagtcaggg

SEQ ID NO: 226023 - DNA, 22 bp, Mus musculus
tgttttgtgaccaattatatgg

SEQ ID NO: 226024 - DNA, 23 bp, Mus musculus
ctgtctctgtgtgtctgtgtgca

SEQ ID NO: 226025 - DNA, 22 bp, Mus musculus
tagcttgatctatggtaacagt

SEQ ID NO: 226026 - DNA, 20 bp, Mus musculus
tacatgtatatatgcataca

SEQ ID NO: 226027 - DNA, 20 bp, Mus musculus
tgcatgcatgcatgtgtgta

SEQ ID NO: 226028 - DNA, 23 bp, Mus musculus
tgtgtgtgtgtataatcacatgt

SEQ ID NO: 226029 - DNA, 23 bp, Mus musculus
tgtatatgtatatgtctgtggta

SEQ ID NO: 226030 - DNA, 19 bp, Mus musculus
agggtacatatgcatgggt

SEQ ID NO: 226031 - DNA, 19 bp, Mus musculus
aggctagaagagggtatct

SEQ ID NO: 226032 - DNA, 23 bp, Mus musculus
acatgaagggtaaaccagccata

SEQ ID NO: 226033 - DNA, 20 bp, Mus musculus
atgtatgtatgtatgtatgt

SEQ ID NO: 226034 - DNA, 21 bp, Mus musculus
tatatgtatatgtatatgtgt

SEQ ID NO: 226035 - DNA, 23 bp, Mus musculus
aagagagaattgagagagcagaa

SEQ ID NO: 226036 - DNA, 22 bp, Mus musculus
ctctgtcactgtcactctgtca

SEQ ID NO: 226037 - DNA, 22 bp, Mus musculus
ccaggtgagactgctgtagttg

SEQ ID NO: 226038 - DNA, 22 bp, Mus musculus
tgttttgtgaccaattatatgg

SEQ ID NO: 226039 - DNA, 22 bp, Mus musculus
tgttttgtgaccaattatatgg

SEQ ID NO: 226040 - DNA, 23 bp, Mus musculus
gggtctgtctgtctgtctcactg

SEQ ID NO: 226041 - DNA, 23 bp, Mus musculus
tcttttgtccctggtttggttta

SEQ ID NO: 226042 - DNA, 19 bp, Mus musculus
ctgtggggccttccaactg

SEQ ID NO: 226043 - DNA, 23 bp, Mus musculus
cattcttcttgcagtagtggtca

SEQ ID NO: 226044 - DNA, 23 bp, Mus musculus
tcactcactgtgacaatggcatt

SEQ ID NO: 226045 - DNA, 23 bp, Mus musculus
aaaggattggtgttgatgatgat

SEQ ID NO: 226046 - DNA, 20 bp, Mus musculus
tactcacatttccatatgca

SEQ ID NO: 226047 - DNA, 21 bp, Mus musculus
aggctgatgatgatgatgatg

SEQ ID NO: 226048 - DNA, 20 bp, Mus musculus
tactcacatttccatatgca

SEQ ID NO: 226049 - DNA, 21 bp, Mus musculus
aggctgatgatgatgatgatg

SEQ ID NO: 226050 - DNA, 20 bp, Mus musculus
tgattcagtgtataacatgt

SEQ ID NO: 226051 - DNA, 22 bp, Mus musculus
tgttttgtgaccaattatatgg

SEQ ID NO: 226052 - DNA, 23 bp, Mus musculus
tagtccatggtgatctgatagga

SEQ ID NO: 226053 - DNA, 23 bp, Mus musculus
gttttgtgaccaattaaatggtt

SEQ ID NO: 226054 - DNA, 23 bp, Mus musculus
ttactccgtggtaatcagatagg

SEQ ID NO: 226055 - DNA, 23 bp, Mus musculus
ttttgtgaccaattgtatggtca

SEQ ID NO: 226056 - DNA, 23 bp, Mus musculus
aactgtgtttttgtacatgtgtg

SEQ ID NO: 226057 - DNA, 19 bp, Mus musculus
aatttgcaaaattacaaat

SEQ ID NO: 226058 - DNA, 23 bp, Mus musculus
ccttgagcatactgattagggat

SEQ ID NO: 226059 - DNA, 21 bp, Mus musculus
atttttcattgggtaaggagc

SEQ ID NO: 226060 - DNA, 21 bp, Mus musculus
tttgattcttgagcttagctt

SEQ ID NO: 226061 - DNA, 23 bp, Mus musculus
catacaacaaactgagctgattt

SEQ ID NO: 226062 - DNA, 19 bp, Mus musculus
tgtatgtatgtatatatgt

SEQ ID NO: 226063 - DNA, 23 bp, Mus musculus
taagcttctgtcagtcactcagg

SEQ ID NO: 226064 - DNA, 23 bp, Mus musculus
caaactttagtattgaaggagtt

SEQ ID NO: 226065 - DNA, 22 bp, Mus musculus
acacatgtttatatatgtacaa

SEQ ID NO: 226066 - DNA, 20 bp, Mus musculus
tgagagtagggagtgagtac

SEQ ID NO: 226067 - DNA, 23 bp, Mus musculus
tcactctctgcataatatctgac

SEQ ID NO: 226068 - DNA, 23 bp, Mus musculus
agcagggactgtctctgactctg

SEQ ID NO: 226069 - DNA, 20 bp, Mus musculus
taagctctgacacaatcaag

SEQ ID NO: 226070 - DNA, 22 bp, Mus musculus
gtcacttcatatcccactcttc

SEQ ID NO: 226071 - DNA, 22 bp, Mus musculus
tgcctcacacggtcactcaggg

SEQ ID NO: 226072 - DNA, 23 bp, Mus musculus
tccctctgtctgtctgtctgtcc

SEQ ID NO: 226073 - DNA, 23 bp, Mus musculus
tctgtccgtccgtccgtgtgtgc

SEQ ID NO: 226074 - DNA, 20 bp, Mus musculus
tggagcgggatctcttaagc

SEQ ID NO: 226075 - DNA, 22 bp, Mus musculus
tgttttgtgaccaattatatgg

SEQ ID NO: 226076 - DNA, 21 bp, Mus musculus
atatatctgtgcatatctatg

SEQ ID NO: 226077 - DNA, 22 bp, Mus musculus
tgttttgtgaccaattatatgg

SEQ ID NO: 226078 - DNA, 23 bp, Mus musculus
aagtactgagagtggagatagag

SEQ ID NO: 226079 - DNA, 23 bp, Mus musculus
tatatctgtgcttatctatgaat

SEQ ID NO: 226080 - DNA, 23 bp, Mus musculus
tgctgagagtggagatagaggtc

SEQ ID NO: 226081 - DNA, 23 bp, Mus musculus
gcgtgtgtgtctgtctgtcattc

SEQ ID NO: 226082 - DNA, 23 bp, Mus musculus
tatatctgtgcttatctatgaat

SEQ ID NO: 226083 - DNA, 23 bp, Mus musculus
tgctgagagtggagatagaggtc

SEQ ID NO: 226084 - DNA, 22 bp, Mus musculus
tgttttgtgaccaattatatgg

SEQ ID NO: 226085 - DNA, 23 bp, Mus musculus
acagaacagtcattgctgagaga

SEQ ID NO: 226086 - DNA, 23 bp, Mus musculus
tgtctctgactgtgacttgtccc

SEQ ID NO: 226087 - DNA, 19 bp, Mus musculus
agaactcctgggagaccag

SEQ ID NO: 226088 - DNA, 23 bp, Mus musculus
atgtaacagagcagagacaggac

SEQ ID NO: 226089 - DNA, 21 bp, Mus musculus
tttacagaccctgatttggga

SEQ ID NO: 226090 - DNA, 21 bp, Mus musculus
aactactgttatttttttctt

SEQ ID NO: 226091 - DNA, 22 bp, Mus musculus
aggaacagagggaggtttgagg

SEQ ID NO: 226092 - DNA, 22 bp, Mus musculus
agagatgattgtgagctaacat

SEQ ID NO: 226093 - DNA, 23 bp, Mus musculus
tacttaattttagtttatggatg

SEQ ID NO: 226094 - DNA, 22 bp, Mus musculus
tgttttgtgaccaattatatgg

SEQ ID NO: 226095 - DNA, 19 bp, Mus musculus
atgatgttcatagactaag

SEQ ID NO: 226096 - DNA, 23 bp, Mus musculus
atagtgtttttgttcttctgcct

SEQ ID NO: 226097 - DNA, 23 bp, Mus musculus
tcactcccagacttctgtattgc

SEQ ID NO: 226098 - DNA, 21 bp, Mus musculus
gacctgatgatttcatttatt

SEQ ID NO: 226099 - DNA, 23 bp, Mus musculus
ttgaaaactactgttatagaact

SEQ ID NO: 226100 - DNA, 22 bp, Mus musculus
tctgtctcagtggttttggagg

SEQ ID NO: 226101 - DNA, 23 bp, Mus musculus
ttgttcagtttccatgtgaatgt

SEQ ID NO: 226102 - DNA, 21 bp, Mus musculus
ttttgtggtaggatctgatga

SEQ ID NO: 226103 - DNA, 23 bp, Mus musculus
ttggatttcctcagattctgttg

SEQ ID NO: 226104 - DNA, 23 bp, Mus musculus
actgtgtctctgtttagttcctg

SEQ ID NO: 226105 - DNA, 23 bp, Mus musculus
atatatgtgcatgcatatgtata

SEQ ID NO: 226106 - DNA, 23 bp, Mus musculus
atgagtgcctgcttgcatgtatg

SEQ ID NO: 226107 - DNA, 23 bp, Mus musculus
tattcaagctacaatcagtgaag

SEQ ID NO: 226108 - DNA, 22 bp, Mus musculus
gatagagcacagggtcctcagt

SEQ ID NO: 226109 - DNA, 21 bp, Mus musculus
ttcagactgctcttccagagg

SEQ ID NO: 226110 - DNA, 23 bp, Mus musculus
aggctggctgcgtgtatggagcg

SEQ ID NO: 226111 - DNA, 21 bp, Mus musculus
agaggtacaattgaagttcta

SEQ ID NO: 226112 - DNA, 22 bp, Mus musculus
tgttttgtgaccaattatatgg

SEQ ID NO: 226113 - DNA, 22 bp, Mus musculus
tgttttgtgaccaattatatgg

SEQ ID NO: 226114 - DNA, 21 bp, Mus musculus
tgtctagacacattttgagtt

SEQ ID NO: 226115 - DNA, 21 bp, Mus musculus
tctctcagtgactatgaactg

SEQ ID NO: 226116 - DNA, 20 bp, Mus musculus
aagagcactgactgctcttc

SEQ ID NO: 226117 - DNA, 18 bp, Mus musculus
tgagctgagtgtctgcag

SEQ ID NO: 226118 - DNA, 22 bp, Mus musculus
tgttttgtgaccaattatatgg

SEQ ID NO: 226119 - DNA, 23 bp, Mus musculus
gtggcactgacaggctgcctggc

SEQ ID NO: 226120 - DNA, 22 bp, Mus musculus
tgttttgtgaccaattatatgg

SEQ ID NO: 226121 - DNA, 23 bp, Mus musculus
tatatgtatatattcatatgtgt

SEQ ID NO: 226122 - DNA, 18 bp, Mus musculus
ttaccactcatttgcaaa

SEQ ID NO: 226123 - DNA, 23 bp, Mus musculus
taaactcaatttcttgatctatt

SEQ ID NO: 226124 - DNA, 23 bp, Mus musculus
aaatgtatagatcaatttgggca

SEQ ID NO: 226125 - DNA, 22 bp, Mus musculus
tgttttgtgaccaattatatgg

SEQ ID NO: 226126 - DNA, 22 bp, Mus musculus
tttgtagctgcatagcaactca

SEQ ID NO: 226127 - DNA, 23 bp, Mus musculus
agagccactctctgagtgtgact

SEQ ID NO: 226128 - DNA, 23 bp, Mus musculus
agagccactctctgagtgtgact

SEQ ID NO: 226129 - DNA, 23 bp, Mus musculus
tggcagacttgtgatattgtagg

SEQ ID NO: 226130 - DNA, 22 bp, Mus musculus
agactgtgaactgccttatcag

SEQ ID NO: 226131 - DNA, 22 bp, Mus musculus
tgttttgtgaccaattatatgg

SEQ ID NO: 226132 - DNA, 19 bp, Mus musculus
tgtatgtatacatgtatac

SEQ ID NO: 226133 - DNA, 19 bp, Mus musculus
tatgtgtatacatgtatac

SEQ ID NO: 226134 - DNA, 19 bp, Mus musculus
atacatatatatatgtgta

SEQ ID NO: 226135 - DNA, 23 bp, Mus musculus
actagagtgaagattgactggac

SEQ ID NO: 226136 - DNA, 23 bp, Mus musculus
tctctctagttgtttctgttagg

SEQ ID NO: 226137 - DNA, 23 bp, Mus musculus
agtttccatggatgggattttgt

SEQ ID NO: 226138 - DNA, 23 bp, Mus musculus
tttgagactcactcagtgactga

SEQ ID NO: 226139 - DNA, 19 bp, Mus musculus
tcttttgtgattttgttga

SEQ ID NO: 226140 - DNA, 19 bp, Mus musculus
tcagtcagttgagttcagg

SEQ ID NO: 226141 - DNA, 22 bp, Mus musculus
tgttttgtgaccaattatatgg

SEQ ID NO: 226142 - DNA, 23 bp, Mus musculus
aatgtcgtactagcttgattgga

SEQ ID NO: 226143 - DNA, 22 bp, Mus musculus
tctctccctctctgcatgttgt

SEQ ID NO: 226144 - DNA, 23 bp, Mus musculus
tataggcactggtttttaagtct

SEQ ID NO: 226145 - DNA, 20 bp, Mus musculus
atcatgctgggttaagtctt

SEQ ID NO: 226146 - DNA, 23 bp, Mus musculus
aaaagaagaaactgcaagatctc

SEQ ID NO: 226147 - DNA, 22 bp, Mus musculus
tgttttgtgaccaattatatgg

SEQ ID NO: 226148 - DNA, 22 bp, Mus musculus
acccagtgctttgtgtgtgcta

SEQ ID NO: 226149 - DNA, 23 bp, Mus musculus
ccactgagtgagtgaaatcccag

SEQ ID NO: 226150 - DNA, 19 bp, Mus musculus
accaagactgtgttgtagg

SEQ ID NO: 226151 - DNA, 22 bp, Mus musculus
tcattgtctgtcagtgtttcag

SEQ ID NO: 226152 - DNA, 22 bp, Mus musculus
gcagagacagaggcattgtagg

SEQ ID NO: 226153 - DNA, 23 bp, Mus musculus
gtaactgagactttctccacagc

SEQ ID NO: 226154 - DNA, 22 bp, Mus musculus
ctgtaagacctggaggaagtgg

SEQ ID NO: 226155 - DNA, 23 bp, Mus musculus
atgtttgagtgcttgaccatagg

SEQ ID NO: 226156 - DNA, 22 bp, Mus musculus
gtgtgtatgtttctgtgtgcat

SEQ ID NO: 226157 - DNA, 23 bp, Mus musculus
tatgtgtgtatgtgtatacatgt

SEQ ID NO: 226158 - DNA, 22 bp, Mus musculus
tgttttgtgaccaattatatgg

SEQ ID NO: 226159 - DNA, 23 bp, Mus musculus
tccagagaacacagagaggtttc

SEQ ID NO: 226160 - DNA, 23 bp, Mus musculus
tcaattttcagcaaccacatggt

SEQ ID NO: 226161 - DNA, 23 bp, Mus musculus
tgcctgcctgcctgcctgcctgt

SEQ ID NO: 226162 - DNA, 19 bp, Mus musculus
tgtgtgtgtgtgtgtgtgt

SEQ ID NO: 226163 - DNA, 22 bp, Mus musculus
tggttctccatctggaagtggt

SEQ ID NO: 226164 - DNA, 21 bp, Mus musculus
agtgtgcatgtctctgtgtga

SEQ ID NO: 226165 - DNA, 22 bp, Mus musculus
tgtatatatgtgtgtgcatatg

SEQ ID NO: 226166 - DNA, 23 bp, Mus musculus
ttggtttgtaagcaagtctgtgg

SEQ ID NO: 226167 - DNA, 18 bp, Mus musculus
ttaagaagttgctcaggt

SEQ ID NO: 226168 - DNA, 23 bp, Mus musculus
ttctctctactagctgctgtgta

SEQ ID NO: 226169 - DNA, 23 bp, Mus musculus
agccctaggctctctggctggca

SEQ ID NO: 226170 - DNA, 22 bp, Mus musculus
tagttgtgtggtttggtgcatg

SEQ ID NO: 226171 - DNA, 22 bp, Mus musculus
tctgataatggactaagcttct

SEQ ID NO: 226172 - DNA, 19 bp, Mus musculus
cacagaagacagtgaggtc

SEQ ID NO: 226173 - DNA, 23 bp, Mus musculus
aaatgaactgtgtgtgtgacatt

SEQ ID NO: 226174 - DNA, 19 bp, Mus musculus
atgtcaagagagtgtgcgc

SEQ ID NO: 226175 - DNA, 22 bp, Mus musculus
ctctggtctgtctctgtgatga

SEQ ID NO: 226176 - DNA, 23 bp, Mus musculus
tataacaactttatcaaggcatg

SEQ ID NO: 226177 - DNA, 23 bp, Mus musculus
atgtatgtatatatgtatgtcag

SEQ ID NO: 226178 - DNA, 19 bp, Mus musculus
gggtctctctcacacggac

SEQ ID NO: 226179 - DNA, 23 bp, Mus musculus
tttctgtcagaggttaagttccc

SEQ ID NO: 226180 - DNA, 23 bp, Mus musculus
tgaccacagaggctgctctgttc

SEQ ID NO: 226181 - DNA, 22 bp, Mus musculus
tgttttgtgaccaattatatgg

SEQ ID NO: 226182 - DNA, 23 bp, Mus musculus
gcttgtctctctgcctctgagtg

SEQ ID NO: 226183 - DNA, 18 bp, Mus musculus
tctgctttagtgatgtga

SEQ ID NO: 226184 - DNA, 23 bp, Mus musculus
tccttatcttaatgaatatatat

SEQ ID NO: 226185 - DNA, 22 bp, Mus musculus
tgttttgtgaccaattatatgg

SEQ ID NO: 226186 - DNA, 23 bp, Mus musculus
acttgtgatcctactgtctcaga

SEQ ID NO: 226187 - DNA, 23 bp, Mus musculus
attacaggtacatgataccacac

SEQ ID NO: 226188 - DNA, 21 bp, Mus musculus
tgtgtctctgtttagtttctg

SEQ ID NO: 226189 - DNA, 22 bp, Mus musculus
tgttttgtgaccaattatatgg

SEQ ID NO: 226190 - DNA, 21 bp, Mus musculus
tggtataagtaggtgtgacat

SEQ ID NO: 226191 - DNA, 21 bp, Mus musculus
ttctagttcatcagattatgt

SEQ ID NO: 226192 - DNA, 23 bp, Mus musculus
agtgaccacacacactctgagca

SEQ ID NO: 226193 - DNA, 20 bp, Mus musculus
tttgagtgttgtgggtgctg

SEQ ID NO: 226194 - DNA, 23 bp, Mus musculus
gtgatcttctggttctttgccag

SEQ ID NO: 226195 - DNA, 20 bp, Mus musculus
acttgagccaggcagtgttg

SEQ ID NO: 226196 - DNA, 21 bp, Mus musculus
aagaggtctttgtgctgggtc

SEQ ID NO: 226197 - DNA, 19 bp, Mus musculus
tatgtatgtgcatatgtat

SEQ ID NO: 226198 - DNA, 22 bp, Mus musculus
atgatggactgactctctgaaa

SEQ ID NO: 226199 - DNA, 22 bp, Mus musculus
tgttttgtgaccaattatatgg

SEQ ID NO: 226200 - DNA, 23 bp, Mus musculus
gtgtgtctgtctgtctgtgtctg

SEQ ID NO: 226201 - DNA, 20 bp, Mus musculus
ccatggtgatctgataggat

SEQ ID NO: 226202 - DNA, 21 bp, Mus musculus
tccatggtggtctgataggat

SEQ ID NO: 226203 - DNA, 23 bp, Mus musculus
cgcagactgtactttgtgtcctc

SEQ ID NO: 226204 - DNA, 23 bp, Mus musculus
aactatgttgtagatgataggct

SEQ ID NO: 226205 - DNA, 23 bp, Mus musculus
tcttgtgagtgcttgagtttggg

SEQ ID NO: 226206 - DNA, 23 bp, Mus musculus
atatctgaccataactctgtgag

SEQ ID NO: 226207 - DNA, 21 bp, Mus musculus
tgtgtacatgcatacataatg

SEQ ID NO: 226208 - DNA, 20 bp, Mus musculus
acatgacattgacagtaata

SEQ ID NO: 226209 - DNA, 23 bp, Mus musculus
atacacagcacatgtataggtgt

SEQ ID NO: 226210 - DNA, 23 bp, Mus musculus
ctgttggagtcactgtaatctga

SEQ ID NO: 226211 - DNA, 22 bp, Mus musculus
ttgtcactgtctagctgtgtga

SEQ ID NO: 226212 - DNA, 21 bp, Mus musculus
cacagactagtcagttagagt

SEQ ID NO: 226213 - DNA, 23 bp, Mus musculus
cactctgagacactctgcctgtg

SEQ ID NO: 226214 - DNA, 19 bp, Mus musculus
acagagttcatattcatgt

SEQ ID NO: 226215 - DNA, 22 bp, Mus musculus
tgttttgtgaccaattatatgg

SEQ ID NO: 226216 - DNA, 21 bp, Mus musculus
tcaggttctatgaataattct

SEQ ID NO: 226217 - DNA, 23 bp, Mus musculus
tttaatgagaatttgttgatcag

SEQ ID NO: 226218 - DNA, 23 bp, Mus musculus
ctgtctgtgtctgttaggtccct

SEQ ID NO: 226219 - DNA, 23 bp, Mus musculus
tgtgtctgtgagtgtgtggttat

SEQ ID NO: 226220 - DNA, 18 bp, Mus musculus
ccataggtgtgtggattc

SEQ ID NO: 226221 - DNA, 20 bp, Mus musculus
agagatatgacttactggtt

SEQ ID NO: 226222 - DNA, 23 bp, Mus musculus
agattctctccctcagtctctcc

SEQ ID NO: 226223 - DNA, 23 bp, Mus musculus
tgactcagtggttaagagcactg

SEQ ID NO: 226224 - DNA, 22 bp, Mus musculus
tgtcactgtgagataatgtgca

SEQ ID NO: 226225 - DNA, 23 bp, Mus musculus
tgtctgcctgcctgcctgcctgt

SEQ ID NO: 226226 - DNA, 21 bp, Mus musculus
tgcagatgcagagtcacgtgt

SEQ ID NO: 226227 - DNA, 23 bp, Mus musculus
aggatatgttactttatatatgt

SEQ ID NO: 226228 - DNA, 23 bp, Mus musculus
tgctcacagttcactctctctgc

SEQ ID NO: 226229 - DNA, 21 bp, Mus musculus
ttccaggctagagaggtggct

SEQ ID NO: 226230 - DNA, 23 bp, Mus musculus
ctgtctgtctgtctgtgggtatg

SEQ ID NO: 226231 - DNA, 23 bp, Mus musculus
agtgtctctgtcagcttttctca

SEQ ID NO: 226232 - DNA, 21 bp, Mus musculus
ctcagtgcttttgttttgttt

SEQ ID NO: 226233 - DNA, 23 bp, Mus musculus
tatatgtgcatgttcatgtgata

SEQ ID NO: 226234 - DNA, 22 bp, Mus musculus
tgttttgtgaccaattatatgg

SEQ ID NO: 226235 - DNA, 21 bp, Mus musculus
tatgaaacaggtcctgcagtc

SEQ ID NO: 226236 - DNA, 21 bp, Mus musculus
cagagacctgagtgagctgat

SEQ ID NO: 226237 - DNA, 19 bp, Mus musculus
aagtgctgggatatcaagc

SEQ ID NO: 226238 - DNA, 23 bp, Mus musculus
tgtatgtgtgtatgttgtagaac

SEQ ID NO: 226239 - DNA, 20 bp, Mus musculus
ttgacacagaactagccagt

SEQ ID NO: 226240 - DNA, 22 bp, Mus musculus
tgttttgtgaccaattctatgc

SEQ ID NO: 226241 - DNA, 23 bp, Mus musculus
taaaagatctatatgtggggctg

SEQ ID NO: 226242 - DNA, 22 bp, Mus musculus
tgttttgtgaccaattatatgg

SEQ ID NO: 226243 - DNA, 23 bp, Mus musculus
ttgagtgtgtgtatatctgtgtg

SEQ ID NO: 226244 - DNA, 22 bp, Mus musculus
tagcttagtggttaagagcaag

SEQ ID NO: 226245 - DNA, 22 bp, Mus musculus
tatctgtgtgtgcatgtgcatg

SEQ ID NO: 226246 - DNA, 23 bp, Mus musculus
tatgcctgtaaatacacatgtgt

SEQ ID NO: 226247 - DNA, 23 bp, Mus musculus
acatatcctattccttgtgtaag

SEQ ID NO: 226248 - DNA, 18 bp, Mus musculus
gtcagaagaaagagagga

SEQ ID NO: 226249 - DNA, 22 bp, Mus musculus
aaatacatgaagcatatattgt

SEQ ID NO: 226250 - DNA, 23 bp, Mus musculus
ctgccactgtgtctgtctctgtc

SEQ ID NO: 226251 - DNA, 23 bp, Mus musculus
tagtccatgatgatctgatagga

SEQ ID NO: 226252 - DNA, 23 bp, Mus musculus
tttgtgaccgattatatggtcaa

SEQ ID NO: 226253 - DNA, 22 bp, Mus musculus
atatatgcacatatacatatga

SEQ ID NO: 226254 - DNA, 22 bp, Mus musculus
acatacactcacatatacatat

SEQ ID NO: 226255 - DNA, 23 bp, Mus musculus
ctttctgtgtgtgaatgtgtatg

SEQ ID NO: 226256 - DNA, 23 bp, Mus musculus
tgactactctgtgtgtgagagag

SEQ ID NO: 226257 - DNA, 23 bp, Mus musculus
tattcacatgtatgcatatatgt

SEQ ID NO: 226258 - DNA, 23 bp, Mus musculus
tttatgaccaattatatggtgaa

SEQ ID NO: 226259 - DNA, 23 bp, Mus musculus
ctgtctgtctctgtgtattggca

SEQ ID NO: 226260 - DNA, 18 bp, Mus musculus
ttcagttctgattttgtt

SEQ ID NO: 226261 - DNA, 19 bp, Mus musculus
acaccgtacatcggaggta

SEQ ID NO: 226262 - DNA, 23 bp, Mus musculus
tccctgcctctctgtctgtatgt

SEQ ID NO: 226263 - DNA, 23 bp, Mus musculus
agtgtgtgatatgtgaaaatggt

SEQ ID NO: 226264 - DNA, 23 bp, Mus musculus
tagtgcatggtgatctgatagga

SEQ ID NO: 226265 - DNA, 22 bp, Mus musculus
tgttttgtgacctattatgtgg

SEQ ID NO: 226266 - DNA, 22 bp, Mus musculus
atatctgaatggttatgatgtg

SEQ ID NO: 226267 - DNA, 22 bp, Mus musculus
tgttttgtgaccaattatatgg

SEQ ID NO: 226268 - DNA, 23 bp, Mus musculus
gatatggtctatctgagaggtca

SEQ ID NO: 226269 - DNA, 21 bp, Mus musculus
tttctgagaggtcatggtgtg

SEQ ID NO: 226270 - DNA, 19 bp, Mus musculus
ataggacatgatatggtct

SEQ ID NO: 226271 - DNA, 21 bp, Mus musculus
tttctgagaggtcatggtgtg

SEQ ID NO: 226272 - DNA, 18 bp, Mus musculus
ctttagtgtttatggtgt

SEQ ID NO: 226273 - DNA, 23 bp, Mus musculus
tagtgcatggtgatctgatagga

SEQ ID NO: 226274 - DNA, 22 bp, Mus musculus
tgttttgtgacctattatgtgg

SEQ ID NO: 226275 - DNA, 22 bp, Mus musculus
tgttttgtgaccaattatatgg

SEQ ID NO: 226276 - DNA, 23 bp, Mus musculus
gatatggtctatctgagaggtca

SEQ ID NO: 226277 - DNA, 21 bp, Mus musculus
tttctgagaggtcatggtgtg

SEQ ID NO: 226278 - DNA, 23 bp, Mus musculus
tagtgcatggtgatctgatagga

SEQ ID NO: 226279 - DNA, 22 bp, Mus musculus
tgttttgtgacctattatgtgg

SEQ ID NO: 226280 - DNA, 23 bp, Mus musculus
gatatggtctatctgagaggtca

SEQ ID NO: 226281 - DNA, 21 bp, Mus musculus
tttctgagaggtcatggtgtg

SEQ ID NO: 226282 - DNA, 18 bp, Mus musculus
ctcccatctgggtgccaa

SEQ ID NO: 226283 - DNA, 18 bp, Mus musculus
ctcccatctgggtgccaa

SEQ ID NO: 226284 - DNA, 18 bp, Mus musculus
ctcccatctgggtgccaa

SEQ ID NO: 226285 - DNA, 23 bp, Mus musculus
tacacacacacacatatatatgt

SEQ ID NO: 226286 - DNA, 23 bp, Mus musculus
atatgtatatatgtatgtctgtg

SEQ ID NO: 226287 - DNA, 23 bp, Mus musculus
ttgctgtctctagtatcctggta

SEQ ID NO: 226288 - DNA, 23 bp, Mus musculus
tgagaccctgagaccctgagacc

SEQ ID NO: 226289 - DNA, 23 bp, Mus musculus
ttgggtctgtggattgtagtgtg

SEQ ID NO: 226290 - DNA, 23 bp, Mus musculus
tgtttctgtctgtgtgagtctgt

SEQ ID NO: 226291 - DNA, 22 bp, Mus musculus
agtgagcatagatgtgtgggtt

SEQ ID NO: 226292 - DNA, 23 bp, Mus musculus
tagtgcatggtgatctgatagga

SEQ ID NO: 226293 - DNA, 22 bp, Mus musculus
tgttttgtgacctattatgtgg

SEQ ID NO: 226294 - DNA, 23 bp, Mus musculus
gatatggtctatctgagaggtca

SEQ ID NO: 226295 - DNA, 21 bp, Mus musculus
tttctgagaggtcatggtgtg

SEQ ID NO: 226296 - DNA, 23 bp, Mus musculus
tagtgcatggtgatctgatagga

SEQ ID NO: 226297 - DNA, 22 bp, Mus musculus
tgttttgtgacctattatgtgg

SEQ ID NO: 226298 - DNA, 22 bp, Mus musculus
tgttttgtgaccaattatatgg

SEQ ID NO: 226299 - DNA, 22 bp, Mus musculus
agtgagcatagatgtgtgggtt

SEQ ID NO: 226300 - DNA, 23 bp, Mus musculus
gcactcccactgtgcttgggcta

SEQ ID NO: 226301 - DNA, 21 bp, Mus musculus
tccatggtggtctgataggat

SEQ ID NO: 226302 - DNA, 21 bp, Mus musculus
agccaggctctgtctcagtca

SEQ ID NO: 226303 - DNA, 23 bp, Mus musculus
taatactttctagttctatccat

SEQ ID NO: 226304 - DNA, 22 bp, Mus musculus
tgttttgtgaccaattatatgg

SEQ ID NO: 226305 - DNA, 22 bp, Mus musculus
tgttttgtgaccaattatatgg

SEQ ID NO: 226306 - DNA, 22 bp, Mus musculus
tgttttgtgaccaattatatgg

SEQ ID NO: 226307 - DNA, 22 bp, Mus musculus
ggtttcacactcttttgggaag

SEQ ID NO: 226308 - DNA, 23 bp, Mus musculus
tgatctcaggctctgtcagtctt

SEQ ID NO: 226309 - DNA, 23 bp, Mus musculus
actgccactgtgtctcagtctgc

SEQ ID NO: 226310 - DNA, 22 bp, Mus musculus
tgttttgtgaccaattatatgg

SEQ ID NO: 226311 - DNA, 22 bp, Mus musculus
tgttttgtgaccaattatatgg

SEQ ID NO: 226312 - DNA, 23 bp, Mus musculus
ctatatgtatatatatatgtgtg

SEQ ID NO: 226313 - DNA, 20 bp, Mus musculus
taatgcacataatagattga

SEQ ID NO: 226314 - DNA, 21 bp, Mus musculus
tttacatggaacactgtgaat

SEQ ID NO: 226315 - DNA, 23 bp, Mus musculus
tttgttccttttgaaatctctaa

SEQ ID NO: 226316 - DNA, 22 bp, Mus musculus
tgttttgtgaccaattatatgg

SEQ ID NO: 226317 - DNA, 23 bp, Mus musculus
gaatggaagtgagttgatattga

SEQ ID NO: 226318 - DNA, 19 bp, Mus musculus
atggttgcacaagtttgca

SEQ ID NO: 226319 - DNA, 18 bp, Mus musculus
agctagtatatgctgcct

SEQ ID NO: 226320 - DNA, 23 bp, Mus musculus
tttatctgtcagcatgaaaagac

SEQ ID NO: 226321 - DNA, 22 bp, Mus musculus
tgttttgtgaccaattatatgg

SEQ ID NO: 226322 - DNA, 21 bp, Mus musculus
tcactgtcattcactgtcatt

SEQ ID NO: 226323 - DNA, 21 bp, Mus musculus
tttgtgcaccaaaaagcctgt

SEQ ID NO: 226324 - DNA, 19 bp, Mus musculus
aaatggatgctttgctatg

SEQ ID NO: 226325 - DNA, 18 bp, Mus musculus
ttttttttgtcataggaa

SEQ ID NO: 226326 - DNA, 23 bp, Mus musculus
acaggttgttgtagaagccttca

SEQ ID NO: 226327 - DNA, 23 bp, Mus musculus
ttgacacaagatagagtcatcaa

SEQ ID NO: 226328 - DNA, 22 bp, Mus musculus
gaaaggttatgtaaatatctgt

SEQ ID NO: 226329 - DNA, 23 bp, Mus musculus
agccactctggatttcagttcct

SEQ ID NO: 226330 - DNA, 22 bp, Mus musculus
aaatggtgttggagctggtgag

SEQ ID NO: 226331 - DNA, 22 bp, Mus musculus
tgttttgtgaccaattatatgg

SEQ ID NO: 226332 - DNA, 21 bp, Mus musculus
atgccatttgttaagtgactg

SEQ ID NO: 226333 - DNA, 21 bp, Mus musculus
tttatctactagccctagtga

SEQ ID NO: 226334 - DNA, 21 bp, Mus musculus
agtgcattcatttatgtgtgt

SEQ ID NO: 226335 - DNA, 20 bp, Mus musculus
gccaaggaaaagaaaccaaa

SEQ ID NO: 226336 - DNA, 18 bp, Mus musculus
ggcctgtgtatgtgctgt

SEQ ID NO: 226337 - DNA, 21 bp, Mus musculus
aacacactcactctatcccgt

SEQ ID NO: 226338 - DNA, 23 bp, Mus musculus
tgactgtgtatctgtgtcttttt

SEQ ID NO: 226339 - DNA, 22 bp, Mus musculus
tatgtgagtatatatgtatgtg

SEQ ID NO: 226340 - DNA, 23 bp, Mus musculus
tgtttttctttatgattatgtcc

SEQ ID NO: 226341 - DNA, 19 bp, Mus musculus
agaatgaattgggtagagt

SEQ ID NO: 226342 - DNA, 19 bp, Mus musculus
ctttctgcttctattttgt

SEQ ID NO: 226343 - DNA, 23 bp, Mus musculus
ttgaaagagaacacagagagttc

SEQ ID NO: 226344 - DNA, 23 bp, Mus musculus
gtgttagtccttgttgtttgatg

SEQ ID NO: 226345 - DNA, 19 bp, Mus musculus
atgagcttggtgtttagac

SEQ ID NO: 226346 - DNA, 23 bp, Mus musculus
aattctcagtctcagtcagtcag

SEQ ID NO: 226347 - DNA, 23 bp, Mus musculus
aggctcaggctctgtctcagtct

SEQ ID NO: 226348 - DNA, 19 bp, Mus musculus
agagaaaataggcacagga

SEQ ID NO: 226349 - DNA, 20 bp, Mus musculus
tgtcggttactgttttgctc

SEQ ID NO: 226350 - DNA, 23 bp, Mus musculus
atctgagagaattctttgtgttc

SEQ ID NO: 226351 - DNA, 23 bp, Mus musculus
agatctgtctgtttctgtctctg

SEQ ID NO: 226352 - DNA, 23 bp, Mus musculus
attttgagaatgcttcatgttgg

SEQ ID NO: 226353 - DNA, 18 bp, Mus musculus
tctcaatttttttatttg

SEQ ID NO: 226354 - DNA, 19 bp, Mus musculus
tcctagagtcggtttaaag

SEQ ID NO: 226355 - DNA, 23 bp, Mus musculus
atgctacatagactgtaagtgta

SEQ ID NO: 226356 - DNA, 23 bp, Mus musculus
atccctgacagtttggactatgt

SEQ ID NO: 226357 - DNA, 23 bp, Mus musculus
tgtatgtttgagtctctgctctc

SEQ ID NO: 226358 - DNA, 23 bp, Mus musculus
acagtgcaagtaagaataggtgt

SEQ ID NO: 226359 - DNA, 19 bp, Mus musculus
tggtcttttctgaagagaa

SEQ ID NO: 226360 - DNA, 22 bp, Mus musculus
gcaagatttagagctctatctg

SEQ ID NO: 226361 - DNA, 23 bp, Mus musculus
ttatactgtttgcatatgtacat

SEQ ID NO: 226362 - DNA, 18 bp, Mus musculus
tgaccaacaagtgttgcc

SEQ ID NO: 226363 - DNA, 18 bp, Mus musculus
aaggaagaaagtgagcac

SEQ ID NO: 226364 - DNA, 23 bp, Mus musculus
atactgaggatataatttcatgt

SEQ ID NO: 226365 - DNA, 21 bp, Mus musculus
atgagagaaaaagatgtgttt

SEQ ID NO: 226366 - DNA, 21 bp, Mus musculus
gtatcaattgaacacaaacga

SEQ ID NO: 226367 - DNA, 20 bp, Mus musculus
tgtgtatgtatgtatgtatg

SEQ ID NO: 226368 - DNA, 23 bp, Mus musculus
tcctgaactacatgctgcagttt

SEQ ID NO: 226369 - DNA, 23 bp, Mus musculus
tagtgacaggagacacagagcac

SEQ ID NO: 226370 - DNA, 23 bp, Mus musculus
tggtttgctgttcttctagagga

SEQ ID NO: 226371 - DNA, 23 bp, Mus musculus
agtccatggttatctgataggat

SEQ ID NO: 226372 - DNA, 23 bp, Mus musculus
tttgtgaccaattatatagtcaa

SEQ ID NO: 226373 - DNA, 23 bp, Mus musculus
tttctctgtatatctctgtctgt

SEQ ID NO: 226374 - DNA, 23 bp, Mus musculus
tagtccatggtgttctgatagga

SEQ ID NO: 226375 - DNA, 22 bp, Mus musculus
tgttttgtgaccaattatatgg

SEQ ID NO: 226376 - DNA, 23 bp, Mus musculus
tatgtatatgtatatgtatatgt

SEQ ID NO: 226377 - DNA, 21 bp, Mus musculus
tgggctatactagaaaatcct

SEQ ID NO: 226378 - DNA, 23 bp, Mus musculus
tcaacagtagatccagttctaat

SEQ ID NO: 226379 - DNA, 18 bp, Mus musculus
tgcatattatatatcaca

SEQ ID NO: 226380 - DNA, 23 bp, Mus musculus
tgtctctgactctgtgcctgcca

SEQ ID NO: 226381 - DNA, 23 bp, Mus musculus
tatcgcataggtagaatacagaa

SEQ ID NO: 226382 - DNA, 23 bp, Mus musculus
tatgcatgtatatatgtatgtat

SEQ ID NO: 226383 - DNA, 22 bp, Mus musculus
acagtgcacagaaacgtttgac

SEQ ID NO: 226384 - DNA, 20 bp, Mus musculus
agtggtggtggtggtggtgg

SEQ ID NO: 226385 - DNA, 23 bp, Mus musculus
tgtgtgtgtctgtctgtcattca

SEQ ID NO: 226386 - DNA, 23 bp, Mus musculus
tgtctgcctgcctgcctgcctgt

SEQ ID NO: 226387 - DNA, 21 bp, Mus musculus
gtggcactgtctgtcatcctc

SEQ ID NO: 226388 - DNA, 22 bp, Mus musculus
tgttttgtgaccaattatatgg

SEQ ID NO: 226389 - DNA, 22 bp, Mus musculus
tgttttgtgaccaattatatgg

SEQ ID NO: 226390 - DNA, 23 bp, Mus musculus
tagtgcatggtgatctgatagga

SEQ ID NO: 226391 - DNA, 22 bp, Mus musculus
tgttttgtgacctattatgtgg

SEQ ID NO: 226392 - DNA, 23 bp, Mus musculus
ttttgtgaccaattctatggtca

SEQ ID NO: 226393 - DNA, 19 bp, Mus musculus
tgcaggagaagggactgag

SEQ ID NO: 226394 - DNA, 19 bp, Mus musculus
tccctgtgtgaaacaggta

SEQ ID NO: 226395 - DNA, 23 bp, Mus musculus
tacatactgagttgtccatgtca

SEQ ID NO: 226396 - DNA, 22 bp, Mus musculus
tgtgagccactatgtagtttct

SEQ ID NO: 226397 - DNA, 23 bp, Mus musculus
tctgagagaacagtcagtgctct

SEQ ID NO: 226398 - DNA, 23 bp, Mus musculus
tggctggctggctggctggctgg

SEQ ID NO: 226399 - DNA, 23 bp, Mus musculus
taccaccatttaaattctcatag

SEQ ID NO: 226400 - DNA, 23 bp, Mus musculus
agcatttcaggttctgtttcatt

SEQ ID NO: 226401 - DNA, 23 bp, Mus musculus
actctgactcccactgttaggag

SEQ ID NO: 226402 - DNA, 23 bp, Mus musculus
ctctgtctctggttaaggttctc

SEQ ID NO: 226403 - DNA, 21 bp, Mus musculus
tcaggatttttgactctgttt

SEQ ID NO: 226404 - DNA, 21 bp, Mus musculus
tctctctgtctcaggtttggc

SEQ ID NO: 226405 - DNA, 23 bp, Mus musculus
tgggtctggctctgactctagat

SEQ ID NO: 226406 - DNA, 23 bp, Mus musculus
tatgactctatgactttatggcc

SEQ ID NO: 226407 - DNA, 23 bp, Mus musculus
tcactggctcactgactcactag

SEQ ID NO: 226408 - DNA, 23 bp, Mus musculus
tctgactgtcaggctctcacttc

SEQ ID NO: 226409 - DNA, 23 bp, Mus musculus
actttggctgtctggctctctga

SEQ ID NO: 226410 - DNA, 23 bp, Mus musculus
ttttggctcaggatctctggctc

SEQ ID NO: 226411 - DNA, 18 bp, Mus musculus
cctacatggttagaaagt

SEQ ID NO: 226412 - DNA, 23 bp, Mus musculus
cttataagttgatttcttttgaa

SEQ ID NO: 226413 - DNA, 23 bp, Mus musculus
ggagatttactagtagttcctac

SEQ ID NO: 226414 - DNA, 18 bp, Mus musculus
atgcgtgtgtgtgtgtgt

SEQ ID NO: 226415 - DNA, 23 bp, Mus musculus
cttataagttgatttcttttgaa

SEQ ID NO: 226416 - DNA, 22 bp, Mus musculus
ggagatttactagtagttccta

SEQ ID NO: 226417 - DNA, 22 bp, Mus musculus
tatgcgtgtgtgtgtgtgtgtg

SEQ ID NO: 226418 - DNA, 23 bp, Mus musculus
cttataagttgatttcttttgaa

SEQ ID NO: 226419 - DNA, 22 bp, Mus musculus
ggagatttactagtagttccta

SEQ ID NO: 226420 - DNA, 22 bp, Mus musculus
tatgcgtgtgtgtgtgtgtgtg

SEQ ID NO: 226421 - DNA, 23 bp, Mus musculus
cttataagttgatttcttttgaa

SEQ ID NO: 226422 - DNA, 22 bp, Mus musculus
ggagatttactagtagttccta

SEQ ID NO: 226423 - DNA, 22 bp, Mus musculus
taaattcaagaagatgatgtat

SEQ ID NO: 226424 - DNA, 23 bp, Mus musculus
tgtctctctgtctgtgtctttgt

SEQ ID NO: 226425 - DNA, 22 bp, Mus musculus
tgttttgtgaccaattatatgg

SEQ ID NO: 226426 - DNA, 23 bp, Mus musculus
ttctgtgtctcggtgtctcggtg

SEQ ID NO: 226427 - DNA, 23 bp, Mus musculus
tggaagagctgccgctgctctgt

SEQ ID NO: 226428 - DNA, 18 bp, Mus musculus
acaagtagtatctttttt

SEQ ID NO: 226429 - DNA, 23 bp, Mus musculus
tgtgtgtgtccatagcatgtgtg

SEQ ID NO: 226430 - DNA, 23 bp, Mus musculus
atctgagagagcagtgtgtgctc

SEQ ID NO: 226431 - DNA, 23 bp, Mus musculus
accctgttttgtttattgaagct

SEQ ID NO: 226432 - DNA, 23 bp, Mus musculus
tctgtctgtctgtctgtctgtct

SEQ ID NO: 226433 - DNA, 22 bp, Mus musculus
acatctgttgaatgagtgaggg

SEQ ID NO: 226434 - DNA, 18 bp, Mus musculus
ttatttgtatatataggt

SEQ ID NO: 226435 - DNA, 23 bp, Mus musculus
atttgagagggaaaaacatcagt

SEQ ID NO: 226436 - DNA, 23 bp, Mus musculus
gtatctgtctgagtcagctgctg

SEQ ID NO: 226437 - DNA, 18 bp, Mus musculus
tacatacacacatatgta

SEQ ID NO: 226438 - DNA, 23 bp, Mus musculus
atatgtgtgtgtattgtgtatgt

SEQ ID NO: 226439 - DNA, 23 bp, Mus musculus
ccactgtcactgtttccctctgt

SEQ ID NO: 226440 - DNA, 21 bp, Mus musculus
agactgtgaatactttgaggt

SEQ ID NO: 226441 - DNA, 23 bp, Mus musculus
gtgagagtcagaactgagagagg

SEQ ID NO: 226442 - DNA, 23 bp, Mus musculus
atacttctcaggctttgaacttc

SEQ ID NO: 226443 - DNA, 21 bp, Mus musculus
tttagactgttgatgtccagt

SEQ ID NO: 226444 - DNA, 20 bp, Mus musculus
tcacagaactgagtgacttg

SEQ ID NO: 226445 - DNA, 23 bp, Mus musculus
tttggtattagataagtaactga

SEQ ID NO: 226446 - DNA, 22 bp, Mus musculus
tgttttgtgaccaattatatgg

SEQ ID NO: 226447 - DNA, 21 bp, Mus musculus
agctccatttatttagtgtct

SEQ ID NO: 226448 - DNA, 23 bp, Mus musculus
tgagaggctctgtcagtgcctga

SEQ ID NO: 226449 - DNA, 23 bp, Mus musculus
tgtgtatgtgtatatgtatatgt

SEQ ID NO: 226450 - DNA, 22 bp, Mus musculus
tgttttgtgaccaattatatgg

SEQ ID NO: 226451 - DNA, 20 bp, Mus musculus
aaggtgcatggaatttttat

SEQ ID NO: 226452 - DNA, 21 bp, Mus musculus
ttcacaggtgagagtgtggac

SEQ ID NO: 226453 - DNA, 23 bp, Mus musculus
agtccatgatgatctcataggat

SEQ ID NO: 226454 - DNA, 23 bp, Mus musculus
tctgttgagacttgttttgtgtc

SEQ ID NO: 226455 - DNA, 19 bp, Mus musculus
tgatttttgtgtatggtga

SEQ ID NO: 226456 - DNA, 23 bp, Mus musculus
gtgtctcacacagtctccttctg

SEQ ID NO: 226457 - DNA, 23 bp, Mus musculus
tatattccatttttattgggttg

SEQ ID NO: 226458 - DNA, 22 bp, Mus musculus
tgttttgtgaccaattatatgg

SEQ ID NO: 226459 - DNA, 23 bp, Mus musculus
tcatgtagtccaggatgtcctca

SEQ ID NO: 226460 - DNA, 20 bp, Mus musculus
tgattatcctgaaagcagtt

SEQ ID NO: 226461 - DNA, 23 bp, Mus musculus
atggttcttgttttagggacagg

SEQ ID NO: 226462 - DNA, 23 bp, Mus musculus
tctcactgtgactaagaaaaatt

SEQ ID NO: 226463 - DNA, 23 bp, Mus musculus
tatgtgtatatatctgagtgcat

SEQ ID NO: 226464 - DNA, 23 bp, Mus musculus
atagatgcacaatatgaatgcag

SEQ ID NO: 226465 - DNA, 22 bp, Mus musculus
tgttttgtgaccaattatatgg

SEQ ID NO: 226466 - DNA, 22 bp, Mus musculus
agagaatatgactatgagtcca

SEQ ID NO: 226467 - DNA, 23 bp, Mus musculus
atttaagtagattacttttcact

SEQ ID NO: 226468 - DNA, 20 bp, Mus musculus
atcagcaaactgtttctgta

SEQ ID NO: 226469 - DNA, 22 bp, Mus musculus
tgttttgtgaccaattatatgg

SEQ ID NO: 226470 - DNA, 23 bp, Mus musculus
ttttagcttgtataccagatgta

SEQ ID NO: 226471 - DNA, 23 bp, Mus musculus
aattggttcttgaattggttaat

SEQ ID NO: 226472 - DNA, 23 bp, Mus musculus
tatctcagtgctcttagtgtcac

SEQ ID NO: 226473 - DNA, 22 bp, Mus musculus
tgttttgtgaccaattatatgg

SEQ ID NO: 226474 - DNA, 23 bp, Mus musculus
atcagatgtggttttcttgtttt

SEQ ID NO: 226475 - DNA, 20 bp, Mus musculus
tctggtagtaggatttttat

SEQ ID NO: 226476 - DNA, 22 bp, Mus musculus
gatctctgtctgcctgtctccc

SEQ ID NO: 226477 - DNA, 23 bp, Mus musculus
tttttgtatctattgaggactgt

SEQ ID NO: 226478 - DNA, 23 bp, Mus musculus
ttagcttgtgttgttttgagggt

SEQ ID NO: 226479 - DNA, 19 bp, Mus musculus
aaaggcaactcaagatttg

SEQ ID NO: 226480 - DNA, 21 bp, Mus musculus
tgcatgtatgtatgtatgcat

SEQ ID NO: 226481 - DNA, 23 bp, Mus musculus
tagaacagagtattcagagtgct

SEQ ID NO: 226482 - DNA, 23 bp, Mus musculus
cagtttatcttgtacgtactgca

SEQ ID NO: 226483 - DNA, 23 bp, Mus musculus
gtatatgtatatgtatatgtgtg

SEQ ID NO: 226484 - DNA, 23 bp, Mus musculus
tatatatctatttctatatggta

SEQ ID NO: 226485 - DNA, 19 bp, Mus musculus
tatgtggtaatttttaggt

SEQ ID NO: 226486 - DNA, 23 bp, Mus musculus
tagtccatgttgatctgatagga

SEQ ID NO: 226487 - DNA, 23 bp, Mus musculus
tatatgtatatgtatatgtatat

SEQ ID NO: 226488 - DNA, 21 bp, Mus musculus
tccaatagatttatgtgttga

SEQ ID NO: 226489 - DNA, 19 bp, Mus musculus
tgcttctgtccattacttc

SEQ ID NO: 226490 - DNA, 19 bp, Mus musculus
cttttttacttaacctagg

SEQ ID NO: 226491 - DNA, 22 bp, Mus musculus
tgttttgtgaccaattatatgg

SEQ ID NO: 226492 - DNA, 22 bp, Mus musculus
tgttttgtgaccaattatatgg

SEQ ID NO: 226493 - DNA, 20 bp, Mus musculus
attgcatcttaattagagtc

SEQ ID NO: 226494 - DNA, 19 bp, Mus musculus
tgtcagaagagtgtcagca

SEQ ID NO: 226495 - DNA, 22 bp, Mus musculus
tgttttgtgaccaattatatgg

SEQ ID NO: 226496 - DNA, 23 bp, Mus musculus
tgtgtgtgcatgtgcatgtgtgt

SEQ ID NO: 226497 - DNA, 23 bp, Mus musculus
tgtgtgtgcatgtgcatgtgtgt

SEQ ID NO: 226498 - DNA, 23 bp, Mus musculus
tgtgtgtgcatgtgcatgtgtgt

SEQ ID NO: 226499 - DNA, 23 bp, Mus musculus
tgtgtgtgcatgtgcatgtgtgt

SEQ ID NO: 226500 - DNA, 22 bp, Mus musculus
tgttttgtgaccaattatatgg

SEQ ID NO: 226501 - DNA, 22 bp, Mus musculus
tgttttgtgaccaattatatgg

SEQ ID NO: 226502 - DNA, 22 bp, Mus musculus
tgttttgtgaccaattatatgg

SEQ ID NO: 226503 - DNA, 22 bp, Mus musculus
tgttttgtgaccaattatatgg

SEQ ID NO: 226504 - DNA, 23 bp, Mus musculus
ttgtgaccaattatattgtcaat

SEQ ID NO: 226505 - DNA, 23 bp, Mus musculus
tttgagaccctgaaatactggtg

SEQ ID NO: 226506 - DNA, 22 bp, Mus musculus
tgactagtttttgtctcctgat

SEQ ID NO: 226507 - DNA, 19 bp, Mus musculus
tcactatttgtttatgtga

SEQ ID NO: 226508 - DNA, 22 bp, Mus musculus
tgttttgtgaccaattatatgg

SEQ ID NO: 226509 - DNA, 18 bp, Mus musculus
tatatagattgatttttt

SEQ ID NO: 226510 - DNA, 23 bp, Mus musculus
aaagagtgttgttcagtttctac

SEQ ID NO: 226511 - DNA, 22 bp, Mus musculus
cttagtccatggtgatctgata

SEQ ID NO: 226512 - DNA, 22 bp, Mus musculus
ttatgtatagatgttagttgtt

SEQ ID NO: 226513 - DNA, 20 bp, Mus musculus
aagcagtctataatacatgt

SEQ ID NO: 226514 - DNA, 22 bp, Mus musculus
tgttttgtgaccaattatatgg

SEQ ID NO: 226515 - DNA, 23 bp, Mus musculus
tatatgtatgtatatatgtgtgt

SEQ ID NO: 226516 - DNA, 23 bp, Mus musculus
tacctgggagatgatgaagagag

SEQ ID NO: 226517 - DNA, 22 bp, Mus musculus
tgttttgtgaccaattatatgg

SEQ ID NO: 226518 - DNA, 21 bp, Mus musculus
tccatgatgatctgatgggat

SEQ ID NO: 226519 - DNA, 21 bp, Mus musculus
tgttttctgtccaattatatg

SEQ ID NO: 226520 - DNA, 23 bp, Mus musculus
tctctctctctctcccagaagtt

SEQ ID NO: 226521 - DNA, 23 bp, Mus musculus
agcttcttggttgaggttgggat

SEQ ID NO: 226522 - DNA, 23 bp, Mus musculus
tagagctcttgctctggcgctct

SEQ ID NO: 226523 - DNA, 19 bp, Mus musculus
aggatagagccttgtgaca

SEQ ID NO: 226524 - DNA, 21 bp, Mus musculus
tgtggatgaatgacagacaga

SEQ ID NO: 226525 - DNA, 21 bp, Mus musculus
tgagctttctgtaaggtgaca

SEQ ID NO: 226526 - DNA, 23 bp, Mus musculus
ttttcatttttgtacatacagac

SEQ ID NO: 226527 - DNA, 23 bp, Mus musculus
ctctatttttgtagctgtattgg

SEQ ID NO: 226528 - DNA, 23 bp, Mus musculus
tgagaggctctgtcagtgcctca

SEQ ID NO: 226529 - DNA, 21 bp, Mus musculus
taactattacctctcgccttc

SEQ ID NO: 226530 - DNA, 23 bp, Mus musculus
ctctgcttcacactttgtctctg

SEQ ID NO: 226531 - DNA, 23 bp, Mus musculus
caatatttttgtatctgttgagg

SEQ ID NO: 226532 - DNA, 23 bp, Mus musculus
actgtgtctctgtttagtttctg

SEQ ID NO: 226533 - DNA, 23 bp, Mus musculus
actcactctctcagttctttcag

SEQ ID NO: 226534 - DNA, 19 bp, Mus musculus
gtttgaagatgtcctccag

SEQ ID NO: 226535 - DNA, 22 bp, Mus musculus
tcggtctctgtttcaatcaacc

SEQ ID NO: 226536 - DNA, 22 bp, Mus musculus
tgttttgtgaccaattatatgg

SEQ ID NO: 226537 - DNA, 22 bp, Mus musculus
ctgtctatgtatgtatgtgtgt

SEQ ID NO: 226538 - DNA, 20 bp, Mus musculus
tgtcagtggtcagagagctc

SEQ ID NO: 226539 - DNA, 19 bp, Mus musculus
atctcctggagctggtgct

SEQ ID NO: 226540 - DNA, 21 bp, Mus musculus
agtggatatatatacatgcag

SEQ ID NO: 226541 - DNA, 22 bp, Mus musculus
ttgaccttgaacttcagagcct

SEQ ID NO: 226542 - DNA, 20 bp, Mus musculus
ggttgctcttcaagttgtag

SEQ ID NO: 226543 - DNA, 21 bp, Mus musculus
tgcatgtgtatatgaatgtat

SEQ ID NO: 226544 - DNA, 20 bp, Mus musculus
ttttgtgaccaattatatgg

SEQ ID NO: 226545 - DNA, 23 bp, Mus musculus
acaattagagatgctttgttatc

SEQ ID NO: 226546 - DNA, 23 bp, Mus musculus
agtgttgtctactctttggttgg

SEQ ID NO: 226547 - DNA, 22 bp, Mus musculus
tgttttgtgaccaattatatgg

SEQ ID NO: 226548 - DNA, 22 bp, Mus musculus
tgttttgtgaccaattatatgg

SEQ ID NO: 226549 - DNA, 23 bp, Mus musculus
gcatagatctctgtctctgtgtt

SEQ ID NO: 226550 - DNA, 20 bp, Mus musculus
ttgtgtatgtgtatatgtgt

SEQ ID NO: 226551 - DNA, 19 bp, Mus musculus
ctgcacattgtgtgtgtgt

SEQ ID NO: 226552 - DNA, 23 bp, Mus musculus
agacaatctcaggtgatgatctt

SEQ ID NO: 226553 - DNA, 22 bp, Mus musculus
catagaggctagactatgacat

SEQ ID NO: 226554 - DNA, 22 bp, Mus musculus
attcatgtatttcataagacat

SEQ ID NO: 226555 - DNA, 22 bp, Mus musculus
tgtgtgtttgtgtatatgtaca

SEQ ID NO: 226556 - DNA, 22 bp, Mus musculus
tgttttgtgaccaattatatgg

SEQ ID NO: 226557 - DNA, 22 bp, Mus musculus
tgttttgtgaccaattatatgg

SEQ ID NO: 226558 - DNA, 22 bp, Mus musculus
tgttttgtgaccaattatatgg

SEQ ID NO: 226559 - DNA, 22 bp, Mus musculus
tgagtatctgcatctgtattgg

SEQ ID NO: 226560 - DNA, 23 bp, Mus musculus
tcatcactctttgtctctatctg

SEQ ID NO: 226561 - DNA, 23 bp, Mus musculus
tcactggatctctctgtctctct

SEQ ID NO: 226562 - DNA, 18 bp, Mus musculus
ggtaaagtaagtgtagtt

SEQ ID NO: 226563 - DNA, 23 bp, Mus musculus
tagtgcatgatgatctgatagga

SEQ ID NO: 226564 - DNA, 22 bp, Mus musculus
tgttttgtgacctattatgtgg

SEQ ID NO: 226565 - DNA, 23 bp, Mus musculus
ctgtctctctgtctctatctcct

SEQ ID NO: 226566 - DNA, 23 bp, Mus musculus
tatatattgtgtatatctttgca

SEQ ID NO: 226567 - DNA, 23 bp, Mus musculus
tttgaatttcttcaggatctgtt

SEQ ID NO: 226568 - DNA, 20 bp, Mus musculus
ttcatttctgattttgttga

SEQ ID NO: 226569 - DNA, 22 bp, Mus musculus
ctgtctctgtctcagccagttg

SEQ ID NO: 226570 - DNA, 23 bp, Mus musculus
atgtgcatatatatacatatgtg

SEQ ID NO: 226571 - DNA, 22 bp, Mus musculus
tgttttgtgaccaattatatgg

SEQ ID NO: 226572 - DNA, 23 bp, Mus musculus
atgtctgatgactctggaactct

SEQ ID NO: 226573 - DNA, 23 bp, Mus musculus
tgtatcactctactaatgctgtc

SEQ ID NO: 226574 - DNA, 22 bp, Mus musculus
tttatctcactatctgttaaag

SEQ ID NO: 226575 - DNA, 23 bp, Mus musculus
tacacacagacatatatatgtgt

SEQ ID NO: 226576 - DNA, 22 bp, Mus musculus
gaagagagaatgccatgttgga

SEQ ID NO: 226577 - DNA, 23 bp, Mus musculus
cactctcagtgacacacttcttc

SEQ ID NO: 226578 - DNA, 23 bp, Mus musculus
tgagattttgggtgtgtcagagt

SEQ ID NO: 226579 - DNA, 23 bp, Mus musculus
tctgactctgtctctaacctgca

SEQ ID NO: 226580 - DNA, 23 bp, Mus musculus
tcatcagtgtggctgagttcagg

SEQ ID NO: 226581 - DNA, 23 bp, Mus musculus
atgtatgtatatgtatgcatatc

SEQ ID NO: 226582 - DNA, 21 bp, Mus musculus
aagcaagtagaggaatccatt

SEQ ID NO: 226583 - DNA, 23 bp, Mus musculus
ctcacactgtcaggatctctgtc

SEQ ID NO: 226584 - DNA, 22 bp, Mus musculus
tatgtgtatatatatatgtatg

SEQ ID NO: 226585 - DNA, 21 bp, Mus musculus
tgtatgtatatatatatgtat

SEQ ID NO: 226586 - DNA, 22 bp, Mus musculus
tgttttgtgaccaattatatgg

SEQ ID NO: 226587 - DNA, 23 bp, Mus musculus
tttttgtgtcaggtttacaaggg

SEQ ID NO: 226588 - DNA, 23 bp, Mus musculus
acaggctggttttgtgtgtcaac

SEQ ID NO: 226589 - DNA, 22 bp, Mus musculus
tgttttgtgaccaattatatgg

SEQ ID NO: 226590 - DNA, 22 bp, Mus musculus
ttctagcattttctttcattat

SEQ ID NO: 226591 - DNA, 19 bp, Mus musculus
aattgtagatagttttact

SEQ ID NO: 226592 - DNA, 18 bp, Mus musculus
tgatctgataagatgcat

SEQ ID NO: 226593 - DNA, 23 bp, Mus musculus
ttatatgtatataaacatgtgtg

SEQ ID NO: 226594 - DNA, 23 bp, Mus musculus
ggtctcgctgtctatatctgtgt

SEQ ID NO: 226595 - DNA, 23 bp, Mus musculus
atagtatagtttgaggttgtgca

SEQ ID NO: 226596 - DNA, 21 bp, Mus musculus
tttggttccacaaagaagtga

SEQ ID NO: 226597 - DNA, 23 bp, Mus musculus
accatgtctagtgatattattgt

SEQ ID NO: 226598 - DNA, 22 bp, Mus musculus
tgttttgtgaccaattatatgg

SEQ ID NO: 226599 - DNA, 23 bp, Mus musculus
gaggacacaaatgacagtgaaca

SEQ ID NO: 226600 - DNA, 23 bp, Mus musculus
ttgtcactgagatgtgttgtctg

SEQ ID NO: 226601 - DNA, 22 bp, Mus musculus
tgttttgtgaccaattatatgg

SEQ ID NO: 226602 - DNA, 22 bp, Mus musculus
tgttttgtgaccaattatatgg

SEQ ID NO: 226603 - DNA, 20 bp, Mus musculus
aggtcttgtacatgctgtca

SEQ ID NO: 226604 - DNA, 23 bp, Mus musculus
agggcagagtctcactctgtctc

SEQ ID NO: 226605 - DNA, 23 bp, Mus musculus
tctgtctgtctgtctgtctgtct

SEQ ID NO: 226606 - DNA, 23 bp, Mus musculus
agtatatgtagttcacagaggta

SEQ ID NO: 226607 - DNA, 22 bp, Mus musculus
tagaacaggtaattgggcagca

SEQ ID NO: 226608 - DNA, 22 bp, Mus musculus
tgttttgtgaccaattatatgg

SEQ ID NO: 226609 - DNA, 21 bp, Mus musculus
aatctgtgtataaaaggtgag

SEQ ID NO: 226610 - DNA, 23 bp, Mus musculus
aaggatggtgtagtactgttcct

SEQ ID NO: 226611 - DNA, 22 bp, Mus musculus
tgttttgtgaccaattatatgg

SEQ ID NO: 226612 - DNA, 22 bp, Mus musculus
tgttttgtgaccaattatatgg

SEQ ID NO: 226613 - DNA, 22 bp, Mus musculus
tgtctctgtttagtttgtgttt

SEQ ID NO: 226614 - DNA, 22 bp, Mus musculus
tgttttgtgaccaattatatgg

SEQ ID NO: 226615 - DNA, 23 bp, Mus musculus
aaatttgtatttgtatatgtcat

SEQ ID NO: 226616 - DNA, 22 bp, Mus musculus
aaacagaagcatgttgatctgt

SEQ ID NO: 226617 - DNA, 23 bp, Mus musculus
gtatgtatgtatgtatgtgtgtg

SEQ ID NO: 226618 - DNA, 18 bp, Mus musculus
acacacatgtgagtgtgg

SEQ ID NO: 226619 - DNA, 23 bp, Mus musculus
tatgtttatgtatgtatgtgtat

SEQ ID NO: 226620 - DNA, 21 bp, Mus musculus
ttacacaagagagtatgctca

SEQ ID NO: 226621 - DNA, 18 bp, Mus musculus
atactcaatcttttgtga

SEQ ID NO: 226622 - DNA, 21 bp, Mus musculus
actgacactaactcactcacc

SEQ ID NO: 226623 - DNA, 23 bp, Mus musculus
tgactctgtctctgggtctgaag

SEQ ID NO: 226624 - DNA, 22 bp, Mus musculus
tgttttgtgaccaattatatgg

SEQ ID NO: 226625 - DNA, 23 bp, Mus musculus
ttcattacacacattttcaaatt

SEQ ID NO: 226626 - DNA, 18 bp, Mus musculus
agggggtgaaaaatgaag

SEQ ID NO: 226627 - DNA, 23 bp, Mus musculus
agaagtgtattgtctgcagctag

SEQ ID NO: 226628 - DNA, 19 bp, Mus musculus
aactgatgtgacaagactg

SEQ ID NO: 226629 - DNA, 23 bp, Mus musculus
aacttgtaaactagttaagctga

SEQ ID NO: 226630 - DNA, 20 bp, Mus musculus
catttgacaggtttgctgtt

SEQ ID NO: 226631 - DNA, 23 bp, Mus musculus
ttccatccgtctgtgtgtgtgac

SEQ ID NO: 226632 - DNA, 23 bp, Mus musculus
tgtggctgggtatcaaaagttct

SEQ ID NO: 226633 - DNA, 23 bp, Mus musculus
aacattgatagcttaggtaatgt

SEQ ID NO: 226634 - DNA, 22 bp, Mus musculus
tgtgtctctgtttagtttctgt

SEQ ID NO: 226635 - DNA, 21 bp, Mus musculus
atctgtccattgatgagagtg

SEQ ID NO: 226636 - DNA, 23 bp, Mus musculus
tctatatctctctctctctgtat

SEQ ID NO: 226637 - DNA, 23 bp, Mus musculus
cctagtaggtgctcagtaagtgt

SEQ ID NO: 226638 - DNA, 23 bp, Mus musculus
tttattgagcacctcctatcaat

SEQ ID NO: 226639 - DNA, 22 bp, Mus musculus
tgttttgtgaccaattatatgg

SEQ ID NO: 226640 - DNA, 22 bp, Mus musculus
tgagtctgttagtctgtgtcag

SEQ ID NO: 226641 - DNA, 23 bp, Mus musculus
tttaatgtctggtagaattctgt

SEQ ID NO: 226642 - DNA, 23 bp, Mus musculus
gtatagactctttgttgttctct

SEQ ID NO: 226643 - DNA, 20 bp, Mus musculus
tagaggacctcgtgtacata

SEQ ID NO: 226644 - DNA, 23 bp, Mus musculus
tctccttctgtcagcccatcatc

SEQ ID NO: 226645 - DNA, 22 bp, Mus musculus
tgttttgtgaccaattatatgg

SEQ ID NO: 226646 - DNA, 21 bp, Mus musculus
agtgcctcagttttgtttttt

SEQ ID NO: 226647 - DNA, 22 bp, Mus musculus
tgttttgtgaccaattatatgg

SEQ ID NO: 226648 - DNA, 20 bp, Mus musculus
ttgcatgtgcatgggtaaga

SEQ ID NO: 226649 - DNA, 23 bp, Mus musculus
agtgattagacattttgttgttg

SEQ ID NO: 226650 - DNA, 23 bp, Mus musculus
atctatacatgtttgtgtatgca

SEQ ID NO: 226651 - DNA, 20 bp, Mus musculus
tcagccgctcactggctctc

SEQ ID NO: 226652 - DNA, 18 bp, Mus musculus
tctctttaggttgggaaa

SEQ ID NO: 226653 - DNA, 23 bp, Mus musculus
actgtgacacactgcagattcca

SEQ ID NO: 226654 - DNA, 21 bp, Mus musculus
tggctcagtggttaagagcac

SEQ ID NO: 226655 - DNA, 22 bp, Mus musculus
ttttgagtgctaggattaaaag

SEQ ID NO: 226656 - DNA, 19 bp, Mus musculus
ttggttgtttcatattgtt

SEQ ID NO: 226657 - DNA, 23 bp, Mus musculus
tgagtgctttgtctgcatgtaca

SEQ ID NO: 226658 - DNA, 23 bp, Mus musculus
gtctcagaggctctgtggctctc

SEQ ID NO: 226659 - DNA, 22 bp, Mus musculus
ttagagacacatcatgttctgg

SEQ ID NO: 226660 - DNA, 18 bp, Mus musculus
tgtatatatatgtgtgtg

SEQ ID NO: 226661 - DNA, 19 bp, Mus musculus
gcaggattatgaaggattt

SEQ ID NO: 226662 - DNA, 20 bp, Mus musculus
tggcagtcaaattcactgtc

SEQ ID NO: 226663 - DNA, 22 bp, Mus musculus
tggctctcagtttattgttagg

SEQ ID NO: 226664 - DNA, 20 bp, Mus musculus
tgagagtagttagagaacag

SEQ ID NO: 226665 - DNA, 22 bp, Mus musculus
tgttttgtgaccaattatatgg

SEQ ID NO: 226666 - DNA, 22 bp, Mus musculus
agttacaggcagttagttgtga

SEQ ID NO: 226667 - DNA, 23 bp, Mus musculus
ttactactgtcaacagacgtgat

SEQ ID NO: 226668 - DNA, 19 bp, Mus musculus
aagtgcaattaaaagatgg

SEQ ID NO: 226669 - DNA, 21 bp, Mus musculus
ttaagagcactgactgctctt

SEQ ID NO: 226670 - DNA, 23 bp, Mus musculus
caatgaagagtgaatgctcacaa

SEQ ID NO: 226671 - DNA, 18 bp, Mus musculus
tcaacttttgaacctttg

SEQ ID NO: 226672 - DNA, 19 bp, Mus musculus
tgagttcaattcttagcaa

SEQ ID NO: 226673 - DNA, 23 bp, Mus musculus
tggttttgaagtgggactcctaa

SEQ ID NO: 226674 - DNA, 22 bp, Mus musculus
tgtgtgtatgtatgtatatatg

SEQ ID NO: 226675 - DNA, 23 bp, Mus musculus
gtatgtatgtatgtatgtgtgtg

SEQ ID NO: 226676 - DNA, 23 bp, Mus musculus
aggtggctctgtacagtgacgac

SEQ ID NO: 226677 - DNA, 23 bp, Mus musculus
tcaccagctccacgtgtctgtca

SEQ ID NO: 226678 - DNA, 23 bp, Mus musculus
aaaaggactgcaactcttcagaa

SEQ ID NO: 226679 - DNA, 23 bp, Mus musculus
tttctgacagtagttgcagtttt

SEQ ID NO: 226680 - DNA, 22 bp, Mus musculus
atgtgtatatatatgtgtgtgt

SEQ ID NO: 226681 - DNA, 23 bp, Mus musculus
tatatgtatatgtatatgtatac

SEQ ID NO: 226682 - DNA, 18 bp, Mus musculus
atggattatgtagaatga

SEQ ID NO: 226683 - DNA, 21 bp, Mus musculus
acattatataagtagtactac

SEQ ID NO: 226684 - DNA, 23 bp, Mus musculus
acaatcattttgaagctgttaaa

SEQ ID NO: 226685 - DNA, 22 bp, Mus musculus
taggtgtttatcatgtagagaa

SEQ ID NO: 226686 - DNA, 22 bp, Mus musculus
tgttttgtgaccaattatatgg

SEQ ID NO: 226687 - DNA, 23 bp, Mus musculus
tgtgtgtataaatacatatgtgt

SEQ ID NO: 226688 - DNA, 19 bp, Mus musculus
tttgcatatatatacatat

SEQ ID NO: 226689 - DNA, 20 bp, Mus musculus
atatgtatatatactgatgt

SEQ ID NO: 226690 - DNA, 23 bp, Mus musculus
actgtgtctctgtttagtttctg

SEQ ID NO: 226691 - DNA, 20 bp, Mus musculus
tatgtatatatatgtgtgtg

SEQ ID NO: 226692 - DNA, 23 bp, Mus musculus
tggctctcactgatacatctgcg

SEQ ID NO: 226693 - DNA, 20 bp, Mus musculus
tggacagcctgtatccagtt

SEQ ID NO: 226694 - DNA, 19 bp, Mus musculus
agactgctgtatcagtctc

SEQ ID NO: 226695 - DNA, 23 bp, Mus musculus
gtgtctatgtgtttatgtgcatg

SEQ ID NO: 226696 - DNA, 19 bp, Mus musculus
acagagggaggaagagaga

SEQ ID NO: 226697 - DNA, 23 bp, Mus musculus
tcaatgccattggaagacttgac

SEQ ID NO: 226698 - DNA, 23 bp, Mus musculus
tgtcttattccgctttctgttgc

SEQ ID NO: 226699 - DNA, 22 bp, Mus musculus
atagatcacccaagactgaatc

SEQ ID NO: 226700 - DNA, 20 bp, Mus musculus
tgagtgcctacagtagccat

SEQ ID NO: 226701 - DNA, 23 bp, Mus musculus
agtgagaacattgtctgcagtct

SEQ ID NO: 226702 - DNA, 23 bp, Mus musculus
tggctgtgtacatttgtgactct

SEQ ID NO: 226703 - DNA, 23 bp, Mus musculus
gagtgcctgtcactgtgtaaagt

SEQ ID NO: 226704 - DNA, 23 bp, Mus musculus
tatttttgtatttcatcaggcct

SEQ ID NO: 226705 - DNA, 21 bp, Mus musculus
tatctagaacaggatgtctac

SEQ ID NO: 226706 - DNA, 23 bp, Mus musculus
cacagtttacagagaggagatga

SEQ ID NO: 226707 - DNA, 19 bp, Mus musculus
tgctcccagaggtctctgc

SEQ ID NO: 226708 - DNA, 19 bp, Mus musculus
ttagttcattgaatccggg

SEQ ID NO: 226709 - DNA, 23 bp, Mus musculus
agagaagagagtcattgagcttg

SEQ ID NO: 226710 - DNA, 23 bp, Mus musculus
tttcacagcaatattctgtctca

SEQ ID NO: 226711 - DNA, 23 bp, Mus musculus
tgtgtctgtctcacatttgagtt

SEQ ID NO: 226712 - DNA, 23 bp, Mus musculus
atgtgtatatatgtgtgtgtgtg

SEQ ID NO: 226713 - DNA, 22 bp, Mus musculus
tgttttgtgaccaattatatgg

SEQ ID NO: 226714 - DNA, 23 bp, Mus musculus
tgtctgtctgtctgtctgttttg

SEQ ID NO: 226715 - DNA, 23 bp, Mus musculus
agctcagagtccacacacagtga

SEQ ID NO: 226716 - DNA, 23 bp, Mus musculus
tctctgtctctctgggcctcagt

SEQ ID NO: 226717 - DNA, 23 bp, Mus musculus
atagtgtgtgtatttcattgtct

SEQ ID NO: 226718 - DNA, 22 bp, Mus musculus
tgttttgtgaccaattatatgg

SEQ ID NO: 226719 - DNA, 22 bp, Mus musculus
tgttttgtgaccaattatatgg

SEQ ID NO: 226720 - DNA, 22 bp, Mus musculus
tgttttgtgaccaattatatgg

SEQ ID NO: 226721 - DNA, 23 bp, Mus musculus
atttctgaatatgttaatgtgta

SEQ ID NO: 226722 - DNA, 23 bp, Mus musculus
tttgtagtgggatctgatgatgt

SEQ ID NO: 226723 - DNA, 22 bp, Mus musculus
tctaaggataagatatgcctgc

SEQ ID NO: 226724 - DNA, 20 bp, Mus musculus
caggggatattttttctctt

SEQ ID NO: 226725 - DNA, 23 bp, Mus musculus
cagactgagcagactgtggagag

SEQ ID NO: 226726 - DNA, 20 bp, Mus musculus
tctgcatcagttcctgcttc

SEQ ID NO: 226727 - DNA, 18 bp, Mus musculus
attctcatgagataggat

SEQ ID NO: 226728 - DNA, 18 bp, Mus musculus
agattttcccgttaggat

SEQ ID NO: 226729 - DNA, 22 bp, Mus musculus
tgttttgtgaccaattatatgg

SEQ ID NO: 226730 - DNA, 23 bp, Mus musculus
ggaggtgagtgtggtttcatgtg

SEQ ID NO: 226731 - DNA, 19 bp, Mus musculus
ttaaagttggatgtatttt

SEQ ID NO: 226732 - DNA, 22 bp, Mus musculus
tgttttgtgaccaattatatgg

SEQ ID NO: 226733 - DNA, 23 bp, Mus musculus
gtttatgcatatatatatgtaca

SEQ ID NO: 226734 - DNA, 20 bp, Mus musculus
tgtatatatatgtacatgta

SEQ ID NO: 226735 - DNA, 22 bp, Mus musculus
ttccctgttggtgggactgttt

SEQ ID NO: 226736 - DNA, 23 bp, Mus musculus
atatctatatctatatatgtgtg

SEQ ID NO: 226737 - DNA, 21 bp, Mus musculus
aaaatggtaatacttataggt

SEQ ID NO: 226738 - DNA, 23 bp, Mus musculus
gtctgtatagtgctacttgtatg

SEQ ID NO: 226739 - DNA, 23 bp, Mus musculus
gtatgtatgtatatgtatatgta

SEQ ID NO: 226740 - DNA, 23 bp, Mus musculus
agagacagagactgagagacaga

SEQ ID NO: 226741 - DNA, 22 bp, Mus musculus
tgttttgtgaccaattatatgg

SEQ ID NO: 226742 - DNA, 22 bp, Mus musculus
tgttttgtgaccaattatatgg

SEQ ID NO: 226743 - DNA, 23 bp, Mus musculus
actgcttttgttcttctgattgc

SEQ ID NO: 226744 - DNA, 23 bp, Mus musculus
tgtgtgtgcgtatatatacatat

SEQ ID NO: 226745 - DNA, 23 bp, Mus musculus
agtgtgtgtgtgtgcctgactgt

SEQ ID NO: 226746 - DNA, 20 bp, Mus musculus
ttgtctttggatctctctct

SEQ ID NO: 226747 - DNA, 21 bp, Mus musculus
cagaggtcataagttcaattc

SEQ ID NO: 226748 - DNA, 22 bp, Mus musculus
tgttttgtgaccaattatatgg

SEQ ID NO: 226749 - DNA, 22 bp, Mus musculus
tgttttgtgaccaattatatgg

SEQ ID NO: 226750 - DNA, 21 bp, Mus musculus
atgtatgtgtgtatgtatatg

SEQ ID NO: 226751 - DNA, 23 bp, Mus musculus
taaaggtatatatgtatttgttt

SEQ ID NO: 226752 - DNA, 20 bp, Mus musculus
agagtagagagtcacagcac

SEQ ID NO: 226753 - DNA, 23 bp, Mus musculus
cagactgcctgcctctctgacac

SEQ ID NO: 226754 - DNA, 23 bp, Mus musculus
ttacagaatatatattctctgtc

SEQ ID NO: 226755 - DNA, 23 bp, Mus musculus
aagacagtgagtggtgagagtga

SEQ ID NO: 226756 - DNA, 23 bp, Mus musculus
tgtgaagacaatttctatttctg

SEQ ID NO: 226757 - DNA, 23 bp, Mus musculus
tctctgtgtttgtgtctgggtgc

SEQ ID NO: 226758 - DNA, 21 bp, Mus musculus
aggaatgtagtcagcctctcc

SEQ ID NO: 226759 - DNA, 18 bp, Mus musculus
gagggtgcctgtgtactc

SEQ ID NO: 226760 - DNA, 23 bp, Mus musculus
atatgtatgtatgtatgtgtgtg

SEQ ID NO: 226761 - DNA, 23 bp, Mus musculus
tatgtatgtatgtatgtgtgagc

SEQ ID NO: 226762 - DNA, 23 bp, Mus musculus
gatgtgtacatgtgtatgtatgt

SEQ ID NO: 226763 - DNA, 23 bp, Mus musculus
ccataggtacaagtctgagctga

SEQ ID NO: 226764 - DNA, 22 bp, Mus musculus
acagtgaggacagtgagtcttg

SEQ ID NO: 226765 - DNA, 23 bp, Mus musculus
tgtgtgcctgtgtgcgtgtgtgt

SEQ ID NO: 226766 - DNA, 19 bp, Mus musculus
atgtatgtgtggaggtata

SEQ ID NO: 226767 - DNA, 21 bp, Mus musculus
tgcaataattttcttcctgga

SEQ ID NO: 226768 - DNA, 23 bp, Mus musculus
actcactgtctgtgcagcttagt

SEQ ID NO: 226769 - DNA, 23 bp, Mus musculus
tgtgagtatggttgttgttattg

SEQ ID NO: 226770 - DNA, 21 bp, Mus musculus
tcaagtgaccataggtgtgtg

SEQ ID NO: 226771 - DNA, 23 bp, Mus musculus
cattggtctacttgtctgtcact

SEQ ID NO: 226772 - DNA, 21 bp, Mus musculus
tccatggtggtctgataggat

SEQ ID NO: 226773 - DNA, 22 bp, Mus musculus
tgagtaaattagtttctttaca

SEQ ID NO: 226774 - DNA, 19 bp, Mus musculus
agagaaatctgagacataa

SEQ ID NO: 226775 - DNA, 22 bp, Mus musculus
tgttttgtgaccaattatatgg

SEQ ID NO: 226776 - DNA, 19 bp, Mus musculus
tatatgtacatatacatac

SEQ ID NO: 226777 - DNA, 20 bp, Mus musculus
actatgtggagttgcctgtg

SEQ ID NO: 226778 - DNA, 23 bp, Mus musculus
tgagtagagtgtcattcagcttc

SEQ ID NO: 226779 - DNA, 23 bp, Mus musculus
tttttattgaagatcagccttag

SEQ ID NO: 226780 - DNA, 22 bp, Mus musculus
tgttttgtgaccaattatatgg

SEQ ID NO: 226781 - DNA, 23 bp, Mus musculus
ctgtgtcactgtcagctaaggtg

SEQ ID NO: 226782 - DNA, 18 bp, Mus musculus
atatgtgtatatatatat

SEQ ID NO: 226783 - DNA, 18 bp, Mus musculus
taaatcacactttttgaa

SEQ ID NO: 226784 - DNA, 22 bp, Mus musculus
tgttttgtgaccaattatatgg

SEQ ID NO: 226785 - DNA, 18 bp, Mus musculus
tcttttgttattatgatc

SEQ ID NO: 226786 - DNA, 23 bp, Mus musculus
aaagtaactggtaatcatcagaa

SEQ ID NO: 226787 - DNA, 22 bp, Mus musculus
gtcagtctcaggaagtcacctg

SEQ ID NO: 226788 - DNA, 18 bp, Mus musculus
tctctctgtctctgtgag

SEQ ID NO: 226789 - DNA, 23 bp, Mus musculus
agtctctctgtgagggaagcagc

SEQ ID NO: 226790 - DNA, 18 bp, Mus musculus
ttttgtatctgttgagtc

SEQ ID NO: 226791 - DNA, 23 bp, Mus musculus
tgtatgtatgtatatgtatatgt

SEQ ID NO: 226792 - DNA, 22 bp, Mus musculus
atgatttaggttgttttgtaat

SEQ ID NO: 226793 - DNA, 19 bp, Mus musculus
aattgccactggaagtcct

SEQ ID NO: 226794 - DNA, 18 bp, Mus musculus
tttatatcttctgcacct

SEQ ID NO: 226795 - DNA, 23 bp, Mus musculus
tatcacatagactaagtttgtat

SEQ ID NO: 226796 - DNA, 22 bp, Mus musculus
tgttttgtgaccaattatatgg

SEQ ID NO: 226797 - DNA, 23 bp, Mus musculus
atgtctgaatgtctatatgtctg

SEQ ID NO: 226798 - DNA, 22 bp, Mus musculus
tatgcagctgattgagagcctg

SEQ ID NO: 226799 - DNA, 23 bp, Mus musculus
agtagggattgcttctcttgtca

SEQ ID NO: 226800 - DNA, 18 bp, Mus musculus
atcttattgtggtagttg

SEQ ID NO: 226801 - DNA, 19 bp, Mus musculus
atcagatttaaagatgtta

SEQ ID NO: 226802 - DNA, 22 bp, Mus musculus
tgttttgtgaccaattatatgg

SEQ ID NO: 226803 - DNA, 22 bp, Mus musculus
tgttttgtgaccaattatatgg

SEQ ID NO: 226804 - DNA, 22 bp, Mus musculus
tgttttgtgaccaattatatgg

SEQ ID NO: 226805 - DNA, 23 bp, Mus musculus
actggaaatatatccacaaagca

SEQ ID NO: 226806 - DNA, 23 bp, Mus musculus
tagtccatggtgatctgatagga

SEQ ID NO: 226807 - DNA, 23 bp, Mus musculus
aagtgtgtatatgtatatgtatg

SEQ ID NO: 226808 - DNA, 21 bp, Mus musculus
ttttaagaaaagtagtatttg

SEQ ID NO: 226809 - DNA, 21 bp, Mus musculus
ttcatggtgatctgataggat

SEQ ID NO: 226810 - DNA, 23 bp, Mus musculus
ttgtgaccaattatattgtcaat

SEQ ID NO: 226811 - DNA, 23 bp, Mus musculus
taatgagagacacaaaggggatg

SEQ ID NO: 226812 - DNA, 21 bp, Mus musculus
atggtatatggtgaggaactg

SEQ ID NO: 226813 - DNA, 22 bp, Mus musculus
tgttttgtgaccaattatatgg

SEQ ID NO: 226814 - DNA, 22 bp, Mus musculus
tgttttgtgaccaattatatgg

SEQ ID NO: 226815 - DNA, 23 bp, Mus musculus
gtctctgtctctgttcaggcacc

SEQ ID NO: 226816 - DNA, 22 bp, Mus musculus
tccatggtggtctgataggatg

SEQ ID NO: 226817 - DNA, 22 bp, Mus musculus
gtatgtgcagtgtgtggtgtgt

SEQ ID NO: 226818 - DNA, 22 bp, Mus musculus
tatgtctgtcataattgtgggt

SEQ ID NO: 226819 - DNA, 23 bp, Mus musculus
agtctctgtatctcctatgacta

SEQ ID NO: 226820 - DNA, 18 bp, Mus musculus
taatacatcagataagga

SEQ ID NO: 226821 - DNA, 23 bp, Mus musculus
gggttagagatcattatgtcctc

SEQ ID NO: 226822 - DNA, 23 bp, Mus musculus
acatgcacaggatgttttctgca

SEQ ID NO: 226823 - DNA, 23 bp, Mus musculus
tgtgtgtgtgtttatgtacatat

SEQ ID NO: 226824 - DNA, 20 bp, Mus musculus
tatgtatatatgtatgtgca

SEQ ID NO: 226825 - DNA, 23 bp, Mus musculus
tgtctgtctctctgtctgtctta

SEQ ID NO: 226826 - DNA, 23 bp, Mus musculus
tatctgtggattgatgtttggct

SEQ ID NO: 226827 - DNA, 23 bp, Mus musculus
atgtatgtatagatgtatgaaca

SEQ ID NO: 226828 - DNA, 22 bp, Mus musculus
tgttttgtgaccaattatatgg

SEQ ID NO: 226829 - DNA, 23 bp, Mus musculus
atttaagagtttttgatgtgatt

SEQ ID NO: 226830 - DNA, 22 bp, Mus musculus
tgttttgtgaccaattatatgg

SEQ ID NO: 226831 - DNA, 18 bp, Mus musculus
ctgagccagtgggagtgc

SEQ ID NO: 226832 - DNA, 23 bp, Mus musculus
tgtgtgcatgtgcatgtgcatgt

SEQ ID NO: 226833 - DNA, 23 bp, Mus musculus
tcaaggtcactctatgtgtaatg

SEQ ID NO: 226834 - DNA, 23 bp, Mus musculus
gagtcacaggctcttgtttttct

SEQ ID NO: 226835 - DNA, 19 bp, Mus musculus
gttatggtgtctgtccaca

SEQ ID NO: 226836 - DNA, 21 bp, Mus musculus
tccatggtgatctgataggat

SEQ ID NO: 226837 - DNA, 23 bp, Mus musculus
attccatgatgatctgataggat

SEQ ID NO: 226838 - DNA, 23 bp, Mus musculus
tagacagtgctgttcctgtctgt

SEQ ID NO: 226839 - DNA, 20 bp, Mus musculus
tatgtgtatgtatgtatgtg

SEQ ID NO: 226840 - DNA, 21 bp, Mus musculus
aggaagtgtgtcactatagag

SEQ ID NO: 226841 - DNA, 22 bp, Mus musculus
aaacctagtaggtagcatagtt

SEQ ID NO: 226842 - DNA, 23 bp, Mus musculus
tgagaccatcttcaaaatggaat

SEQ ID NO: 226843 - DNA, 22 bp, Mus musculus
tgcctctctgccagtctctgtg

SEQ ID NO: 226844 - DNA, 23 bp, Mus musculus
tttcagtagactgacagcagagc

SEQ ID NO: 226845 - DNA, 23 bp, Mus musculus
gcatgagcagtcagactactgtg

SEQ ID NO: 226846 - DNA, 23 bp, Mus musculus
tcatatctgtctacaatgctgag

SEQ ID NO: 226847 - DNA, 21 bp, Mus musculus
tgtctagttccttgactagta

SEQ ID NO: 226848 - DNA, 21 bp, Mus musculus
catgtgtagacaccatggtgt

SEQ ID NO: 226849 - DNA, 20 bp, Mus musculus
tatgtacatatgtatatatg

SEQ ID NO: 226850 - DNA, 20 bp, Mus musculus
tcacacaatgactctgagag

SEQ ID NO: 226851 - DNA, 22 bp, Mus musculus
ctgtgtaattgaaaaggccctg

SEQ ID NO: 226852 - DNA, 23 bp, Mus musculus
tagtccatggtgatctgatagga

SEQ ID NO: 226853 - DNA, 21 bp, Mus musculus
tgttttgttaccaattatatg

SEQ ID NO: 226854 - DNA, 23 bp, Mus musculus
attttgtttctagacttgtgtag

SEQ ID NO: 226855 - DNA, 22 bp, Mus musculus
tgttttgtgaccaattatatgg

SEQ ID NO: 226856 - DNA, 21 bp, Mus musculus
aatgaatggaaaataaagtgt

SEQ ID NO: 226857 - DNA, 23 bp, Mus musculus
tgagaggctctgtcagtgtctga

SEQ ID NO: 226858 - DNA, 23 bp, Mus musculus
aaatgtgtttgctattataatga

SEQ ID NO: 226859 - DNA, 21 bp, Mus musculus
tcttgatcacagtgatagtag

SEQ ID NO: 226860 - DNA, 21 bp, Mus musculus
atgtatgtatatatatgtaca

SEQ ID NO: 226861 - DNA, 23 bp, Mus musculus
atatatgtacatatgtatgtatg

SEQ ID NO: 226862 - DNA, 21 bp, Mus musculus
acatatgtatgtgtgtatatg

SEQ ID NO: 226863 - DNA, 23 bp, Mus musculus
atcacaaactgcaaatgtcaatt

SEQ ID NO: 226864 - DNA, 23 bp, Mus musculus
aatgtgtataaccatctgggtgt

SEQ ID NO: 226865 - DNA, 19 bp, Mus musculus
ttttaagtagccaaaggat

SEQ ID NO: 226866 - DNA, 18 bp, Mus musculus
catttgtatgcatatatc

SEQ ID NO: 226867 - DNA, 23 bp, Mus musculus
tatatgtatatgtatacatgtgt

SEQ ID NO: 226868 - DNA, 21 bp, Mus musculus
atgtgtgtatatgtgtctgct

SEQ ID NO: 226869 - DNA, 23 bp, Mus musculus
tgtctgtgtgtctgtccatctgt

SEQ ID NO: 226870 - DNA, 23 bp, Mus musculus
ctgtccatcggtctgtctatgtc

SEQ ID NO: 226871 - DNA, 21 bp, Mus musculus
aaaggatggatggatggctga

SEQ ID NO: 226872 - DNA, 22 bp, Mus musculus
ttacagaggatggtagagttct

SEQ ID NO: 226873 - DNA, 23 bp, Mus musculus
accacaatctgttcagtggacaa

SEQ ID NO: 226874 - DNA, 22 bp, Mus musculus
tctgtcacactgagtaaagact

SEQ ID NO: 226875 - DNA, 19 bp, Mus musculus
gcatgctgaaggtctgcta

SEQ ID NO: 226876 - DNA, 19 bp, Mus musculus
attacaggctaatgactca

SEQ ID NO: 226877 - DNA, 22 bp, Mus musculus
tgttttgtgaccaattatatgg

SEQ ID NO: 226878 - DNA, 22 bp, Mus musculus
tgttttgtgaccaattatatgg

SEQ ID NO: 226879 - DNA, 22 bp, Mus musculus
agcagcaatgaacatggctgag

SEQ ID NO: 226880 - DNA, 23 bp, Mus musculus
gtgaaaaacaaccagttggtgct

SEQ ID NO: 226881 - DNA, 23 bp, Mus musculus
tgtgtgtctgtatctctctctgt

SEQ ID NO: 226882 - DNA, 22 bp, Mus musculus
tgttttgtgaccaattatatgg

SEQ ID NO: 226883 - DNA, 22 bp, Mus musculus
tgttttgtgaccaattatatgg

SEQ ID NO: 226884 - DNA, 23 bp, Mus musculus
tagtccatggtgatttgatagga

SEQ ID NO: 226885 - DNA, 23 bp, Mus musculus
ttgtgaccaattatattgtcaat

SEQ ID NO: 226886 - DNA, 19 bp, Mus musculus
atgttcaggcaaaacatga

SEQ ID NO: 226887 - DNA, 21 bp, Mus musculus
taatgagcatgtttatctata

SEQ ID NO: 226888 - DNA, 22 bp, Mus musculus
tgttttgtgaccaattatatgg

SEQ ID NO: 226889 - DNA, 23 bp, Mus musculus
tagcccactggtattctgttcaa

SEQ ID NO: 226890 - DNA, 22 bp, Mus musculus
tgttttgtgaccaattatatgg

SEQ ID NO: 226891 - DNA, 22 bp, Mus musculus
cagtcttaggccatggtggtct

SEQ ID NO: 226892 - DNA, 23 bp, Mus musculus
atatttcagggttttatttgact

SEQ ID NO: 226893 - DNA, 18 bp, Mus musculus
gtagagccagagagaata

SEQ ID NO: 226894 - DNA, 23 bp, Mus musculus
tgatttctctctgactctgggag

SEQ ID NO: 226895 - DNA, 22 bp, Mus musculus
tgttttgtgaccaattatatgg

SEQ ID NO: 226896 - DNA, 21 bp, Mus musculus
actctatctcccaagacaatt

SEQ ID NO: 226897 - DNA, 22 bp, Mus musculus
tgttttgtgaccaattatatgg

SEQ ID NO: 226898 - DNA, 23 bp, Mus musculus
agtaactccaattgcagctgcta

SEQ ID NO: 226899 - DNA, 22 bp, Mus musculus
tgttttgtgaccaattatatgg

SEQ ID NO: 226900 - DNA, 21 bp, Mus musculus
tccatggtggtctcataggat

SEQ ID NO: 226901 - DNA, 22 bp, Mus musculus
tgttttgtgaccaattatatgg

SEQ ID NO: 226902 - DNA, 23 bp, Mus musculus
tacttttgtgtttgtacatgtat

SEQ ID NO: 226903 - DNA, 18 bp, Mus musculus
atttaagttcatgtgcag

SEQ ID NO: 226904 - DNA, 21 bp, Mus musculus
tatatgtacatatttgtatgt

SEQ ID NO: 226905 - DNA, 22 bp, Mus musculus
atatatgtacttatatttagtg

SEQ ID NO: 226906 - DNA, 22 bp, Mus musculus
tagtccatggtgatatggtagg

SEQ ID NO: 226907 - DNA, 23 bp, Mus musculus
tttgtccgtggtgatctgatagg

SEQ ID NO: 226908 - DNA, 23 bp, Mus musculus
tatgtgtttggaggaatttcttt

SEQ ID NO: 226909 - DNA, 22 bp, Mus musculus
ttagtccatgtgatctgataga

SEQ ID NO: 226910 - DNA, 22 bp, Mus musculus
tgttttgtgaccaattatatgg

SEQ ID NO: 226911 - DNA, 19 bp, Mus musculus
taacgtaatagttgttgtt

SEQ ID NO: 226912 - DNA, 22 bp, Mus musculus
tatatctatatctatatctgta

SEQ ID NO: 226913 - DNA, 21 bp, Mus musculus
tatgaggatatatatagcaga

SEQ ID NO: 226914 - DNA, 20 bp, Mus musculus
atggtcatcagataggatgt

SEQ ID NO: 226915 - DNA, 23 bp, Mus musculus
atgtgttgacacctgttttgtga

SEQ ID NO: 226916 - DNA, 20 bp, Mus musculus
gtccgtggtgacctgatagg

SEQ ID NO: 226917 - DNA, 20 bp, Mus musculus
ttttgtgaccgattatatgg

SEQ ID NO: 226918 - DNA, 21 bp, Mus musculus
agcttagtacattcaaaagag

SEQ ID NO: 226919 - DNA, 21 bp, Mus musculus
tatcagtgaacacacacagca

SEQ ID NO: 226920 - DNA, 22 bp, Mus musculus
tgttttgtgaccaattatatgg

SEQ ID NO: 226921 - DNA, 21 bp, Mus musculus
attgcttcttcataactgtaa

SEQ ID NO: 226922 - DNA, 23 bp, Mus musculus
aattggaatgtaaacaagtgatt

SEQ ID NO: 226923 - DNA, 23 bp, Mus musculus
ctgtcactgaactctgtgaggag

SEQ ID NO: 226924 - DNA, 23 bp, Mus musculus
gtctcagtcactgtctgtggagt

SEQ ID NO: 226925 - DNA, 22 bp, Mus musculus
tgttttgtgaccaattatatgg

SEQ ID NO: 226926 - DNA, 23 bp, Mus musculus
tagtgcatggtgatctgatagga

SEQ ID NO: 226927 - DNA, 22 bp, Mus musculus
tgttttgtgacctattatgtgg

SEQ ID NO: 226928 - DNA, 20 bp, Mus musculus
tctgtggattgtagtgtggg

SEQ ID NO: 226929 - DNA, 23 bp, Mus musculus
ttgaacttgtcagtgtctctcta

SEQ ID NO: 226930 - DNA, 23 bp, Mus musculus
agctcaccgtggatatgttgttg

SEQ ID NO: 226931 - DNA, 20 bp, Mus musculus
caagatgtggggctggaaag

SEQ ID NO: 226932 - DNA, 23 bp, Mus musculus
tgtacatgtaaggatatgcatag

SEQ ID NO: 226933 - DNA, 23 bp, Mus musculus
tgcatgtatatatgtatgtatgt

SEQ ID NO: 226934 - DNA, 21 bp, Mus musculus
atttatgtatatgtatatatg

SEQ ID NO: 226935 - DNA, 23 bp, Mus musculus
tatatctatatgtatgtgtatat

SEQ ID NO: 226936 - DNA, 22 bp, Mus musculus
tatatatgtatatgtattcata

SEQ ID NO: 226937 - DNA, 23 bp, Mus musculus
ccgttgtacctgtagaagtgcag

SEQ ID NO: 226938 - DNA, 23 bp, Mus musculus
tgtatgtgagtacactgtggctg

SEQ ID NO: 226939 - DNA, 21 bp, Mus musculus
tccatggtggtctgataggat

SEQ ID NO: 226940 - DNA, 22 bp, Mus musculus
tgttttgtgaccaattatatgg

SEQ ID NO: 226941 - DNA, 19 bp, Mus musculus
gtccattaatattgagaga

SEQ ID NO: 226942 - DNA, 22 bp, Mus musculus
tgtgccggtggttctctcctct

SEQ ID NO: 226943 - DNA, 19 bp, Mus musculus
acacacatgtatatgtgta

SEQ ID NO: 226944 - DNA, 22 bp, Mus musculus
tttgccccagttagaagtgtga

SEQ ID NO: 226945 - DNA, 23 bp, Mus musculus
caaagtctgaagtaagtgaggag

SEQ ID NO: 226946 - DNA, 23 bp, Mus musculus
tctcacagagtcaaactttccac

SEQ ID NO: 226947 - DNA, 22 bp, Mus musculus
tgtgtgtgcatgtgcatgagca

SEQ ID NO: 226948 - DNA, 22 bp, Mus musculus
aatggcatagtatagtcagagc

SEQ ID NO: 226949 - DNA, 23 bp, Mus musculus
ctttttgtgtgtggtacttatgt

SEQ ID NO: 226950 - DNA, 20 bp, Mus musculus
tgtgtgtgtgtgtgtgattg

SEQ ID NO: 226951 - DNA, 18 bp, Mus musculus
gaatgtgtgcaagttctt

SEQ ID NO: 226952 - DNA, 23 bp, Mus musculus
ccttttgtgtgtggtacttatgt

SEQ ID NO: 226953 - DNA, 23 bp, Mus musculus
tgtgtgtgtgtgtgtgattgcac

SEQ ID NO: 226954 - DNA, 18 bp, Mus musculus
tgtctgagagagtctcag

SEQ ID NO: 226955 - DNA, 22 bp, Mus musculus
tgagatctgctaaagcattgtg

SEQ ID NO: 226956 - DNA, 19 bp, Mus musculus
gtatgtatgtatgtatgaa

SEQ ID NO: 226957 - DNA, 22 bp, Mus musculus
tcagggtctgtctctctctata

SEQ ID NO: 226958 - DNA, 18 bp, Mus musculus
aagaaagcaagctatgga

SEQ ID NO: 226959 - DNA, 21 bp, Mus musculus
ttaggttcctgtcagcaatca

SEQ ID NO: 226960 - DNA, 23 bp, Mus musculus
aagtcactagtggttccgtttag

SEQ ID NO: 226961 - DNA, 23 bp, Mus musculus
tgcctgcctgcctgcttgtctgc

SEQ ID NO: 226962 - DNA, 23 bp, Mus musculus
agagatgtgactgtggaatggca

SEQ ID NO: 226963 - DNA, 23 bp, Mus musculus
tcacttgatgtcctgttttcctg

SEQ ID NO: 226964 - DNA, 23 bp, Mus musculus
aggatgcttttgatatctagttc

SEQ ID NO: 226965 - DNA, 20 bp, Mus musculus
tccatggtggtgtgatagga

SEQ ID NO: 226966 - DNA, 23 bp, Mus musculus
ttttgtgaccgattatatggtca

SEQ ID NO: 226967 - DNA, 23 bp, Mus musculus
tgtcacagtccttttcatgataa

SEQ ID NO: 226968 - DNA, 18 bp, Mus musculus
tagagggtactctccagc

SEQ ID NO: 226969 - DNA, 22 bp, Mus musculus
acgaggcttgactttgcttttc

SEQ ID NO: 226970 - DNA, 18 bp, Mus musculus
tagaagacctggtgcaga

SEQ ID NO: 226971 - DNA, 23 bp, Mus musculus
actgcctctgtctctgtgagttc

SEQ ID NO: 226972 - DNA, 21 bp, Mus musculus
tacacactgggtgaagcagaa

SEQ ID NO: 226973 - DNA, 23 bp, Mus musculus
gtctgtgactccagttgcaggag

SEQ ID NO: 226974 - DNA, 21 bp, Mus musculus
tatttcatcattgaccaagga

SEQ ID NO: 226975 - DNA, 23 bp, Mus musculus
ggacataatgtgcaggcacagtg

SEQ ID NO: 226976 - DNA, 23 bp, Mus musculus
taaggacaatcaggagcacacag

SEQ ID NO: 226977 - DNA, 23 bp, Mus musculus
tcactgtctgactcttacttctc

SEQ ID NO: 226978 - DNA, 23 bp, Mus musculus
tgtctgactgtctgtctgtctat

SEQ ID NO: 226979 - DNA, 22 bp, Mus musculus
tgttttgtgaccaattatatgg

SEQ ID NO: 226980 - DNA, 23 bp, Mus musculus
attgttacatatgtattcatgta

SEQ ID NO: 226981 - DNA, 23 bp, Mus musculus
tggattacttcaggatctgttgt

SEQ ID NO: 226982 - DNA, 21 bp, Mus musculus
cagagtctcatcttccagaat

SEQ ID NO: 226983 - DNA, 23 bp, Mus musculus
tgagagatgtgtgtctccactag

SEQ ID NO: 226984 - DNA, 23 bp, Mus musculus
cagtctctgactctgtgtattgt

SEQ ID NO: 226985 - DNA, 20 bp, Mus musculus
acacacactgactgttcttg

SEQ ID NO: 226986 - DNA, 22 bp, Mus musculus
tgttttgtgaccaattatatgg

SEQ ID NO: 226987 - DNA, 23 bp, Mus musculus
agaagtctgcctgtctctgcctc

SEQ ID NO: 226988 - DNA, 23 bp, Mus musculus
gtctccatcttccactgcatggt

SEQ ID NO: 226989 - DNA, 23 bp, Mus musculus
gatcacactgagtctatagacag

SEQ ID NO: 226990 - DNA, 22 bp, Mus musculus
tcagtgctgaaatcttgatttt

SEQ ID NO: 226991 - DNA, 20 bp, Mus musculus
tttcaactacatttccactg

SEQ ID NO: 226992 - DNA, 22 bp, Mus musculus
ggagttgtgaaagctagtaaat

SEQ ID NO: 226993 - DNA, 19 bp, Mus musculus
tctgtctgtctgtccgtgg

SEQ ID NO: 226994 - DNA, 21 bp, Mus musculus
attggacaagacacagctgaa

SEQ ID NO: 226995 - DNA, 23 bp, Mus musculus
gctttgggactgtgtctgtctgc

SEQ ID NO: 226996 - DNA, 21 bp, Mus musculus
tgtggatatagtttgagaatg

SEQ ID NO: 226997 - DNA, 23 bp, Mus musculus
tctcaagcagccttagatttgaa

SEQ ID NO: 226998 - DNA, 22 bp, Mus musculus
gtcacaaagcacaatctctgca

SEQ ID NO: 226999 - DNA, 21 bp, Mus musculus
aacacagatgtgtgggagcac

SEQ ID NO: 227000 - DNA, 21 bp, Mus musculus
gaatcacttcctttactgtgt

SEQ ID NO: 227001 - DNA, 23 bp, Mus musculus
gtgtgtgtgtgtatatgtatata

SEQ ID NO: 227002 - DNA, 20 bp, Mus musculus
atatgtatgtatatatatgt

SEQ ID NO: 227003 - DNA, 19 bp, Mus musculus
gaatgaaaacatgtttctc

SEQ ID NO: 227004 - DNA, 22 bp, Mus musculus
tgttttgtgaccaattatatgg

SEQ ID NO: 227005 - DNA, 20 bp, Mus musculus
ttttgtgaccaaatatatgg

SEQ ID NO: 227006 - DNA, 22 bp, Mus musculus
tatgtatgtatgtatgtatatg

SEQ ID NO: 227007 - DNA, 23 bp, Mus musculus
ttatgtgtcagaaggaatttctt

SEQ ID NO: 227008 - DNA, 22 bp, Mus musculus
ttactcagtaaggcattgttct

SEQ ID NO: 227009 - DNA, 21 bp, Mus musculus
tttctgtgtagggtaatgtgc

SEQ ID NO: 227010 - DNA, 23 bp, Mus musculus
tatgtatacatatgtaggacatt

SEQ ID NO: 227011 - DNA, 18 bp, Mus musculus
tatgtgtatgtatatata

SEQ ID NO: 227012 - DNA, 22 bp, Mus musculus
tgttttgtgaccaattatatgg

SEQ ID NO: 227013 - DNA, 23 bp, Mus musculus
tgcctgcctgcctgcatgcctgt

SEQ ID NO: 227014 - DNA, 18 bp, Mus musculus
acagacacatacagacac

SEQ ID NO: 227015 - DNA, 22 bp, Mus musculus
tgttttgtgaccaattatatgg

SEQ ID NO: 227016 - DNA, 23 bp, Mus musculus
ctctgggggtggattttggcata

SEQ ID NO: 227017 - DNA, 23 bp, Mus musculus
aaagccaggctcagtggctctct

SEQ ID NO: 227018 - DNA, 22 bp, Mus musculus
tgttttgtgaccaattatatgg

SEQ ID NO: 227019 - DNA, 20 bp, Mus musculus
accagacagcaatagcaggg

SEQ ID NO: 227020 - DNA, 21 bp, Mus musculus
tacatatgactggcaccattc

SEQ ID NO: 227021 - DNA, 22 bp, Mus musculus
tgttttgtgaccaattatatgg

SEQ ID NO: 227022 - DNA, 23 bp, Mus musculus
tgtctgtccctctgtctctgcgt

SEQ ID NO: 227023 - DNA, 22 bp, Mus musculus
tgttttgtgaccaattatatgg

SEQ ID NO: 227024 - DNA, 22 bp, Mus musculus
tgttttgtgaccaattatatgg

SEQ ID NO: 227025 - DNA, 23 bp, Mus musculus
ctcagtgtgtctgagtgcctccc

SEQ ID NO: 227026 - DNA, 22 bp, Mus musculus
tgttttgtgaccaattatatgg

SEQ ID NO: 227027 - DNA, 23 bp, Mus musculus
gtctgtctgtctgtctctctctc

SEQ ID NO: 227028 - DNA, 22 bp, Mus musculus
tgttttgtgaccaattatatgg

SEQ ID NO: 227029 - DNA, 22 bp, Mus musculus
tgttttgtgaccaattatatgg

SEQ ID NO: 227030 - DNA, 22 bp, Mus musculus
tgttttgtgaccaattatatgg

SEQ ID NO: 227031 - DNA, 20 bp, Mus musculus
agtaatgaaattatgttttt

SEQ ID NO: 227032 - DNA, 23 bp, Mus musculus
agactgatgaagttactctctca

SEQ ID NO: 227033 - DNA, 22 bp, Mus musculus
gaataataggatttgtctatca

SEQ ID NO: 227034 - DNA, 18 bp, Mus musculus
atctgtattcatttttct

SEQ ID NO: 227035 - DNA, 22 bp, Mus musculus
tgttttgtgaccaattatatgg

SEQ ID NO: 227036 - DNA, 23 bp, Mus musculus
atatctatatctatatgtgtgtg

SEQ ID NO: 227037 - DNA, 22 bp, Mus musculus
ccatggtggtctgataggatgc

SEQ ID NO: 227038 - DNA, 22 bp, Mus musculus
tgttttgtgaccaattatatgg

SEQ ID NO: 227039 - DNA, 19 bp, Mus musculus
agagtttggctgggtatag

SEQ ID NO: 227040 - DNA, 23 bp, Mus musculus
tctcagtgtctgtataacatctg

SEQ ID NO: 227041 - DNA, 20 bp, Mus musculus
atagttgtctctggttagag

SEQ ID NO: 227042 - DNA, 22 bp, Mus musculus
tgttttgtgaccaattatatgg

SEQ ID NO: 227043 - DNA, 23 bp, Mus musculus
tagtgcatggtgatctgatagga

SEQ ID NO: 227044 - DNA, 19 bp, Mus musculus
tttgtgacctattatgtgg

SEQ ID NO: 227045 - DNA, 22 bp, Mus musculus
tgttttgtgaccaattatatgg

SEQ ID NO: 227046 - DNA, 23 bp, Mus musculus
ccagaagtccctgctgtatgtgt

SEQ ID NO: 227047 - DNA, 23 bp, Mus musculus
atatcagctggtgtatgttgtct

SEQ ID NO: 227048 - DNA, 18 bp, Mus musculus
atatgtgtatatgtatat

SEQ ID NO: 227049 - DNA, 22 bp, Mus musculus
tgttttgtgaccaattatatgg

SEQ ID NO: 227050 - DNA, 22 bp, Mus musculus
tgacaagatgcttttctgagat

SEQ ID NO: 227051 - DNA, 22 bp, Mus musculus
tctctgcctctgtctggagagt

SEQ ID NO: 227052 - DNA, 23 bp, Mus musculus
tctccccctgtcaatcattatcc

SEQ ID NO: 227053 - DNA, 20 bp, Mus musculus
agacagtgaacaggggtgga

SEQ ID NO: 227054 - DNA, 23 bp, Mus musculus
tcattcagagtgatatttctagc

SEQ ID NO: 227055 - DNA, 19 bp, Mus musculus
tatagtgatctgataggat

SEQ ID NO: 227056 - DNA, 22 bp, Mus musculus
tactgcttttcatattctgtct

SEQ ID NO: 227057 - DNA, 22 bp, Mus musculus
tgttttgtgaccaattatatgg

SEQ ID NO: 227058 - DNA, 23 bp, Mus musculus
tgtacatatgtatgtatgtatgt

SEQ ID NO: 227059 - DNA, 22 bp, Mus musculus
tgttttgtgaccaattatatgg

SEQ ID NO: 227060 - DNA, 22 bp, Mus musculus
tgttttgtgaccaattatatgg

SEQ ID NO: 227061 - DNA, 18 bp, Mus musculus
tgtgatgatgcaaaccac

SEQ ID NO: 227062 - DNA, 18 bp, Mus musculus
tgtgatgatgcaaaccac

SEQ ID NO: 227063 - DNA, 23 bp, Mus musculus
tgacagtctgagaatgagcaatg

SEQ ID NO: 227064 - DNA, 22 bp, Mus musculus
tgttttgtgaccaattatatgg

SEQ ID NO: 227065 - DNA, 23 bp, Mus musculus
tagtccatgttgatctgatagga

SEQ ID NO: 227066 - DNA, 19 bp, Mus musculus
tatttggtcagttttggag

SEQ ID NO: 227067 - DNA, 22 bp, Mus musculus
tgttttgtgaccaattatatgg

SEQ ID NO: 227068 - DNA, 23 bp, Mus musculus
aatgtgaatatgtatgtgtgtgt

SEQ ID NO: 227069 - DNA, 20 bp, Mus musculus
ttagattgggcagagaataa

SEQ ID NO: 227070 - DNA, 20 bp, Mus musculus
tgataggatacatgggagaa

SEQ ID NO: 227071 - DNA, 22 bp, Mus musculus
tgttttgtgaccaattatatgg

SEQ ID NO: 227072 - DNA, 22 bp, Mus musculus
tgttttgtgaccaattatatgg

SEQ ID NO: 227073 - DNA, 18 bp, Mus musculus
gtatgtatgtatgtgtgt

SEQ ID NO: 227074 - DNA, 23 bp, Mus musculus
cacacatgtgtgtgtgtgtacag

SEQ ID NO: 227075 - DNA, 19 bp, Mus musculus
tgtatatatatgtatatgt

SEQ ID NO: 227076 - DNA, 23 bp, Mus musculus
atgtatgtatgtatgtatgtatg

SEQ ID NO: 227077 - DNA, 21 bp, Mus musculus
tgtgtgtatgtgtatatatgt

SEQ ID NO: 227078 - DNA, 22 bp, Mus musculus
atatgcatgtatgtatatgtgt

SEQ ID NO: 227079 - DNA, 20 bp, Mus musculus
atgtatgtgtgtatatatga

SEQ ID NO: 227080 - DNA, 22 bp, Mus musculus
tgttttgtgaccaattatatgg

SEQ ID NO: 227081 - DNA, 23 bp, Mus musculus
tcttagtgcttgttctatcagtg

SEQ ID NO: 227082 - DNA, 22 bp, Mus musculus
tgttttgtgaccaattatatgg

SEQ ID NO: 227083 - DNA, 23 bp, Mus musculus
tgtctctgagagcctgtcagtta

SEQ ID NO: 227084 - DNA, 23 bp, Mus musculus
cagagtgagacaaagcagaaact

SEQ ID NO: 227085 - DNA, 22 bp, Mus musculus
tccctgtgtctgctattggtga

SEQ ID NO: 227086 - DNA, 22 bp, Mus musculus
atgaacacacacaaattcctgt

SEQ ID NO: 227087 - DNA, 23 bp, Mus musculus
acacacacacatacatcatatca

SEQ ID NO: 227088 - DNA, 23 bp, Mus musculus
tatttttgagatgagagagtggc

SEQ ID NO: 227089 - DNA, 20 bp, Mus musculus
agagcaagctaaggcaaaga

SEQ ID NO: 227090 - DNA, 23 bp, Mus musculus
tcagtcaatttctctctggatct

SEQ ID NO: 227091 - DNA, 23 bp, Mus musculus
ggtaagatcttctggaagtggac

SEQ ID NO: 227092 - DNA, 22 bp, Mus musculus
attaatctgttcaagcagtggt

SEQ ID NO: 227093 - DNA, 22 bp, Mus musculus
aagacagtgacaagactgccac

SEQ ID NO: 227094 - DNA, 23 bp, Mus musculus
atgcctgtgtgtgtctgtgtatc

SEQ ID NO: 227095 - DNA, 18 bp, Mus musculus
aagagcaggctatatgtg

SEQ ID NO: 227096 - DNA, 23 bp, Mus musculus
tatgcttgtatatgtgtatgtgt

SEQ ID NO: 227097 - DNA, 23 bp, Mus musculus
tttgtgtgtgtgtgtaaaactgg

SEQ ID NO: 227098 - DNA, 23 bp, Mus musculus
gtctgtctgtctgtctctctcgt

SEQ ID NO: 227099 - DNA, 23 bp, Mus musculus
agtgagagagacaggcagagatg

SEQ ID NO: 227100 - DNA, 20 bp, Mus musculus
agtggttgctgtgggaggga

SEQ ID NO: 227101 - DNA, 23 bp, Mus musculus
tcactggctctgtgtgtctttta

SEQ ID NO: 227102 - DNA, 22 bp, Mus musculus
tgtttagagctaagtgtggtgt

SEQ ID NO: 227103 - DNA, 18 bp, Mus musculus
aactgtctgcctgagctg

SEQ ID NO: 227104 - DNA, 21 bp, Mus musculus
aaagtctcagttccagatcac

SEQ ID NO: 227105 - DNA, 23 bp, Mus musculus
ggtgagatttctctcagtgacag

SEQ ID NO: 227106 - DNA, 21 bp, Mus musculus
actgtgtctgtgatatacatg

SEQ ID NO: 227107 - DNA, 23 bp, Mus musculus
tgtgtacatgtatgtgtgtatat

SEQ ID NO: 227108 - DNA, 23 bp, Mus musculus
gtgtgtatgtatgtatgtatgta

SEQ ID NO: 227109 - DNA, 23 bp, Mus musculus
tttcactgtcacacttaaactgg

SEQ ID NO: 227110 - DNA, 23 bp, Mus musculus
ctttgattctcttgctgctttga

SEQ ID NO: 227111 - DNA, 21 bp, Mus musculus
tcatgctggcagcatgatgat

SEQ ID NO: 227112 - DNA, 18 bp, Mus musculus
cacaggcatatgcatgtg

SEQ ID NO: 227113 - DNA, 23 bp, Mus musculus
tttctgtggtttagatatcagag

SEQ ID NO: 227114 - DNA, 22 bp, Mus musculus
tgttttgtgaccaattatatgg

SEQ ID NO: 227115 - DNA, 22 bp, Mus musculus
tgttttgtgaccaattatatgg

SEQ ID NO: 227116 - DNA, 22 bp, Mus musculus
tgttttgtgaccaattatatgg

SEQ ID NO: 227117 - DNA, 23 bp, Mus musculus
tgctgagagtggagatagaggtc

SEQ ID NO: 227118 - DNA, 22 bp, Mus musculus
tgttttgtgaccaattatatgg

SEQ ID NO: 227119 - DNA, 20 bp, Mus musculus
tggagcgggatctcttaagc

SEQ ID NO: 227120 - DNA, 19 bp, Mus musculus
ttactttcacttctgctcg

SEQ ID NO: 227121 - DNA, 23 bp, Mus musculus
tgctgagagtggagatagaggtc

SEQ ID NO: 227122 - DNA, 22 bp, Mus musculus
tgttttgtgaccaattatatgg

SEQ ID NO: 227123 - DNA, 23 bp, Mus musculus
tgctgagagtggagatagaggtc

SEQ ID NO: 227124 - DNA, 22 bp, Mus musculus
tgttttgtgaccaattatatgg

SEQ ID NO: 227125 - DNA, 23 bp, Mus musculus
tgctgagagtggagatagaggtc

SEQ ID NO: 227126 - DNA, 23 bp, Mus musculus
tgctgagagtggagatagaggtc

SEQ ID NO: 227127 - DNA, 23 bp, Mus musculus
tagtccatggtgatctgatagga

SEQ ID NO: 227128 - DNA, 19 bp, Mus musculus
tttgtatctgttgaagcct

SEQ ID NO: 227129 - DNA, 20 bp, Mus musculus
ttttgtgacccactatatgg

SEQ ID NO: 227130 - DNA, 21 bp, Mus musculus
tgcatatatgtactttatgta

SEQ ID NO: 227131 - DNA, 23 bp, Mus musculus
gaaatgagtgtgaggtctgaggc

SEQ ID NO: 227132 - DNA, 23 bp, Mus musculus
actgtcacagtctgtgggatgct

SEQ ID NO: 227133 - DNA, 23 bp, Mus musculus
ggcctgtcacacagtgtgatcag

SEQ ID NO: 227134 - DNA, 19 bp, Mus musculus
tctcagtgtgtgttggagc

SEQ ID NO: 227135 - DNA, 21 bp, Mus musculus
tgcatacatatgcatatgtga

SEQ ID NO: 227136 - DNA, 23 bp, Mus musculus
tacacatgtgtatatgttcatat

SEQ ID NO: 227137 - DNA, 20 bp, Mus musculus
tgagaggctgtttttgtagt

SEQ ID NO: 227138 - DNA, 23 bp, Mus musculus
tgtgtctgtgtgtgcctgtgtat

SEQ ID NO: 227139 - DNA, 23 bp, Mus musculus
tgtagtcctggctgtcctgggac

SEQ ID NO: 227140 - DNA, 23 bp, Mus musculus
tcagactcacagagaaacatctg

SEQ ID NO: 227141 - DNA, 20 bp, Mus musculus
aaacatgaagcgctgcaaca

SEQ ID NO: 227142 - DNA, 23 bp, Mus musculus
tccctgaggagccctttgagcct

SEQ ID NO: 227143 - DNA, 23 bp, Mus musculus
ctctgctagaacagactgtgctt

SEQ ID NO: 227144 - DNA, 19 bp, Mus musculus
tggcacagacctttaatcc

SEQ ID NO: 227145 - DNA, 23 bp, Mus musculus
caaagtgctaacagtgcaggtag

SEQ ID NO: 227146 - DNA, 19 bp, Mus musculus
tactgcagtgccagcactt

SEQ ID NO: 227147 - DNA, 23 bp, Mus musculus
caaagtgctcatagtgcaggtag

SEQ ID NO: 227148 - DNA, 20 bp, Mus musculus
actgcagtgtgagcacttct

SEQ ID NO: 227149 - DNA, 23 bp, Mus musculus
ctacttacgattagttttgcaga

SEQ ID NO: 227150 - DNA, 23 bp, Mus musculus
tgtgcaaatccatgcaaaactga

SEQ ID NO: 227151 - DNA, 23 bp, Mus musculus
attggtggcattacttgtgttag

SEQ ID NO: 227152 - DNA, 22 bp, Mus musculus
tattgcacttgtcccggcctga

SEQ ID NO: 227153 - DNA, 23 bp, Mus musculus
gatctcagactgttgtgagccac

SEQ ID NO: 227154 - DNA, 22 bp, Mus musculus
ctgaggtagtaggctgaaatgt

SEQ ID NO: 227155 - DNA, 23 bp, Mus musculus
agcatgaagaatttgcttggcac

SEQ ID NO: 227156 - DNA, 19 bp, Mus musculus
tggcatggagagaggagtc

SEQ ID NO: 227157 - DNA, 23 bp, Mus musculus
aatgtgtgtgtgtgtgtcactgc

SEQ ID NO: 227158 - DNA, 23 bp, Mus musculus
tgatatttatgcatggttttcct

SEQ ID NO: 227159 - DNA, 20 bp, Mus musculus
tagtgcctgcatctgatcac

SEQ ID NO: 227160 - DNA, 23 bp, Mus musculus
tgtgtgcacagtgaccacagagg

SEQ ID NO: 227161 - DNA, 23 bp, Mus musculus
agtacaataggctgtggtagttc

SEQ ID NO: 227162 - DNA, 22 bp, Mus musculus
tgttttgtgaccaattatatgg

SEQ ID NO: 227163 - DNA, 22 bp, Mus musculus
tgttttgtgaccaattatatgg

SEQ ID NO: 227164 - DNA, 22 bp, Mus musculus
tgttttgtgaccaattatatgg

SEQ ID NO: 227165 - DNA, 23 bp, Mus musculus
cattttggaatttttctagtaca

SEQ ID NO: 227166 - DNA, 22 bp, Mus musculus
tgtctagaaacctatagcttcg

SEQ ID NO: 227167 - DNA, 22 bp, Mus musculus
tagaccaatggaatagaattga

SEQ ID NO: 227168 - DNA, 22 bp, Mus musculus
tgttttgtgaccaattatatgg

SEQ ID NO: 227169 - DNA, 21 bp, Mus musculus
tccatggtggtctgataggat

SEQ ID NO: 227170 - DNA, 22 bp, Mus musculus
tgttttgtgaccaattatatgg

SEQ ID NO: 227171 - DNA, 22 bp, Mus musculus
tgttttgtgaccaattatatgg

SEQ ID NO: 227172 - DNA, 22 bp, Mus musculus
tgttttgtgaccaattatatgg

SEQ ID NO: 227173 - DNA, 20 bp, Mus musculus
tcacagtctcattctaacca

SEQ ID NO: 227174 - DNA, 22 bp, Mus musculus
aattagcaatgtaattgagttt

SEQ ID NO: 227175 - DNA, 22 bp, Mus musculus
tgttttgtgaccaattatatgg

SEQ ID NO: 227176 - DNA, 23 bp, Mus musculus
ggagtgtgtgaggagacagagcc

SEQ ID NO: 227177 - DNA, 20 bp, Mus musculus
aatctatatgtatttgtttc

SEQ ID NO: 227178 - DNA, 23 bp, Mus musculus
agttcaattcctagaaaccacat

SEQ ID NO: 227179 - DNA, 23 bp, Mus musculus
tgagttaattgagagtcagcaca

SEQ ID NO: 227180 - DNA, 23 bp, Mus musculus
tatttctgtatttcatgttctgt

SEQ ID NO: 227181 - DNA, 23 bp, Mus musculus
tgacagaacagtgtatgcacctg

SEQ ID NO: 227182 - DNA, 23 bp, Mus musculus
agaactctatttgttaatgttag

SEQ ID NO: 227183 - DNA, 18 bp, Mus musculus
agaggaaatatgaagcat

SEQ ID NO: 227184 - DNA, 21 bp, Mus musculus
taaactgtctctgacttagcc

SEQ ID NO: 227185 - DNA, 23 bp, Mus musculus
ttgctgtccgtctgtctctgtct

SEQ ID NO: 227186 - DNA, 22 bp, Mus musculus
ctttaaagaagaaactgagctc

SEQ ID NO: 227187 - DNA, 22 bp, Mus musculus
tgacttgttaatatcttgttga

SEQ ID NO: 227188 - DNA, 23 bp, Mus musculus
tgtgtgtgtgtctgtgtcagata

SEQ ID NO: 227189 - DNA, 18 bp, Mus musculus
ttctggaaatcatgaact

SEQ ID NO: 227190 - DNA, 23 bp, Mus musculus
ggcgctgtctgtctgtctgtctc

SEQ ID NO: 227191 - DNA, 23 bp, Mus musculus
cattgcctatctctgtctatctg

SEQ ID NO: 227192 - DNA, 23 bp, Mus musculus
tctatatctatatatgtgtgtgt

SEQ ID NO: 227193 - DNA, 23 bp, Mus musculus
tgagctgtcttgtgtgggtgcca

SEQ ID NO: 227194 - DNA, 22 bp, Mus musculus
tgttttgtgaccaattatatgg

SEQ ID NO: 227195 - DNA, 23 bp, Mus musculus
tgcctcagtggctctgtgcctcc

SEQ ID NO: 227196 - DNA, 23 bp, Mus musculus
agactctcactttctatgtagag

SEQ ID NO: 227197 - DNA, 23 bp, Mus musculus
tgtgtgtgtgtgtgtgtgtcata

SEQ ID NO: 227198 - DNA, 22 bp, Mus musculus
tgagtctttgtggaaagttact

SEQ ID NO: 227199 - DNA, 22 bp, Mus musculus
atttcagtgactgaataagaag

SEQ ID NO: 227200 - DNA, 23 bp, Mus musculus
aactgtgtactatgctaagttgt

SEQ ID NO: 227201 - DNA, 23 bp, Mus musculus
taaagtacataagttatgtccta

SEQ ID NO: 227202 - DNA, 23 bp, Mus musculus
agactagtgattatgttttaatc

SEQ ID NO: 227203 - DNA, 23 bp, Mus musculus
aagtaaggatgacaatcttagtt

SEQ ID NO: 227204 - DNA, 23 bp, Mus musculus
tagtccatggtgatctgatagga

SEQ ID NO: 227205 - DNA, 19 bp, Mus musculus
tgtcaattacttatgagta

SEQ ID NO: 227206 - DNA, 23 bp, Mus musculus
catttccatagtagaatagtgat

SEQ ID NO: 227207 - DNA, 21 bp, Mus musculus
tatgtgatatatggtaagtga

SEQ ID NO: 227208 - DNA, 22 bp, Mus musculus
tgttttgtgaccaattatatgg

SEQ ID NO: 227209 - DNA, 18 bp, Mus musculus
gttttgtctatggaaacc

SEQ ID NO: 227210 - DNA, 23 bp, Mus musculus
aatcacagaaacatgataccatc

SEQ ID NO: 227211 - DNA, 23 bp, Mus musculus
gtatgcatgcatgcatgtatgtc

SEQ ID NO: 227212 - DNA, 23 bp, Mus musculus
taattactgcttctctttcctta

SEQ ID NO: 227213 - DNA, 23 bp, Mus musculus
tattgtgtggtcttgatttaact

SEQ ID NO: 227214 - DNA, 19 bp, Mus musculus
taagtggcatgtatttagg

SEQ ID NO: 227215 - DNA, 23 bp, Mus musculus
tctatgtctatatctatctctct

SEQ ID NO: 227216 - DNA, 22 bp, Mus musculus
tgttttgtgaccaattatatgg

SEQ ID NO: 227217 - DNA, 19 bp, Mus musculus
ttgtcaaagggactgttca

SEQ ID NO: 227218 - DNA, 22 bp, Mus musculus
tgttttgtgaccaattatatgg

SEQ ID NO: 227219 - DNA, 19 bp, Mus musculus
agttctctatctttgttgg

SEQ ID NO: 227220 - DNA, 19 bp, Mus musculus
ttgggtagagtacattatg

SEQ ID NO: 227221 - DNA, 21 bp, Mus musculus
tagcactttagccactacact

SEQ ID NO: 227222 - DNA, 21 bp, Mus musculus
aaggagctggagtggttagct

SEQ ID NO: 227223 - DNA, 22 bp, Mus musculus
tgttttgtgaccaattatatgg

SEQ ID NO: 227224 - DNA, 22 bp, Mus musculus
tgttttgtgaccaattatatgg

SEQ ID NO: 227225 - DNA, 23 bp, Mus musculus
gcagctcaggtagtagaatgtat

SEQ ID NO: 227226 - DNA, 23 bp, Mus musculus
caggctctgtgtccctctctgcc

SEQ ID NO: 227227 - DNA, 19 bp, Mus musculus
tgtgtgtgtgtgtgtgtat

SEQ ID NO: 227228 - DNA, 22 bp, Mus musculus
tgttttgtgaccaattatatgg

SEQ ID NO: 227229 - DNA, 23 bp, Mus musculus
gcctcagtccctctgtgcttctg

SEQ ID NO: 227230 - DNA, 20 bp, Mus musculus
agactcagcacagtgagagg

SEQ ID NO: 227231 - DNA, 22 bp, Mus musculus
tgttttgtgaccaattatatgg

SEQ ID NO: 227232 - DNA, 22 bp, Mus musculus
tgttttgtgaccaattatatgg

SEQ ID NO: 227233 - DNA, 20 bp, Mus musculus
ccagctaagtttatcactat

SEQ ID NO: 227234 - DNA, 22 bp, Mus musculus
tgttttgtgaccaattatatgg

SEQ ID NO: 227235 - DNA, 22 bp, Mus musculus
tgttttgtgaccaattatatgg

SEQ ID NO: 227236 - DNA, 22 bp, Mus musculus
tgttttgtgaccaattatatgg

SEQ ID NO: 227237 - DNA, 18 bp, Mus musculus
tgaaagggattcttctga

SEQ ID NO: 227238 - DNA, 23 bp, Mus musculus
atatatatggatatgtatatcca

SEQ ID NO: 227239 - DNA, 21 bp, Mus musculus
atatgtgtgtgtgtgtataca

SEQ ID NO: 227240 - DNA, 23 bp, Mus musculus
ttagagagacctattattcaggt

SEQ ID NO: 227241 - DNA, 19 bp, Mus musculus
tgagagaagacattgagga

SEQ ID NO: 227242 - DNA, 23 bp, Mus musculus
ctgtctctctctctctctgacac

SEQ ID NO: 227243 - DNA, 23 bp, Mus musculus
atgctctctcagtctctgtgagt

SEQ ID NO: 227244 - DNA, 22 bp, Mus musculus
aaggatgtatacaactgtgtgt

SEQ ID NO: 227245 - DNA, 23 bp, Mus musculus
gggctgtctctgactctgtagcc

SEQ ID NO: 227246 - DNA, 23 bp, Mus musculus
agtcagaactcagtcagtaaact

SEQ ID NO: 227247 - DNA, 23 bp, Mus musculus
gcatgtagaccccagttcgactc

SEQ ID NO: 227248 - DNA, 23 bp, Mus musculus
gcctctctgtctgcctctgtttg

SEQ ID NO: 227249 - DNA, 19 bp, Mus musculus
tgttggaagatgtaaactt

SEQ ID NO: 227250 - DNA, 23 bp, Mus musculus
ttttacttgtatatgtattgtat

SEQ ID NO: 227251 - DNA, 23 bp, Mus musculus
tcagagatgaatgacagcaaaga

SEQ ID NO: 227252 - DNA, 20 bp, Mus musculus
gtacagtactgattttgtac

SEQ ID NO: 227253 - DNA, 23 bp, Mus musculus
tgtatggtgatcctggacagagg

SEQ ID NO: 227254 - DNA, 22 bp, Mus musculus
tgtagctgccagaatgatgtat

SEQ ID NO: 227255 - DNA, 22 bp, Mus musculus
acacacacacactaacatgaga

SEQ ID NO: 227256 - DNA, 23 bp, Mus musculus
tgtctgtctctgtgtaagtctgt

SEQ ID NO: 227257 - DNA, 18 bp, Mus musculus
gtggtcataatgaggtgt

SEQ ID NO: 227258 - DNA, 20 bp, Mus musculus
acagcatgataagaggctag

SEQ ID NO: 227259 - DNA, 23 bp, Mus musculus
acatcagcaatttgcttctatac

SEQ ID NO: 227260 - DNA, 23 bp, Mus musculus
cttcattcagtgcttttccagtg

SEQ ID NO: 227261 - DNA, 23 bp, Mus musculus
gaaaaagtgagaggttttcaggc

SEQ ID NO: 227262 - DNA, 20 bp, Mus musculus
gtctctctttctttgtggag

SEQ ID NO: 227263 - DNA, 20 bp, Mus musculus
ttcacttgcttgtacttggg

SEQ ID NO: 227264 - DNA, 23 bp, Mus musculus
tacttcatttgctgctgaacaac

SEQ ID NO: 227265 - DNA, 23 bp, Mus musculus
tgggtctgtgtaactctgtgtat

SEQ ID NO: 227266 - DNA, 22 bp, Mus musculus
tgttttgtgaccaattatatgg

SEQ ID NO: 227267 - DNA, 23 bp, Mus musculus
ttgcagaagagagtgagtactcc

SEQ ID NO: 227268 - DNA, 22 bp, Mus musculus
tgttttgtgaccaattatatgg

SEQ ID NO: 227269 - DNA, 22 bp, Mus musculus
tgttttgtgaccaattatatgg

SEQ ID NO: 227270 - DNA, 23 bp, Mus musculus
tatgtgtatatatatgtgtgtgt

SEQ ID NO: 227271 - DNA, 23 bp, Mus musculus
atgtatgtatatatgtatacatg

SEQ ID NO: 227272 - DNA, 18 bp, Mus musculus
gtatatatttgaagtgtg

SEQ ID NO: 227273 - DNA, 22 bp, Mus musculus
tgttttgtgaccaattatatgg

SEQ ID NO: 227274 - DNA, 20 bp, Mus musculus
tctggtcatgcatcttggag

SEQ ID NO: 227275 - DNA, 23 bp, Mus musculus
tccttgtctggctctgggtctct

SEQ ID NO: 227276 - DNA, 22 bp, Mus musculus
tactgcttttaatattctgtct

SEQ ID NO: 227277 - DNA, 23 bp, Mus musculus
ttctggtccagtctatttggagt

SEQ ID NO: 227278 - DNA, 23 bp, Mus musculus
tctgtgtctggcagtctgtctgc

SEQ ID NO: 227279 - DNA, 22 bp, Mus musculus
tgtgtgtgtgtgtatctgcatg

SEQ ID NO: 227280 - DNA, 23 bp, Mus musculus
ttttctgagataggatctcatgt

SEQ ID NO: 227281 - DNA, 23 bp, Mus musculus
gcctctctctgccagtgctcaca

SEQ ID NO: 227282 - DNA, 23 bp, Mus musculus
tgcctctctctgccagtgctctc

SEQ ID NO: 227283 - DNA, 19 bp, Mus musculus
gagctgaaaagtaacttgg

SEQ ID NO: 227284 - DNA, 23 bp, Mus musculus
cagacagcagagacagctcagtg

SEQ ID NO: 227285 - DNA, 18 bp, Mus musculus
agtttgcttcccagtgtc

SEQ ID NO: 227286 - DNA, 23 bp, Mus musculus
gtgtcagcttctgcatctgtaat

SEQ ID NO: 227287 - DNA, 23 bp, Mus musculus
cagacagcagagacagctcagtg

SEQ ID NO: 227288 - DNA, 22 bp, Mus musculus
atgggccagagtttgcttccca

SEQ ID NO: 227289 - DNA, 19 bp, Mus musculus
gagctgaaaagtaacttgg

SEQ ID NO: 227290 - DNA, 23 bp, Mus musculus
cagacagcagagacagctcagtg

SEQ ID NO: 227291 - DNA, 18 bp, Mus musculus
agtttgcttcccagtgtc

SEQ ID NO: 227292 - DNA, 19 bp, Mus musculus
gagctgaaaagtaacttgg

SEQ ID NO: 227293 - DNA, 23 bp, Mus musculus
cagacagcagagacagctcagtg

SEQ ID NO: 227294 - DNA, 18 bp, Mus musculus
agtttgcttcccagtgtc

SEQ ID NO: 227295 - DNA, 19 bp, Mus musculus
gagctgaaaagtaacttgg

SEQ ID NO: 227296 - DNA, 23 bp, Mus musculus
cagacagcagagacagctcagtg

SEQ ID NO: 227297 - DNA, 22 bp, Mus musculus
atgggccagagtttgcttccca

SEQ ID NO: 227298 - DNA, 23 bp, Mus musculus
gtgtcagcttctgcatctgtaat

SEQ ID NO: 227299 - DNA, 20 bp, Mus musculus
tgtgtgtgtgtgtgcgcgcg

SEQ ID NO: 227300 - DNA, 23 bp, Mus musculus
gagcatgtgatgtatgtgtgcac

SEQ ID NO: 227301 - DNA, 20 bp, Mus musculus
gtggtggtggtggtggtgga

SEQ ID NO: 227302 - DNA, 23 bp, Mus musculus
tctgtgtgtgtgtctgtgtgcgc

SEQ ID NO: 227303 - DNA, 23 bp, Mus musculus
tgtgcatgtgcaaacacacacac

SEQ ID NO: 227304 - DNA, 23 bp, Mus musculus
tgttatgcaatgttctttgggca

SEQ ID NO: 227305 - DNA, 19 bp, Mus musculus
tgtgtgtctgtctgtctgt

SEQ ID NO: 227306 - DNA, 21 bp, Mus musculus
tttgtgtctgctttgtaattc

SEQ ID NO: 227307 - DNA, 22 bp, Mus musculus
tgttttgtgaccaattatatgg

SEQ ID NO: 227308 - DNA, 21 bp, Mus musculus
tgtgtgtgtatgtatatatgt

SEQ ID NO: 227309 - DNA, 23 bp, Mus musculus
aggaagctaaagatgctacagaa

SEQ ID NO: 227310 - DNA, 23 bp, Mus musculus
acacaggcactgacacaggcact

SEQ ID NO: 227311 - DNA, 22 bp, Mus musculus
tgttttgtgaccaattatatgg

SEQ ID NO: 227312 - DNA, 22 bp, Mus musculus
tctcttatggtagagttgggga

SEQ ID NO: 227313 - DNA, 23 bp, Mus musculus
tgatgtctgagagcttacctgtt

SEQ ID NO: 227314 - DNA, 22 bp, Mus musculus
tgttttgtgaccaattatatgg

SEQ ID NO: 227315 - DNA, 22 bp, Mus musculus
tgttttgtgaccaattatatgg

SEQ ID NO: 227316 - DNA, 20 bp, Mus musculus
tcacagaactgagtgacttg

SEQ ID NO: 227317 - DNA, 23 bp, Mus musculus
tgatgtctgagagcttacctgtt

SEQ ID NO: 227318 - DNA, 22 bp, Mus musculus
tctcttatggtagagttgggga

SEQ ID NO: 227319 - DNA, 20 bp, Mus musculus
catgaatgtagagggcctag

SEQ ID NO: 227320 - DNA, 23 bp, Mus musculus
tctgtggttgttgcttctatatt

SEQ ID NO: 227321 - DNA, 21 bp, Mus musculus
tgaataggtaggtagaaagtg

SEQ ID NO: 227322 - DNA, 22 bp, Mus musculus
tgttttgtgaccaattatatgg

SEQ ID NO: 227323 - DNA, 20 bp, Mus musculus
tcacagaactgagtgacttg

SEQ ID NO: 227324 - DNA, 23 bp, Mus musculus
tgatgtctgagagcttacctgtt

SEQ ID NO: 227325 - DNA, 22 bp, Mus musculus
tctcttatggtagagttgggga

SEQ ID NO: 227326 - DNA, 20 bp, Mus musculus
tcacagaactgagtgacttg

SEQ ID NO: 227327 - DNA, 23 bp, Mus musculus
tgatgtctgagagcttacctgtt

SEQ ID NO: 227328 - DNA, 22 bp, Mus musculus
tctcttatggtagagttgggga

SEQ ID NO: 227329 - DNA, 23 bp, Mus musculus
tgatgtctgagagcttacctgtt

SEQ ID NO: 227330 - DNA, 22 bp, Mus musculus
tgttttgtgaccaattatatgg

SEQ ID NO: 227331 - DNA, 20 bp, Mus musculus
tcacagaactgagtgacttg

SEQ ID NO: 227332 - DNA, 23 bp, Mus musculus
tgatgtctgagagcttacctgtt

SEQ ID NO: 227333 - DNA, 22 bp, Mus musculus
tctcttatggtagagttgggga

SEQ ID NO: 227334 - DNA, 23 bp, Mus musculus
tgatgtctgagagcttacctgtt

SEQ ID NO: 227335 - DNA, 23 bp, Mus musculus
tgatgtctgagagcttacctgtt

SEQ ID NO: 227336 - DNA, 22 bp, Mus musculus
tgttttgtgaccaattatatgg

SEQ ID NO: 227337 - DNA, 23 bp, Mus musculus
tctgtggttgttgcttctatatt

SEQ ID NO: 227338 - DNA, 23 bp, Mus musculus
tgtgtgtctgtttgtcaattcat

SEQ ID NO: 227339 - DNA, 23 bp, Mus musculus
atgttggtctgataggatacatg

SEQ ID NO: 227340 - DNA, 22 bp, Mus musculus
tgttttgtgaccaattttatgg

SEQ ID NO: 227341 - DNA, 23 bp, Mus musculus
cagcatttgcttctgctcctggt

SEQ ID NO: 227342 - DNA, 19 bp, Mus musculus
tgagtacagactcctagag

SEQ ID NO: 227343 - DNA, 23 bp, Mus musculus
tgtgtgtctgtttgtcaattcat

SEQ ID NO: 227344 - DNA, 20 bp, Mus musculus
acagaaagtagtctgcacag

SEQ ID NO: 227345 - DNA, 23 bp, Mus musculus
gggtgtctgtgtctgtctgagtc

SEQ ID NO: 227346 - DNA, 20 bp, Mus musculus
tgagtagagactcctagagg

SEQ ID NO: 227347 - DNA, 23 bp, Mus musculus
tgatctcattttgttgtagtatt

SEQ ID NO: 227348 - DNA, 18 bp, Mus musculus
ataggtaggtagaaagtg

SEQ ID NO: 227349 - DNA, 19 bp, Mus musculus
tgagtacagactcctagag

SEQ ID NO: 227350 - DNA, 21 bp, Mus musculus
tgaataggtaggtagaaagtg

SEQ ID NO: 227351 - DNA, 23 bp, Mus musculus
tgtgtgtctgtttgtcaattcat

SEQ ID NO: 227352 - DNA, 20 bp, Mus musculus
acagaaagtagtctgcacag

SEQ ID NO: 227353 - DNA, 23 bp, Mus musculus
agtccatggtgatctgataggtt

SEQ ID NO: 227354 - DNA, 21 bp, Mus musculus
tttgggacccattatatggcc

SEQ ID NO: 227355 - DNA, 23 bp, Mus musculus
tgtgtgtctgtttgtcaattcat

SEQ ID NO: 227356 - DNA, 20 bp, Mus musculus
acagaaagtagtctgcacag

SEQ ID NO: 227357 - DNA, 23 bp, Mus musculus
gggtgtctgtgtctgtctgagtc

SEQ ID NO: 227358 - DNA, 20 bp, Mus musculus
tgagtagagactcctagagg

SEQ ID NO: 227359 - DNA, 23 bp, Mus musculus
ttgtaccttgtaaattgtgatat

SEQ ID NO: 227360 - DNA, 22 bp, Mus musculus
tgttttgtgaccaattatatgg

SEQ ID NO: 227361 - DNA, 19 bp, Mus musculus
tctgaggctggtccaggta

SEQ ID NO: 227362 - DNA, 22 bp, Mus musculus
ataggaaggtactctgcaggtt

SEQ ID NO: 227363 - DNA, 23 bp, Mus musculus
gtgtctgtgtctgtgtctgtgtc

SEQ ID NO: 227364 - DNA, 22 bp, Mus musculus
tatgagtattttgtatgctatg

SEQ ID NO: 227365 - DNA, 21 bp, Mus musculus
tatgtgtgtgtatgtagatag

SEQ ID NO: 227366 - DNA, 21 bp, Mus musculus
tccagcagagagagaaaagag

SEQ ID NO: 227367 - DNA, 23 bp, Mus musculus
tgaataatttgttacctgaaagt

SEQ ID NO: 227368 - DNA, 20 bp, Mus musculus
attgtgagtagagtttcagt

SEQ ID NO: 227369 - DNA, 23 bp, Mus musculus
aagaggaagatgaaaaatggtat

SEQ ID NO: 227370 - DNA, 23 bp, Mus musculus
tccatggttgtctgataggatgc

SEQ ID NO: 227371 - DNA, 21 bp, Mus musculus
tgtgtatatatatatatgtgt

SEQ ID NO: 227372 - DNA, 23 bp, Mus musculus
aatgtaccacattttgtttttca

SEQ ID NO: 227373 - DNA, 23 bp, Mus musculus
gttttgtctccttgtatatctgt

SEQ ID NO: 227374 - DNA, 22 bp, Mus musculus
tgttttgtgaccaattatatgg

SEQ ID NO: 227375 - DNA, 22 bp, Mus musculus
tgttttgtgaccaattatatgg

SEQ ID NO: 227376 - DNA, 23 bp, Mus musculus
agtgaacagatgagtgtgaccag

SEQ ID NO: 227377 - DNA, 22 bp, Mus musculus
tgttttgtgaccaattatatgg

SEQ ID NO: 227378 - DNA, 20 bp, Mus musculus
atgttatgaagtttgttctt

SEQ ID NO: 227379 - DNA, 22 bp, Mus musculus
agaaaacttcaatgtctggaag

SEQ ID NO: 227380 - DNA, 23 bp, Mus musculus
cctctctctttctctcagtgtcc

SEQ ID NO: 227381 - DNA, 22 bp, Mus musculus
tgaggaagtatcttgaaaagat

SEQ ID NO: 227382 - DNA, 21 bp, Mus musculus
tctaaggtattttcttaattg

SEQ ID NO: 227383 - DNA, 22 bp, Mus musculus
atcagtcactgtcacataacag

SEQ ID NO: 227384 - DNA, 23 bp, Mus musculus
tcattcccagtctctgttctctc

SEQ ID NO: 227385 - DNA, 22 bp, Mus musculus
tgtgtatatatgtatacgtgtg

SEQ ID NO: 227386 - DNA, 23 bp, Mus musculus
tgactggctggctggctggctgg

SEQ ID NO: 227387 - DNA, 22 bp, Mus musculus
cagtcttaggccatggtggtct

SEQ ID NO: 227388 - DNA, 23 bp, Mus musculus
ttttgtgaccaactatatggtca

SEQ ID NO: 227389 - DNA, 23 bp, Mus musculus
acagagagaccatctctctctct

SEQ ID NO: 227390 - DNA, 23 bp, Mus musculus
ctgtgtagagtctgaggactgaa

SEQ ID NO: 227391 - DNA, 19 bp, Mus musculus
accctgtgtgtatgtgtgt

SEQ ID NO: 227392 - DNA, 23 bp, Mus musculus
actcactggctgctcttcagagg

SEQ ID NO: 227393 - DNA, 18 bp, Mus musculus
atgctcctgaccaggaga

SEQ ID NO: 227394 - DNA, 22 bp, Mus musculus
tgttttgtgaccaattatatgg

SEQ ID NO: 227395 - DNA, 22 bp, Mus musculus
ctgagtgcctgagagcctgaga

SEQ ID NO: 227396 - DNA, 23 bp, Mus musculus
ttaagtgtatatatacatatgtg

SEQ ID NO: 227397 - DNA, 23 bp, Mus musculus
tgtatatatgtatacatatgtat

SEQ ID NO: 227398 - DNA, 20 bp, Mus musculus
tatgtgtgttgtcttgttgt

SEQ ID NO: 227399 - DNA, 22 bp, Mus musculus
tttagctcagaagtcatgcagt

SEQ ID NO: 227400 - DNA, 22 bp, Mus musculus
tgttttgtgaccaattatatgg

SEQ ID NO: 227401 - DNA, 23 bp, Mus musculus
agctacatctggctactgggtct

SEQ ID NO: 227402 - DNA, 23 bp, Mus musculus
agctacattgtctgctgggtttc

SEQ ID NO: 227403 - DNA, 22 bp, Mus musculus
tgttttgtgaccaattatatgg

SEQ ID NO: 227404 - DNA, 23 bp, Mus musculus
cttttcactgtgtttctctcatc

SEQ ID NO: 227405 - DNA, 18 bp, Mus musculus
caggttctcattgtctgt

SEQ ID NO: 227406 - DNA, 23 bp, Mus musculus
tcaaagtatttgttgagtatcca

SEQ ID NO: 227407 - DNA, 23 bp, Mus musculus
atacttctaggtaactcagtaaa

SEQ ID NO: 227408 - DNA, 19 bp, Mus musculus
taagatcaggataaagctt

SEQ ID NO: 227409 - DNA, 19 bp, Mus musculus
aatctaatcttgtttgttt

SEQ ID NO: 227410 - DNA, 22 bp, Mus musculus
tatttctgtctttaacatgtgt

SEQ ID NO: 227411 - DNA, 23 bp, Mus musculus
tccatggtgatctgatatgatgt

SEQ ID NO: 227412 - DNA, 21 bp, Mus musculus
tgttttgtgaccaattatgtg

SEQ ID NO: 227413 - DNA, 23 bp, Mus musculus
gatctctcactctgtgagtgttg

SEQ ID NO: 227414 - DNA, 20 bp, Mus musculus
tctggatgacataagaaagt

SEQ ID NO: 227415 - DNA, 21 bp, Mus musculus
atagttagcaagctagtgttc

SEQ ID NO: 227416 - DNA, 21 bp, Mus musculus
atgacttctgatttagttctt

SEQ ID NO: 227417 - DNA, 23 bp, Mus musculus
ttctaggttcttaccttgtgttc

SEQ ID NO: 227418 - DNA, 23 bp, Mus musculus
atctgtgtgtgcatgttcatgtg

SEQ ID NO: 227419 - DNA, 23 bp, Mus musculus
gattgagtccactgatctctctt

SEQ ID NO: 227420 - DNA, 23 bp, Mus musculus
gtatgtatgtatgtatgtatgtg

SEQ ID NO: 227421 - DNA, 23 bp, Mus musculus
tgtgtcacagtgtgaaactagag

SEQ ID NO: 227422 - DNA, 19 bp, Mus musculus
ataagattgagtatgaata

SEQ ID NO: 227423 - DNA, 23 bp, Mus musculus
tgagttagacaacctgtgtttgt

SEQ ID NO: 227424 - DNA, 22 bp, Mus musculus
aacactgacaagtgaagatgtg

SEQ ID NO: 227425 - DNA, 22 bp, Mus musculus
tgttttgtgacctattatatgg

SEQ ID NO: 227426 - DNA, 22 bp, Mus musculus
tttggctgccagtgtgtgtaca

SEQ ID NO: 227427 - DNA, 23 bp, Mus musculus
atatgtgtgtctgcatgagcata

SEQ ID NO: 227428 - DNA, 22 bp, Mus musculus
tgttttgtgaccaattatatgg

SEQ ID NO: 227429 - DNA, 23 bp, Mus musculus
gcatgtgtgtatatttatacatg

SEQ ID NO: 227430 - DNA, 22 bp, Mus musculus
tgcatataaaacatgtatatat

SEQ ID NO: 227431 - DNA, 23 bp, Mus musculus
gtttttacttgatttgtatagat

SEQ ID NO: 227432 - DNA, 22 bp, Mus musculus
tgttttgtgaccaattatatgg

SEQ ID NO: 227433 - DNA, 22 bp, Mus musculus
tgttttgtgaccaattatatgg

SEQ ID NO: 227434 - DNA, 22 bp, Mus musculus
tgttttgtgaccaattatatgg

SEQ ID NO: 227435 - DNA, 22 bp, Mus musculus
ttgagcagtcagacttggtgct

SEQ ID NO: 227436 - DNA, 22 bp, Mus musculus
tgttttgtgaccaattatatgg

SEQ ID NO: 227437 - DNA, 19 bp, Mus musculus
agagtttggctgggtatag

SEQ ID NO: 227438 - DNA, 20 bp, Mus musculus
ttcagattccatgtgtatgc

SEQ ID NO: 227439 - DNA, 22 bp, Mus musculus
ttagtccatggtgatctgatag

SEQ ID NO: 227440 - DNA, 23 bp, Mus musculus
tactgcatggtgatctgatagga

SEQ ID NO: 227441 - DNA, 22 bp, Mus musculus
tgttttgtgacctattatgtgg

SEQ ID NO: 227442 - DNA, 22 bp, Mus musculus
tgttttgtgaccaattatatgg

SEQ ID NO: 227443 - DNA, 19 bp, Mus musculus
actgtctgtgaattggatg

SEQ ID NO: 227444 - DNA, 23 bp, Mus musculus
atagggttatctgattctctgga

SEQ ID NO: 227445 - DNA, 23 bp, Mus musculus
tagtccatggtgatttgatagga

SEQ ID NO: 227446 - DNA, 22 bp, Mus musculus
tgttttgtgaccaattatatgg

SEQ ID NO: 227447 - DNA, 22 bp, Mus musculus
atacttgtgcatgtgcatatat

SEQ ID NO: 227448 - DNA, 23 bp, Mus musculus
taggctttggttgaaattgttgt

SEQ ID NO: 227449 - DNA, 23 bp, Mus musculus
tataagcaggataaccaaagctt

SEQ ID NO: 227450 - DNA, 19 bp, Mus musculus
tatgaatacaagtttctcc

SEQ ID NO: 227451 - DNA, 23 bp, Mus musculus
aaagattatttctaattgtgtgt

SEQ ID NO: 227452 - DNA, 21 bp, Mus musculus
aaagctctatagggagctgga

SEQ ID NO: 227453 - DNA, 23 bp, Mus musculus
atgtatgtatgtatgtgtgtgtg

SEQ ID NO: 227454 - DNA, 19 bp, Mus musculus
tagcagatgtacaagtgcc

SEQ ID NO: 227455 - DNA, 19 bp, Mus musculus
atgaatatacattggcatg

SEQ ID NO: 227456 - DNA, 18 bp, Mus musculus
tgataggcatagctctat

SEQ ID NO: 227457 - DNA, 23 bp, Mus musculus
tgtgcttgtatgttgtagtaatt

SEQ ID NO: 227458 - DNA, 23 bp, Mus musculus
tctctctaactgtaattctgagt

SEQ ID NO: 227459 - DNA, 20 bp, Mus musculus
atgtgagtgaagagacttcc

SEQ ID NO: 227460 - DNA, 23 bp, Mus musculus
ggcagagacaagtgagtgatctc

SEQ ID NO: 227461 - DNA, 23 bp, Mus musculus
agacatataatttagagctgtgt

SEQ ID NO: 227462 - DNA, 23 bp, Mus musculus
ctgagggtctctgtgtttgttct

SEQ ID NO: 227463 - DNA, 23 bp, Mus musculus
agtcaggctgtgcctctcttagt

SEQ ID NO: 227464 - DNA, 23 bp, Mus musculus
tgggtgtagacagacagacagag

SEQ ID NO: 227465 - DNA, 20 bp, Mus musculus
aggtacaaggttgatttctt

SEQ ID NO: 227466 - DNA, 23 bp, Mus musculus
gtctgtctgtctgtctgtgggca

SEQ ID NO: 227467 - DNA, 23 bp, Mus musculus
tctggtgagaggagtgtgaggtc

SEQ ID NO: 227468 - DNA, 18 bp, Mus musculus
atatgaaaaggagcggct

SEQ ID NO: 227469 - DNA, 23 bp, Mus musculus
tgactagtgtttaagttctgatg

SEQ ID NO: 227470 - DNA, 20 bp, Mus musculus
atgtatgtatgtatgtatgt

SEQ ID NO: 227471 - DNA, 22 bp, Mus musculus
tgttttgtgaccaattatatgg

SEQ ID NO: 227472 - DNA, 23 bp, Mus musculus
ttgcctgcctgcctgcctgcctg

SEQ ID NO: 227473 - DNA, 20 bp, Mus musculus
tgtggtttagtctctgggag

SEQ ID NO: 227474 - DNA, 23 bp, Mus musculus
gaggactgactgctcttccagag

SEQ ID NO: 227475 - DNA, 22 bp, Mus musculus
tttgggacttggttgtattgta

SEQ ID NO: 227476 - DNA, 20 bp, Mus musculus
atgtatgtatgtatgtatgt

SEQ ID NO: 227477 - DNA, 23 bp, Mus musculus
tgtctagattttagtgtgtgtgt

SEQ ID NO: 227478 - DNA, 22 bp, Mus musculus
tgttttgtgaccaattatatgg

SEQ ID NO: 227479 - DNA, 21 bp, Mus musculus
agtggctctagataccaggct

SEQ ID NO: 227480 - DNA, 23 bp, Mus musculus
atcagagttgctgttcaataggc

SEQ ID NO: 227481 - DNA, 23 bp, Mus musculus
tgcaagcctgtgtgtcagtatta

SEQ ID NO: 227482 - DNA, 23 bp, Mus musculus
tctctgggtccctgagttcctgg

SEQ ID NO: 227483 - DNA, 20 bp, Mus musculus
atctgtgtacatatatatgt

SEQ ID NO: 227484 - DNA, 23 bp, Mus musculus
aatgctctctctgtgtgtgcctg

SEQ ID NO: 227485 - DNA, 23 bp, Mus musculus
tgccagaagagagtgtcagaact

SEQ ID NO: 227486 - DNA, 22 bp, Mus musculus
tgttttgtgaccaattatatgg

SEQ ID NO: 227487 - DNA, 19 bp, Mus musculus
taaggaaaagtaattgttg

SEQ ID NO: 227488 - DNA, 22 bp, Mus musculus
aatgaaccagaaaatggtttga

SEQ ID NO: 227489 - DNA, 18 bp, Mus musculus
atatgtgtgtgtgtatat

SEQ ID NO: 227490 - DNA, 23 bp, Mus musculus
tatacaagcatgtatgtatatat

SEQ ID NO: 227491 - DNA, 23 bp, Mus musculus
ccgtcagtgaaatgagagagatc

SEQ ID NO: 227492 - DNA, 23 bp, Mus musculus
tggaaggatcacaagttccagtc

SEQ ID NO: 227493 - DNA, 18 bp, Mus musculus
ctgtcacgttctggtctc

SEQ ID NO: 227494 - DNA, 23 bp, Mus musculus
gccattctgtctgtgtgtgtccc

SEQ ID NO: 227495 - DNA, 18 bp, Mus musculus
ctgtcacgttctggtctc

SEQ ID NO: 227496 - DNA, 21 bp, Mus musculus
taacacagggtagttgggagg

SEQ ID NO: 227497 - DNA, 18 bp, Mus musculus
ggttctcagcagggctct

SEQ ID NO: 227498 - DNA, 21 bp, Mus musculus
taacacagggtagttgggagg

SEQ ID NO: 227499 - DNA, 22 bp, Mus musculus
tatgtctatatatttgtgtgtg

SEQ ID NO: 227500 - DNA, 23 bp, Mus musculus
taggctagagagattgttgagtg

SEQ ID NO: 227501 - DNA, 20 bp, Mus musculus
ttgatacttaaacaattctg

SEQ ID NO: 227502 - DNA, 20 bp, Mus musculus
tgctgactgctcttccagag

SEQ ID NO: 227503 - DNA, 23 bp, Mus musculus
tgtccttcacagaacagagtctc

SEQ ID NO: 227504 - DNA, 18 bp, Mus musculus
taaagccacatatgggaa

SEQ ID NO: 227505 - DNA, 23 bp, Mus musculus
taagagcactgactgctcttcca

SEQ ID NO: 227506 - DNA, 23 bp, Mus musculus
tatctctgtgaggtttacatcat

SEQ ID NO: 227507 - DNA, 18 bp, Mus musculus
tctgctcaacctggagca

SEQ ID NO: 227508 - DNA, 19 bp, Mus musculus
gtatgcacgcatgcatgta

SEQ ID NO: 227509 - DNA, 23 bp, Mus musculus
tatgcatgtatgtatgtatgtat

SEQ ID NO: 227510 - DNA, 23 bp, Mus musculus
ttatctttggaatactaactgtt

SEQ ID NO: 227511 - DNA, 23 bp, Mus musculus
taagagcactgactgctcttcca

SEQ ID NO: 227512 - DNA, 22 bp, Mus musculus
atagcaagttgcttggtttgtt

SEQ ID NO: 227513 - DNA, 19 bp, Mus musculus
agtcagtcagtctgtctgt

SEQ ID NO: 227514 - DNA, 23 bp, Mus musculus
tcagtcagtctgtctgttgtctg

SEQ ID NO: 227515 - DNA, 23 bp, Mus musculus
ggtcactctgactgcctctctta

SEQ ID NO: 227516 - DNA, 23 bp, Mus musculus
atctgtatatataattatgtata

SEQ ID NO: 227517 - DNA, 23 bp, Mus musculus
atatgtatatatgtgtgtgtgtg

SEQ ID NO: 227518 - DNA, 19 bp, Mus musculus
tgtgtatgcatgtaaaact

SEQ ID NO: 227519 - DNA, 21 bp, Mus musculus
caatgaccatctgtaatgaga

SEQ ID NO: 227520 - DNA, 23 bp, Mus musculus
tgcatgagactagtcattgagtt

SEQ ID NO: 227521 - DNA, 23 bp, Mus musculus
gaatgtagtgaagtgagttcagt

SEQ ID NO: 227522 - DNA, 21 bp, Mus musculus
tggctggctgagatgagagat

SEQ ID NO: 227523 - DNA, 19 bp, Mus musculus
tctccatttccatccctgt

SEQ ID NO: 227524 - DNA, 23 bp, Mus musculus
agagatgtgactgtggaatggca

SEQ ID NO: 227525 - DNA, 23 bp, Mus musculus
ttttctatggtttagatatcaga

SEQ ID NO: 227526 - DNA, 23 bp, Mus musculus
tgttttgtgaccaactatatggt

SEQ ID NO: 227527 - DNA, 21 bp, Mus musculus
tctgtgtgtgtatgaggggta

SEQ ID NO: 227528 - DNA, 22 bp, Mus musculus
tgttttgtgaccaattatatgg

SEQ ID NO: 227529 - DNA, 23 bp, Mus musculus
tcagactgggagtaatctgtgac

SEQ ID NO: 227530 - DNA, 22 bp, Mus musculus
tgttttgtgaccaattatatgg

SEQ ID NO: 227531 - DNA, 21 bp, Mus musculus
tggaagtcagactaaatgtat

SEQ ID NO: 227532 - DNA, 22 bp, Mus musculus
cagtcttaggccatggtggtct

SEQ ID NO: 227533 - DNA, 23 bp, Mus musculus
ttttgtgaccaactatatggtca

SEQ ID NO: 227534 - DNA, 23 bp, Mus musculus
gtctctgactctgtgtctgtgtc

SEQ ID NO: 227535 - DNA, 23 bp, Mus musculus
aaaagaccttatgaaatcacctt

SEQ ID NO: 227536 - DNA, 22 bp, Mus musculus
atggagtgtttgtttagagtgt

SEQ ID NO: 227537 - DNA, 23 bp, Mus musculus
gggtattttattagctggttcct

SEQ ID NO: 227538 - DNA, 23 bp, Mus musculus
agtgtgtgcatgtgcatgtgtgt

SEQ ID NO: 227539 - DNA, 22 bp, Mus musculus
acacttaacttaggtttccttt

SEQ ID NO: 227540 - DNA, 22 bp, Mus musculus
tgttttgtgaccaattatatgg

SEQ ID NO: 227541 - DNA, 23 bp, Mus musculus
tcactcagtcatctgtttctgtt

SEQ ID NO: 227542 - DNA, 23 bp, Mus musculus
tctctagttctcactctctctga

SEQ ID NO: 227543 - DNA, 23 bp, Mus musculus
atgagacacagacactgtacgtc

SEQ ID NO: 227544 - DNA, 23 bp, Mus musculus
ctgtctgtatgtctgtgtgtctt

SEQ ID NO: 227545 - DNA, 22 bp, Mus musculus
tgttttgtgaccaattatatgg

SEQ ID NO: 227546 - DNA, 23 bp, Mus musculus
tcactcagtcatctgtttctgtt

SEQ ID NO: 227547 - DNA, 22 bp, Mus musculus
tgacacacagtctctatcttct

SEQ ID NO: 227548 - DNA, 22 bp, Mus musculus
tgttttgtgaccaattatatgg

SEQ ID NO: 227549 - DNA, 23 bp, Mus musculus
tcactcagtcatctgtttctgtt

SEQ ID NO: 227550 - DNA, 23 bp, Mus musculus
tcactcagtcatctgtttctgtt

SEQ ID NO: 227551 - DNA, 22 bp, Mus musculus
actgtccctgtgactctgcctg

SEQ ID NO: 227552 - DNA, 23 bp, Mus musculus
tcactcagtcatctgtttctgtt

SEQ ID NO: 227553 - DNA, 19 bp, Mus musculus
catggtgatgtgatagggt

SEQ ID NO: 227554 - DNA, 20 bp, Mus musculus
tgttttgtgactgattatat

SEQ ID NO: 227555 - DNA, 22 bp, Mus musculus
acacttaacttaggtttccttt

SEQ ID NO: 227556 - DNA, 22 bp, Mus musculus
tgttttgtgaccaattatatgg

SEQ ID NO: 227557 - DNA, 22 bp, Mus musculus
tgttttgtgaccaattatatgg

SEQ ID NO: 227558 - DNA, 18 bp, Mus musculus
tgccttctttttccaagg

SEQ ID NO: 227559 - DNA, 22 bp, Mus musculus
tgttttgtgaccaattatatgg

SEQ ID NO: 227560 - DNA, 23 bp, Mus musculus
agtgtgtgcatgtgcatgtgtgt

SEQ ID NO: 227561 - DNA, 22 bp, Mus musculus
acacttaacttaggtttccttt

SEQ ID NO: 227562 - DNA, 23 bp, Mus musculus
tcactcagtcatctgtttctgtt

SEQ ID NO: 227563 - DNA, 22 bp, Mus musculus
tgttttgtgaccaattatatgg

SEQ ID NO: 227564 - DNA, 23 bp, Mus musculus
agtgtgtgcatgtgcatgtgtgt

SEQ ID NO: 227565 - DNA, 23 bp, Mus musculus
acacttaacctaggtttcctttg

SEQ ID NO: 227566 - DNA, 23 bp, Mus musculus
atttagtgcatttcttcttctga

SEQ ID NO: 227567 - DNA, 22 bp, Mus musculus
tgttttgtgaccaattatatgg

SEQ ID NO: 227568 - DNA, 23 bp, Mus musculus
tcactcagtcatctgtttctgtt

SEQ ID NO: 227569 - DNA, 23 bp, Mus musculus
ttgttgtctcagtgtctgtgtgg

SEQ ID NO: 227570 - DNA, 23 bp, Mus musculus
ttgttgtctcagtgtctgtgtgg

SEQ ID NO: 227571 - DNA, 22 bp, Mus musculus
tgttttgtgaccaattatatgg

SEQ ID NO: 227572 - DNA, 23 bp, Mus musculus
tcactcagtcatctgtttctgtt

SEQ ID NO: 227573 - DNA, 23 bp, Mus musculus
tctatctctctgacaaatccctc

SEQ ID NO: 227574 - DNA, 23 bp, Mus musculus
ttgttgtctcagtgtctgtgtgg

SEQ ID NO: 227575 - DNA, 23 bp, Mus musculus
ttgttgtctcagtgtctgtgtgg

SEQ ID NO: 227576 - DNA, 23 bp, Mus musculus
ttgttgtctcagtgtctgtgtgg

SEQ ID NO: 227577 - DNA, 23 bp, Mus musculus
ttgttgtctcagtgtctgtgtgg

SEQ ID NO: 227578 - DNA, 22 bp, Mus musculus
acacttaacttaggtttccttt

SEQ ID NO: 227579 - DNA, 23 bp, Mus musculus
agtgtgtgcatgtgcatgtgtgt

SEQ ID NO: 227580 - DNA, 22 bp, Mus musculus
acacttaacttaggtttccttt

SEQ ID NO: 227581 - DNA, 23 bp, Mus musculus
agtgtgtgcatgtgcatgtgtgt

SEQ ID NO: 227582 - DNA, 22 bp, Mus musculus
acacttaacttaggtttccttt

SEQ ID NO: 227583 - DNA, 23 bp, Mus musculus
agtgtgtgcatgtgcatgtgtgt

SEQ ID NO: 227584 - DNA, 23 bp, Mus musculus
tcactcagtcatctgtttctgtt

SEQ ID NO: 227585 - DNA, 23 bp, Mus musculus
tcactcagtcatctgtttctgtt

SEQ ID NO: 227586 - DNA, 22 bp, Mus musculus
tgttttgtgaccaattatatgg

SEQ ID NO: 227587 - DNA, 22 bp, Mus musculus
tgttttgtgaccaattatatgg

SEQ ID NO: 227588 - DNA, 23 bp, Mus musculus
tcactcagtcatctgtttctgtt

SEQ ID NO: 227589 - DNA, 22 bp, Mus musculus
tgttttgtgaccaattatatgg

SEQ ID NO: 227590 - DNA, 22 bp, Mus musculus
acacttaacttaggtttccttt

SEQ ID NO: 227591 - DNA, 19 bp, Mus musculus
aatgttataaaactatggt

SEQ ID NO: 227592 - DNA, 23 bp, Mus musculus
ttgggagaatttggatgtgtgtg

SEQ ID NO: 227593 - DNA, 22 bp, Mus musculus
tcattgtgcatacattttatgt

SEQ ID NO: 227594 - DNA, 22 bp, Mus musculus
ttttcctactgaagagatagaa

SEQ ID NO: 227595 - DNA, 23 bp, Mus musculus
tgtaggggacaggtttatttgag

SEQ ID NO: 227596 - DNA, 19 bp, Mus musculus
catggtgatgtgatagggt

SEQ ID NO: 227597 - DNA, 20 bp, Mus musculus
tgttttgtgactgattatat

SEQ ID NO: 227598 - DNA, 23 bp, Mus musculus
agcctagagtggaatgttacctg

SEQ ID NO: 227599 - DNA, 23 bp, Mus musculus
tgtgtgtgcatgtgcatgtgtgt

SEQ ID NO: 227600 - DNA, 22 bp, Mus musculus
tgttttgtgaccaattatatgg

SEQ ID NO: 227601 - DNA, 22 bp, Mus musculus
tgttttgtgaccaattatatgg

SEQ ID NO: 227602 - DNA, 19 bp, Mus musculus
catggtggtctgataggat

SEQ ID NO: 227603 - DNA, 22 bp, Mus musculus
tgttttgtgaccaattatatgg

SEQ ID NO: 227604 - DNA, 23 bp, Mus musculus
gtgtgtgcatgtgcatgtgtgtg

SEQ ID NO: 227605 - DNA, 22 bp, Mus musculus
tgttttgtgaccaattatatgg

SEQ ID NO: 227606 - DNA, 22 bp, Mus musculus
tgttttgtgaccaattatatgg

SEQ ID NO: 227607 - DNA, 23 bp, Mus musculus
tgtaggggacaggtttatttgag

SEQ ID NO: 227608 - DNA, 22 bp, Mus musculus
tgttttgtgaccaattatatgg

SEQ ID NO: 227609 - DNA, 23 bp, Mus musculus
agcttagagtggaatgttacctg

SEQ ID NO: 227610 - DNA, 18 bp, Mus musculus
atccatgttaatcaaagg

SEQ ID NO: 227611 - DNA, 23 bp, Mus musculus
agcctagagtggaaagttacctg

SEQ ID NO: 227612 - DNA, 23 bp, Mus musculus
tgaagttggtctagactttttgt

SEQ ID NO: 227613 - DNA, 23 bp, Mus musculus
gaaatctagaggaagaaaggtgt

SEQ ID NO: 227614 - DNA, 22 bp, Mus musculus
acacttaacttaggtttccttt

SEQ ID NO: 227615 - DNA, 23 bp, Mus musculus
caccatagagaagacagtgagga

SEQ ID NO: 227616 - DNA, 19 bp, Mus musculus
tgatgaaggatgaatagta

SEQ ID NO: 227617 - DNA, 19 bp, Mus musculus
catggtgatgtgatagggt

SEQ ID NO: 227618 - DNA, 20 bp, Mus musculus
tgttttgtgactgattatat

SEQ ID NO: 227619 - DNA, 22 bp, Mus musculus
tgttttgtgaccaattatatgg

SEQ ID NO: 227620 - DNA, 20 bp, Mus musculus
taggggacaggtttatttga

SEQ ID NO: 227621 - DNA, 23 bp, Mus musculus
tcactcagtcatctgtttctgtt

SEQ ID NO: 227622 - DNA, 22 bp, Mus musculus
tgttttgtgaccaattatatgg

SEQ ID NO: 227623 - DNA, 23 bp, Mus musculus
tcactcagtcatctgtttctgtt

SEQ ID NO: 227624 - DNA, 22 bp, Mus musculus
tgttttgtgaccaattatatgg

SEQ ID NO: 227625 - DNA, 22 bp, Mus musculus
tgttttgtgaccaattatatgg

SEQ ID NO: 227626 - DNA, 19 bp, Mus musculus
catggtgatgtgatagggt

SEQ ID NO: 227627 - DNA, 20 bp, Mus musculus
tgttttgtgactgattatat

SEQ ID NO: 227628 - DNA, 21 bp, Mus musculus
ttagatgttagtccttgcagg

SEQ ID NO: 227629 - DNA, 19 bp, Mus musculus
tctctcacttatgtgctag

SEQ ID NO: 227630 - DNA, 19 bp, Mus musculus
catggtgatgtgatagggt

SEQ ID NO: 227631 - DNA, 20 bp, Mus musculus
tgttttgtgactgattatat

SEQ ID NO: 227632 - DNA, 21 bp, Mus musculus
agattcacctttaaatttgac

SEQ ID NO: 227633 - DNA, 23 bp, Mus musculus
atttagtgcatttcttcttctga

SEQ ID NO: 227634 - DNA, 22 bp, Mus musculus
tgttttgtgaccaattatatgg

SEQ ID NO: 227635 - DNA, 23 bp, Mus musculus
gagagcagacagtcacttggtac

SEQ ID NO: 227636 - DNA, 23 bp, Mus musculus
tttagtgcatttcttcttctgat

SEQ ID NO: 227637 - DNA, 19 bp, Mus musculus
catggtggtctgataggat

SEQ ID NO: 227638 - DNA, 22 bp, Mus musculus
tgttttgtgaccaattatatgg

SEQ ID NO: 227639 - DNA, 23 bp, Mus musculus
tctctagttctcactctctctga

SEQ ID NO: 227640 - DNA, 21 bp, Mus musculus
tgagagtggagatagaggtca

SEQ ID NO: 227641 - DNA, 23 bp, Mus musculus
atttagtgcatttcttcttctga

SEQ ID NO: 227642 - DNA, 22 bp, Mus musculus
ttttcctactgaagagatagaa

SEQ ID NO: 227643 - DNA, 23 bp, Mus musculus
tgtaggggacaggtttatttgag

SEQ ID NO: 227644 - DNA, 23 bp, Mus musculus
tctctagttctcactctctctga

SEQ ID NO: 227645 - DNA, 22 bp, Mus musculus
ttttcctactgaagagatagaa

SEQ ID NO: 227646 - DNA, 23 bp, Mus musculus
tgtaggggacaggtttatttgag

SEQ ID NO: 227647 - DNA, 22 bp, Mus musculus
tgttttgtgaccaattatatgg

SEQ ID NO: 227648 - DNA, 20 bp, Mus musculus
tacagctaggaagaagctct

SEQ ID NO: 227649 - DNA, 23 bp, Mus musculus
tgtttctatactttacaaccaga

SEQ ID NO: 227650 - DNA, 23 bp, Mus musculus
atttagtgcatttcttcttctga

SEQ ID NO: 227651 - DNA, 20 bp, Mus musculus
tgcagtctatatggaattct

SEQ ID NO: 227652 - DNA, 23 bp, Mus musculus
tgctaccttgtctcagtgtctgt

SEQ ID NO: 227653 - DNA, 23 bp, Mus musculus
ttgggagaatttggatgtgtgtg

SEQ ID NO: 227654 - DNA, 23 bp, Mus musculus
acatttgagagtaaggagtgtgt

SEQ ID NO: 227655 - DNA, 23 bp, Mus musculus
ttgttgtctcagtgtctgtgtgg

SEQ ID NO: 227656 - DNA, 18 bp, Mus musculus
tgccttctttttccaagg

SEQ ID NO: 227657 - DNA, 22 bp, Mus musculus
aagccagcaaaaagctttttgt

SEQ ID NO: 227658 - DNA, 23 bp, Mus musculus
agtgtgtgcatgtgcatgtgtgt

SEQ ID NO: 227659 - DNA, 22 bp, Mus musculus
acacttaacttaggtttccttt

SEQ ID NO: 227660 - DNA, 19 bp, Mus musculus
tcacgtgcaataggcatga

SEQ ID NO: 227661 - DNA, 23 bp, Mus musculus
atttagtgcatttcttcttctga

SEQ ID NO: 227662 - DNA, 23 bp, Mus musculus
tcactcagtcatctgtttctgtt

SEQ ID NO: 227663 - DNA, 23 bp, Mus musculus
aatcagagcaattatgattgcac

SEQ ID NO: 227664 - DNA, 22 bp, Mus musculus
tagcagactggctgttctttat

SEQ ID NO: 227665 - DNA, 18 bp, Mus musculus
atcttggagaaagccatt

SEQ ID NO: 227666 - DNA, 18 bp, Mus musculus
gctcactctcaggctctg

SEQ ID NO: 227667 - DNA, 23 bp, Mus musculus
tccctgtcagtatcaaattgatc

SEQ ID NO: 227668 - DNA, 23 bp, Mus musculus
tctgcctggagtcagtgggtcag

SEQ ID NO: 227669 - DNA, 22 bp, Mus musculus
actgaactcattttgaacttct

SEQ ID NO: 227670 - DNA, 23 bp, Mus musculus
gccctctctctctcacttatgtg

SEQ ID NO: 227671 - DNA, 23 bp, Mus musculus
tcactcagtcatctgtttctgtt

SEQ ID NO: 227672 - DNA, 22 bp, Mus musculus
tgttttgtgaccaattatatgg

SEQ ID NO: 227673 - DNA, 23 bp, Mus musculus
tcactcagtcatctgtttctgtt

SEQ ID NO: 227674 - DNA, 21 bp, Mus musculus
atacacatacatatacatatg

SEQ ID NO: 227675 - DNA, 23 bp, Mus musculus
tcactcagtcatctgtttctgtt

SEQ ID NO: 227676 - DNA, 23 bp, Mus musculus
tcactcagtcatctgtttctgtt

SEQ ID NO: 227677 - DNA, 23 bp, Mus musculus
agtgtgtgcatgtgcatgtgtgt

SEQ ID NO: 227678 - DNA, 23 bp, Mus musculus
agccagcaaaaaaaagctttttg

SEQ ID NO: 227679 - DNA, 20 bp, Mus musculus
acttaactgaggtttccttt

SEQ ID NO: 227680 - DNA, 23 bp, Mus musculus
tcactcagtcatctgtttctgtt

SEQ ID NO: 227681 - DNA, 23 bp, Mus musculus
tctatctctctgacaaatccctc

SEQ ID NO: 227682 - DNA, 18 bp, Mus musculus
tgttgatacacacacaca

SEQ ID NO: 227683 - DNA, 21 bp, Mus musculus
tatgtatgtatgtatatgtat

SEQ ID NO: 227684 - DNA, 20 bp, Mus musculus
tcacagttagttttacagtc

SEQ ID NO: 227685 - DNA, 23 bp, Mus musculus
tactatgtatatatgtatatgta

SEQ ID NO: 227686 - DNA, 22 bp, Mus musculus
tgtacatgtgtatgtatgtata

SEQ ID NO: 227687 - DNA, 22 bp, Mus musculus
tgttttgtgaccaattatatgg

SEQ ID NO: 227688 - DNA, 22 bp, Mus musculus
tgttttgtgaccaattatatgg

SEQ ID NO: 227689 - DNA, 18 bp, Mus musculus
tcactggcacctgacctt

SEQ ID NO: 227690 - DNA, 23 bp, Mus musculus
tcactcagtcatctgtttctgtt

SEQ ID NO: 227691 - DNA, 22 bp, Mus musculus
tgttttgtgaccaattatatgg

SEQ ID NO: 227692 - DNA, 21 bp, Mus musculus
tgcctgcctggctgtgtgact

SEQ ID NO: 227693 - DNA, 23 bp, Mus musculus
ctgtctgtctgtctgtctgtgtg

SEQ ID NO: 227694 - DNA, 22 bp, Mus musculus
ttgagtgtgtgtctctctctgc

SEQ ID NO: 227695 - DNA, 23 bp, Mus musculus
tcactcagtcatctgtttctgtt

SEQ ID NO: 227696 - DNA, 22 bp, Mus musculus
tgttttgtgaccaattatatgg

SEQ ID NO: 227697 - DNA, 22 bp, Mus musculus
tgttttgtgaccaattatatgg

SEQ ID NO: 227698 - DNA, 23 bp, Mus musculus
tctctttgtctgtgtggaatggt

SEQ ID NO: 227699 - DNA, 19 bp, Mus musculus
catggtgatgtgatagggt

SEQ ID NO: 227700 - DNA, 20 bp, Mus musculus
tgttttgtgactgattatat

SEQ ID NO: 227701 - DNA, 23 bp, Mus musculus
agcctagagtggaatgttacctg

SEQ ID NO: 227702 - DNA, 23 bp, Mus musculus
atttagtgcatttcttcttctga

SEQ ID NO: 227703 - DNA, 22 bp, Mus musculus
tgttttgtgaccaattatatgg

SEQ ID NO: 227704 - DNA, 23 bp, Mus musculus
agcctagagtggaatgttacctg

SEQ ID NO: 227705 - DNA, 19 bp, Mus musculus
catggtgatgtgatagggt

SEQ ID NO: 227706 - DNA, 20 bp, Mus musculus
tgttttgtgactgattatat

SEQ ID NO: 227707 - DNA, 22 bp, Mus musculus
tgttttgtgaccaattatatgg

SEQ ID NO: 227708 - DNA, 22 bp, Mus musculus
tgttttgtgaccaattatatgg

SEQ ID NO: 227709 - DNA, 21 bp, Mus musculus
tacagcaggtaaaggatggag

SEQ ID NO: 227710 - DNA, 23 bp, Mus musculus
agtgtgtgcatgtgcatgtgtgt

SEQ ID NO: 227711 - DNA, 22 bp, Mus musculus
acacttaacttaggtttccttt

SEQ ID NO: 227712 - DNA, 22 bp, Mus musculus
tgttttgtgaccaattatatgg

SEQ ID NO: 227713 - DNA, 22 bp, Mus musculus
tgttttgtgaccaattatatgg

SEQ ID NO: 227714 - DNA, 23 bp, Mus musculus
tcactcagtcatctgtttctgtt

SEQ ID NO: 227715 - DNA, 23 bp, Mus musculus
tgtatgcatgtatatgtataggt

SEQ ID NO: 227716 - DNA, 20 bp, Mus musculus
tatgtatatgtatatgatgt

SEQ ID NO: 227717 - DNA, 22 bp, Mus musculus
tgttttgtgaccaattatatgg

SEQ ID NO: 227718 - DNA, 23 bp, Mus musculus
ctctctcacctatgtgcttggcc

SEQ ID NO: 227719 - DNA, 23 bp, Mus musculus
tcactcagtcatctgtttctgtt

SEQ ID NO: 227720 - DNA, 23 bp, Mus musculus
ttgttgtctcagtgtctgtgtgg

SEQ ID NO: 227721 - DNA, 23 bp, Mus musculus
ttgttgtctcagtgtctgtgtgg

SEQ ID NO: 227722 - DNA, 23 bp, Mus musculus
tcactcagtcatctgtttctgtt

SEQ ID NO: 227723 - DNA, 23 bp, Mus musculus
tcactcagtcatctgtttctgtt

SEQ ID NO: 227724 - DNA, 23 bp, Mus musculus
gcactgtctctttcacactgtgg

SEQ ID NO: 227725 - DNA, 19 bp, Mus musculus
catggtgatgtgatagggt

SEQ ID NO: 227726 - DNA, 18 bp, Mus musculus
tgttttgtgactgattat

SEQ ID NO: 227727 - DNA, 21 bp, Mus musculus
ttcaggacatagttcatggaa

SEQ ID NO: 227728 - DNA, 23 bp, Mus musculus
tgtgtgtgcatgtgcatgtgtgt

SEQ ID NO: 227729 - DNA, 23 bp, Mus musculus
atcaatgtggatgtcattgcatt

SEQ ID NO: 227730 - DNA, 21 bp, Mus musculus
agaagatctagtatgcagggt

SEQ ID NO: 227731 - DNA, 20 bp, Mus musculus
tgttttgtgaccaattatat

SEQ ID NO: 227732 - DNA, 23 bp, Mus musculus
agagcatctgcttcaggctctgt

SEQ ID NO: 227733 - DNA, 23 bp, Mus musculus
agacagctatactaggtttctgt

SEQ ID NO: 227734 - DNA, 20 bp, Mus musculus
tgaacttcctagtcagtgtt

SEQ ID NO: 227735 - DNA, 23 bp, Mus musculus
ataaagcttgctttagttggata

SEQ ID NO: 227736 - DNA, 22 bp, Mus musculus
ataaaagacaggagtgggagtc

SEQ ID NO: 227737 - DNA, 23 bp, Mus musculus
aatacatatgtatgtatgtgtgt

SEQ ID NO: 227738 - DNA, 19 bp, Mus musculus
tatgtacatgtaaagatat

SEQ ID NO: 227739 - DNA, 20 bp, Mus musculus
atatgtatgtatttatgtgt

SEQ ID NO: 227740 - DNA, 23 bp, Mus musculus
tatgtatatatgtatatgtgatt

SEQ ID NO: 227741 - DNA, 23 bp, Mus musculus
tatatgcatatgtatatataagt

SEQ ID NO: 227742 - DNA, 23 bp, Mus musculus
tgtatatgaatgtggatatgtat

SEQ ID NO: 227743 - DNA, 20 bp, Mus musculus
tgtatatatgtatatgtatg

SEQ ID NO: 227744 - DNA, 18 bp, Mus musculus
atatgtatgtatatatgt

SEQ ID NO: 227745 - DNA, 22 bp, Mus musculus
tgttttgtgaccaattatatgg

SEQ ID NO: 227746 - DNA, 22 bp, Mus musculus
tgttttgtgaccaattatatgg

SEQ ID NO: 227747 - DNA, 19 bp, Mus musculus
tatgcatgtctatatatat

SEQ ID NO: 227748 - DNA, 23 bp, Mus musculus
tttatatgtgtatgtgtatatat

SEQ ID NO: 227749 - DNA, 22 bp, Mus musculus
acacacacatgcatccatgagc

SEQ ID NO: 227750 - DNA, 23 bp, Mus musculus
gcatccctctgtgtgtgtgtgtg

SEQ ID NO: 227751 - DNA, 23 bp, Mus musculus
cactctcagccactgaatcaggt

SEQ ID NO: 227752 - DNA, 23 bp, Mus musculus
tgtctgtctgtctgtatgtgtac

SEQ ID NO: 227753 - DNA, 23 bp, Mus musculus
agtgtgtgcatgtgcatgtgtgt

SEQ ID NO: 227754 - DNA, 22 bp, Mus musculus
acacttaacttaggtttccttt

SEQ ID NO: 227755 - DNA, 23 bp, Mus musculus
acacacttaactgaggtttcctt

SEQ ID NO: 227756 - DNA, 19 bp, Mus musculus
agtgggagtttggagttag

SEQ ID NO: 227757 - DNA, 23 bp, Mus musculus
tctgcctgcctgcctgcctgcct

SEQ ID NO: 227758 - DNA, 22 bp, Mus musculus
actggtcactcactgtgtcttt

SEQ ID NO: 227759 - DNA, 22 bp, Mus musculus
tgttttgtgaccaattatatgg

SEQ ID NO: 227760 - DNA, 18 bp, Mus musculus
gtttccatgtgtgtgtgt

SEQ ID NO: 227761 - DNA, 23 bp, Mus musculus
tatatatgtattatagctatatg

SEQ ID NO: 227762 - DNA, 19 bp, Mus musculus
agtgaggtacaagtaggtc

SEQ ID NO: 227763 - DNA, 22 bp, Mus musculus
tgttttgtgaccaattatatgg

SEQ ID NO: 227764 - DNA, 19 bp, Mus musculus
tagatatctattgatatag

SEQ ID NO: 227765 - DNA, 22 bp, Mus musculus
tctatagatttagatatgtgtt

SEQ ID NO: 227766 - DNA, 22 bp, Mus musculus
tgttttgtgaccaattatatgg

SEQ ID NO: 227767 - DNA, 22 bp, Mus musculus
tgttttgtgaccaattatatgg

SEQ ID NO: 227768 - DNA, 22 bp, Mus musculus
tgttttgtgaccaattatatgg

SEQ ID NO: 227769 - DNA, 22 bp, Mus musculus
atatatgtatatatgtatatgt

SEQ ID NO: 227770 - DNA, 20 bp, Mus musculus
tgtgtgtgtatatatgtgtg

SEQ ID NO: 227771 - DNA, 23 bp, Mus musculus
tatatgtatatatgtgcgtgtgt

SEQ ID NO: 227772 - DNA, 22 bp, Mus musculus
atgtgtgcatatgttacacata

SEQ ID NO: 227773 - DNA, 23 bp, Mus musculus
atatgtatatatgtatatgtgac

SEQ ID NO: 227774 - DNA, 21 bp, Mus musculus
tatgcatatgaatatataagt

SEQ ID NO: 227775 - DNA, 20 bp, Mus musculus
tatatgtatatgaatgtgga

SEQ ID NO: 227776 - DNA, 20 bp, Mus musculus
tgtatatatgtatatgtatg

SEQ ID NO: 227777 - DNA, 23 bp, Mus musculus
atgtgtatatatatgtatgtatg

SEQ ID NO: 227778 - DNA, 22 bp, Mus musculus
tatctatatgtctatgtatgta

SEQ ID NO: 227779 - DNA, 18 bp, Mus musculus
atatgtatgtttatgtgt

SEQ ID NO: 227780 - DNA, 23 bp, Mus musculus
aagtgtatatatgtatttgtgtg

SEQ ID NO: 227781 - DNA, 21 bp, Mus musculus
atgtatgcatgtatatgtgta

SEQ ID NO: 227782 - DNA, 22 bp, Mus musculus
tgttttgtgaccaattatatgg

SEQ ID NO: 227783 - DNA, 22 bp, Mus musculus
tgttttgtgaccaattatatgg

SEQ ID NO: 227784 - DNA, 20 bp, Mus musculus
tatgcatgtctatatatatg

SEQ ID NO: 227785 - DNA, 23 bp, Mus musculus
tttatatgtgtatgtgtatatat

SEQ ID NO: 227786 - DNA, 22 bp, Mus musculus
ataaaagacaggagtgggagtc

SEQ ID NO: 227787 - DNA, 22 bp, Mus musculus
ataaaagacaggagtgggagtc

SEQ ID NO: 227788 - DNA, 23 bp, Mus musculus
ttgtgtgaatatgtatatgtctg

SEQ ID NO: 227789 - DNA, 23 bp, Mus musculus
atttgtttgtatgaagttattgg

SEQ ID NO: 227790 - DNA, 23 bp, Mus musculus
cttaacagattcctcttacctgg

SEQ ID NO: 227791 - DNA, 23 bp, Mus musculus
tggtgagagatgttacagaggtc

SEQ ID NO: 227792 - DNA, 23 bp, Mus musculus
ctgttgtgtgttagacaagtaca

SEQ ID NO: 227793 - DNA, 21 bp, Mus musculus
aagtgtactgtattgctttag

SEQ ID NO: 227794 - DNA, 23 bp, Mus musculus
tcatagcttaggattctctaagt

SEQ ID NO: 227795 - DNA, 23 bp, Mus musculus
tttggatttcttcaggatctgtg

SEQ ID NO: 227796 - DNA, 23 bp, Mus musculus
tcatttctgattttgttaattag

SEQ ID NO: 227797 - DNA, 23 bp, Mus musculus
tagtccatggtgatctgatagga

SEQ ID NO: 227798 - DNA, 22 bp, Mus musculus
tgttttgtgaccaattatatgg

SEQ ID NO: 227799 - DNA, 23 bp, Mus musculus
attttagctgtactagggtttct

SEQ ID NO: 227800 - DNA, 23 bp, Mus musculus
gtatgtgtgtgtgtatatgcaca

SEQ ID NO: 227801 - DNA, 22 bp, Mus musculus
tgttttgtgaccaattatatgg

SEQ ID NO: 227802 - DNA, 23 bp, Mus musculus
tgtaggggacaggtttatttgag

SEQ ID NO: 227803 - DNA, 18 bp, Mus musculus
gtatgtatgtatgtatgt

SEQ ID NO: 227804 - DNA, 23 bp, Mus musculus
ttgttgtctcagtgtctgtgtgg

SEQ ID NO: 227805 - DNA, 23 bp, Mus musculus
tcactcagtcatctgtttctgtt

SEQ ID NO: 227806 - DNA, 23 bp, Mus musculus
tcactcagtcatctgtttctgtt

SEQ ID NO: 227807 - DNA, 23 bp, Mus musculus
tcactcagtcatctgtttctgtt

SEQ ID NO: 227808 - DNA, 23 bp, Mus musculus
ttgttgtctcagtgtctgtgtgg

SEQ ID NO: 227809 - DNA, 23 bp, Mus musculus
ctttttgtctcagtgtctgtgtg

SEQ ID NO: 227810 - DNA, 21 bp, Mus musculus
tttcagcttcacaatgatggg

SEQ ID NO: 227811 - DNA, 23 bp, Mus musculus
agtgtgtgcatgtgcatgtgtgt

SEQ ID NO: 227812 - DNA, 22 bp, Mus musculus
acacttaacttaggtttccttt

SEQ ID NO: 227813 - DNA, 22 bp, Mus musculus
attgtgactgtttctctgtctc

SEQ ID NO: 227814 - DNA, 22 bp, Mus musculus
acacttaacttaggtttccttt

SEQ ID NO: 227815 - DNA, 23 bp, Mus musculus
agtgtgtgcatgtgcatgtgtgt

SEQ ID NO: 227816 - DNA, 22 bp, Mus musculus
acacttaacttaggtttccttt

SEQ ID NO: 227817 - DNA, 23 bp, Mus musculus
agtgtgtgcatgtgcatgtgtgt

SEQ ID NO: 227818 - DNA, 22 bp, Mus musculus
acacttaacttaggtttccttt

SEQ ID NO: 227819 - DNA, 19 bp, Mus musculus
tgctgcatacagtgctgga

SEQ ID NO: 227820 - DNA, 22 bp, Mus musculus
tgttttgtgaccaattatatgg

SEQ ID NO: 227821 - DNA, 22 bp, Mus musculus
tgttttgtgaccaattatatgg

SEQ ID NO: 227822 - DNA, 23 bp, Mus musculus
agtgtgtgcatgtgcatgtgtgt

SEQ ID NO: 227823 - DNA, 22 bp, Mus musculus
acacttaacttaggtttccttt

SEQ ID NO: 227824 - DNA, 23 bp, Mus musculus
tcactcagtcatctgtttctgtt

SEQ ID NO: 227825 - DNA, 22 bp, Mus musculus
acacttaacttaggtttccttt

SEQ ID NO: 227826 - DNA, 23 bp, Mus musculus
atttagtgcatttcttcttctga

SEQ ID NO: 227827 - DNA, 21 bp, Mus musculus
tgcggtctatatggaattctg

SEQ ID NO: 227828 - DNA, 23 bp, Mus musculus
tgctaccttgtctcagtgtctgt

SEQ ID NO: 227829 - DNA, 23 bp, Mus musculus
atttagtgcatttcttcttctga

SEQ ID NO: 227830 - DNA, 20 bp, Mus musculus
tgcagtctatatggaattct

SEQ ID NO: 227831 - DNA, 22 bp, Mus musculus
tgttttgtgaccaattatatgg

SEQ ID NO: 227832 - DNA, 20 bp, Mus musculus
tacagctaggaagaagctct

SEQ ID NO: 227833 - DNA, 23 bp, Mus musculus
tgtttctatactttacaaccaga

SEQ ID NO: 227834 - DNA, 22 bp, Mus musculus
tgttttgtgaccaattatatgg

SEQ ID NO: 227835 - DNA, 20 bp, Mus musculus
tacagctaggaagaagctct

SEQ ID NO: 227836 - DNA, 23 bp, Mus musculus
tgtttctatactttacaaccaga

SEQ ID NO: 227837 - DNA, 23 bp, Mus musculus
atttagtgcatttcttcttctga

SEQ ID NO: 227838 - DNA, 20 bp, Mus musculus
tgcagtctatatggaattct

SEQ ID NO: 227839 - DNA, 23 bp, Mus musculus
tgctaccttgtctcagtgtctgt

SEQ ID NO: 227840 - DNA, 23 bp, Mus musculus
tgtgtgtgcatgtgcatgtgtgt

SEQ ID NO: 227841 - DNA, 23 bp, Mus musculus
acacacttaactgaggtttcctt

SEQ ID NO: 227842 - DNA, 23 bp, Mus musculus
tcagatgtgtttttgttatcatg

SEQ ID NO: 227843 - DNA, 23 bp, Mus musculus
agtgtgtgcatgtgcatgtgtgt

SEQ ID NO: 227844 - DNA, 23 bp, Mus musculus
agtgtgtgcatgtgcatgtgtgt

SEQ ID NO: 227845 - DNA, 23 bp, Mus musculus
atggtgcagtgatagggtgtatg

SEQ ID NO: 227846 - DNA, 20 bp, Mus musculus
tgttttgtgactgattatat

SEQ ID NO: 227847 - DNA, 23 bp, Mus musculus
tcactcagtcatctgtttctgtt

SEQ ID NO: 227848 - DNA, 19 bp, Mus musculus
ctataggaccaggacagca

SEQ ID NO: 227849 - DNA, 19 bp, Mus musculus
gaagttcttgggctggaga

SEQ ID NO: 227850 - DNA, 22 bp, Mus musculus
cacacactttctctctctctga

SEQ ID NO: 227851 - DNA, 23 bp, Mus musculus
tgtgtgtgcatgtgcatgtgtgt

SEQ ID NO: 227852 - DNA, 22 bp, Mus musculus
tgttttgtgaccaattatatgg

SEQ ID NO: 227853 - DNA, 23 bp, Mus musculus
tcactcagtcatctgtttctgtt

SEQ ID NO: 227854 - DNA, 23 bp, Mus musculus
aagtgagtgtgtgctctctcggc

SEQ ID NO: 227855 - DNA, 23 bp, Mus musculus
agtgtgtgcatgtgcatgtgtgt

SEQ ID NO: 227856 - DNA, 23 bp, Mus musculus
aaggtgcctgcctgcctctaaac

SEQ ID NO: 227857 - DNA, 23 bp, Mus musculus
agtgtgtgcatgtgcatgtgtgt

SEQ ID NO: 227858 - DNA, 22 bp, Mus musculus
acacttaacttaggtttccttt

SEQ ID NO: 227859 - DNA, 23 bp, Mus musculus
agtgtgtgcatgtgcatgtgtgt

SEQ ID NO: 227860 - DNA, 23 bp, Mus musculus
tcactcagtcatctgtttctgtt

SEQ ID NO: 227861 - DNA, 23 bp, Mus musculus
ctctgggtctgtctgtgtggctc

SEQ ID NO: 227862 - DNA, 23 bp, Mus musculus
agtcctattgattggaaagtgta

SEQ ID NO: 227863 - DNA, 22 bp, Mus musculus
tcagagtggagagagtgtactt

SEQ ID NO: 227864 - DNA, 18 bp, Mus musculus
ctggttgtacacatttgt

SEQ ID NO: 227865 - DNA, 23 bp, Mus musculus
gtgtctgtatgtctctctctgtg

SEQ ID NO: 227866 - DNA, 23 bp, Mus musculus
tcactcagtcatctgtttctgtt

SEQ ID NO: 227867 - DNA, 23 bp, Mus musculus
ctttaactgtttggtagttgtct

SEQ ID NO: 227868 - DNA, 22 bp, Mus musculus
tgttttgtgaccaattatatgg

SEQ ID NO: 227869 - DNA, 22 bp, Mus musculus
acacttaacttaggtttccttt

SEQ ID NO: 227870 - DNA, 23 bp, Mus musculus
tcactcagtcatctgtttctgtt

SEQ ID NO: 227871 - DNA, 21 bp, Mus musculus
ttttcacattgtttctttatg

SEQ ID NO: 227872 - DNA, 23 bp, Mus musculus
tcactcagtcatctgtttctgtt

SEQ ID NO: 227873 - DNA, 23 bp, Mus musculus
tcactcagtcatctgtttctgtt

SEQ ID NO: 227874 - DNA, 23 bp, Mus musculus
tcactcagtcatctgtttctgtt

SEQ ID NO: 227875 - DNA, 18 bp, Mus musculus
tatgtatatatgtataga

SEQ ID NO: 227876 - DNA, 22 bp, Mus musculus
tatactacagcttgaggtcggg

SEQ ID NO: 227877 - DNA, 18 bp, Mus musculus
ctgaagttattttgttgt

SEQ ID NO: 227878 - DNA, 20 bp, Mus musculus
tttgaccttcctctcggtgt

SEQ ID NO: 227879 - DNA, 22 bp, Mus musculus
actaggaacagagtcagcaccc

SEQ ID NO: 227880 - DNA, 23 bp, Mus musculus
tgtcttcttctagggtctgtata

SEQ ID NO: 227881 - DNA, 23 bp, Mus musculus
tttctagtgagaaatctgatgta

SEQ ID NO: 227882 - DNA, 23 bp, Mus musculus
ttttgctctcatacgtgtttgag

SEQ ID NO: 227883 - DNA, 20 bp, Mus musculus
tacaggttctttcaccaaag

SEQ ID NO: 227884 - DNA, 23 bp, Mus musculus
gattctgagagaattctgagagg

SEQ ID NO: 227885 - DNA, 23 bp, Mus musculus
attcctgattcttgaagaagaga

SEQ ID NO: 227886 - DNA, 20 bp, Mus musculus
tgttttgtgactgattatat

SEQ ID NO: 227887 - DNA, 22 bp, Mus musculus
tgttttgtgaccaattatatgg

SEQ ID NO: 227888 - DNA, 22 bp, Mus musculus
tgttttgtgaccaattatatgg

SEQ ID NO: 227889 - DNA, 23 bp, Mus musculus
agacagctgagtgagcacactct

SEQ ID NO: 227890 - DNA, 23 bp, Mus musculus
tctctagttctcactctctctga

SEQ ID NO: 227891 - DNA, 23 bp, Mus musculus
ttcatgtggaaatcttaacaatg

SEQ ID NO: 227892 - DNA, 23 bp, Mus musculus
tttgagacatttttagctgattg

SEQ ID NO: 227893 - DNA, 19 bp, Mus musculus
catggtgatgtgatagggt

SEQ ID NO: 227894 - DNA, 20 bp, Mus musculus
tgttttgtgactgattatat

SEQ ID NO: 227895 - DNA, 22 bp, Mus musculus
atcagagcctgaatttgcccat

SEQ ID NO: 227896 - DNA, 23 bp, Mus musculus
atttagtgcatttcttcttctga

SEQ ID NO: 227897 - DNA, 21 bp, Mus musculus
tgagagtggagatagaggtca

SEQ ID NO: 227898 - DNA, 23 bp, Mus musculus
ttcatgtggaaatcttaacaatg

SEQ ID NO: 227899 - DNA, 23 bp, Mus musculus
ttgttgtctcagtgtctgtgtgg

SEQ ID NO: 227900 - DNA, 23 bp, Mus musculus
ttactgcttctagaattctctct

SEQ ID NO: 227901 - DNA, 21 bp, Mus musculus
tgagagtggagatagaggtca

SEQ ID NO: 227902 - DNA, 23 bp, Mus musculus
ttcatgtggaaatcttaacaatg

SEQ ID NO: 227903 - DNA, 23 bp, Mus musculus
tgagacattttcagctgattgag

SEQ ID NO: 227904 - DNA, 22 bp, Mus musculus
tgttttgtgaccaattatatgg

SEQ ID NO: 227905 - DNA, 22 bp, Mus musculus
tgttttgtgaccaattatatgg

SEQ ID NO: 227906 - DNA, 23 bp, Mus musculus
tcactcagtcatctgtttctgtt

SEQ ID NO: 227907 - DNA, 22 bp, Mus musculus
tgcatgtatgtatgtatgtatg

SEQ ID NO: 227908 - DNA, 23 bp, Mus musculus
ttgttgtctcagtgtctgtgtgg

SEQ ID NO: 227909 - DNA, 18 bp, Mus musculus
tgccttctttttccaagg

SEQ ID NO: 227910 - DNA, 21 bp, Mus musculus
tgagagtggagatagaggtca

SEQ ID NO: 227911 - DNA, 23 bp, Mus musculus
gtgtgtgcatgtgcatgtgtgtg

SEQ ID NO: 227912 - DNA, 23 bp, Mus musculus
acacttaacttaggtttcctttg

SEQ ID NO: 227913 - DNA, 23 bp, Mus musculus
tcactcagtcatctgtttctgtt

SEQ ID NO: 227914 - DNA, 22 bp, Mus musculus
tgttttgtgaccaattatatgg

SEQ ID NO: 227915 - DNA, 22 bp, Mus musculus
tgttttgtgaccaattatatgg

SEQ ID NO: 227916 - DNA, 23 bp, Mus musculus
tgctaccttgtctcagtgtctgt

SEQ ID NO: 227917 - DNA, 22 bp, Mus musculus
tgttttgtgaccaattatatgg

SEQ ID NO: 227918 - DNA, 23 bp, Mus musculus
tcactcagtcatctgtttctgtt

SEQ ID NO: 227919 - DNA, 23 bp, Mus musculus
tgtaggggacaggtttatttgag

SEQ ID NO: 227920 - DNA, 23 bp, Mus musculus
atttagtgcatttcttcttctga

SEQ ID NO: 227921 - DNA, 18 bp, Mus musculus
atgatggtctgataggat

SEQ ID NO: 227922 - DNA, 21 bp, Mus musculus
ttagatgttagtccttgcagg

SEQ ID NO: 227923 - DNA, 22 bp, Mus musculus
ttttcctactgaagagatagaa

SEQ ID NO: 227924 - DNA, 23 bp, Mus musculus
tgtaggggacaggtttatttgag

SEQ ID NO: 227925 - DNA, 22 bp, Mus musculus
tgttttgtgaccaattatatgg

SEQ ID NO: 227926 - DNA, 22 bp, Mus musculus
tgttttgtgaccaattatatgg

SEQ ID NO: 227927 - DNA, 23 bp, Mus musculus
tcactcagtcatctgtttctgtt

SEQ ID NO: 227928 - DNA, 21 bp, Mus musculus
tgagagtggagatagaggtca

SEQ ID NO: 227929 - DNA, 22 bp, Mus musculus
acacttaacttaggtttccttt

SEQ ID NO: 227930 - DNA, 23 bp, Mus musculus
acacttaacttaggtttcctttg

SEQ ID NO: 227931 - DNA, 18 bp, Mus musculus
tctatgatgtaagctgaa

SEQ ID NO: 227932 - DNA, 21 bp, Mus musculus
tagagtgatgtcacagagcac

SEQ ID NO: 227933 - DNA, 23 bp, Mus musculus
tacagctaggaagaagctctttg

SEQ ID NO: 227934 - DNA, 18 bp, Mus musculus
tgccttccttttccaagg

SEQ ID NO: 227935 - DNA, 22 bp, Mus musculus
tgttttgtgaccaattatatgg

SEQ ID NO: 227936 - DNA, 22 bp, Mus musculus
aaattagaagaagtatatagat

SEQ ID NO: 227937 - DNA, 22 bp, Mus musculus
tatgagcctcaagccacatcga

SEQ ID NO: 227938 - DNA, 23 bp, Mus musculus
tgtctgagtgcttttcttgagaa

SEQ ID NO: 227939 - DNA, 22 bp, Mus musculus
tgttttgtgaccaattatatgg

SEQ ID NO: 227940 - DNA, 20 bp, Mus musculus
gacaggatgcatgtgacaat

SEQ ID NO: 227941 - DNA, 23 bp, Mus musculus
agtggttctatgatgtaagttga

SEQ ID NO: 227942 - DNA, 23 bp, Mus musculus
atcaatgtggatgtcattgcatt

SEQ ID NO: 227943 - DNA, 22 bp, Mus musculus
tgttttgtgaccaattatatgg

SEQ ID NO: 227944 - DNA, 23 bp, Mus musculus
atttagtgcatttcttcttctga

SEQ ID NO: 227945 - DNA, 20 bp, Mus musculus
tgcagtctatatggaattct

SEQ ID NO: 227946 - DNA, 23 bp, Mus musculus
tgctaccttgtctcagtgtctgt

SEQ ID NO: 227947 - DNA, 22 bp, Mus musculus
tgttttgtgaccaattatatgg

SEQ ID NO: 227948 - DNA, 18 bp, Mus musculus
gtttccatgtgtgtgtgt

SEQ ID NO: 227949 - DNA, 23 bp, Mus musculus
aagtgagtgtgtgctctctcggc

SEQ ID NO: 227950 - DNA, 23 bp, Mus musculus
atgctaccttgtctcagtgtctg

SEQ ID NO: 227951 - DNA, 19 bp, Mus musculus
tcagttcaagatacaggca

SEQ ID NO: 227952 - DNA, 23 bp, Mus musculus
agtgtttctctgtgtttcttata

SEQ ID NO: 227953 - DNA, 22 bp, Mus musculus
tgttttgtgaccaattatatgg

SEQ ID NO: 227954 - DNA, 23 bp, Mus musculus
tcactcagtcatctgtttctgtt

SEQ ID NO: 227955 - DNA, 22 bp, Mus musculus
acacttaacttaggtttccttt

SEQ ID NO: 227956 - DNA, 23 bp, Mus musculus
tcactcagtcatctgtttctgtt

SEQ ID NO: 227957 - DNA, 23 bp, Mus musculus
ttttatccagattttcaagtttt

SEQ ID NO: 227958 - DNA, 23 bp, Mus musculus
tcactcagtcatctgtttctgtt

SEQ ID NO: 227959 - DNA, 23 bp, Mus musculus
tcactcagtcatctgtttctgtt

SEQ ID NO: 227960 - DNA, 23 bp, Mus musculus
tcactcagtcatctgtttctgtt

SEQ ID NO: 227961 - DNA, 23 bp, Mus musculus
agtgtgtgcatgtgcatgtgtgt

SEQ ID NO: 227962 - DNA, 22 bp, Mus musculus
acacttaacttaggtttccttt

SEQ ID NO: 227963 - DNA, 22 bp, Mus musculus
tgttttgtgaccaattatatgg

SEQ ID NO: 227964 - DNA, 21 bp, Mus musculus
tgttgcaatttatatttatgt

SEQ ID NO: 227965 - DNA, 23 bp, Mus musculus
ctttaactgtttggtagttgtct

SEQ ID NO: 227966 - DNA, 22 bp, Mus musculus
tgttttgtgaccaattatatgg

SEQ ID NO: 227967 - DNA, 23 bp, Mus musculus
ctttaactgtttggtagttgtct

SEQ ID NO: 227968 - DNA, 22 bp, Mus musculus
tgttttgtgaccaattatatgg

SEQ ID NO: 227969 - DNA, 23 bp, Mus musculus
tcactcagtcatctgtttctgtt

SEQ ID NO: 227970 - DNA, 23 bp, Mus musculus
tcactcagtcatctgtttctgtt

SEQ ID NO: 227971 - DNA, 23 bp, Mus musculus
agtgtgtgcatgtgcatgtgtgt

SEQ ID NO: 227972 - DNA, 23 bp, Mus musculus
tttactgtgaggaaatgtctctc

SEQ ID NO: 227973 - DNA, 23 bp, Mus musculus
tcactcagtcatctgtttctgtt

SEQ ID NO: 227974 - DNA, 22 bp, Mus musculus
acacttaacttaggtttccttt

SEQ ID NO: 227975 - DNA, 23 bp, Mus musculus
tcactcagtcatctgtttctgtt

SEQ ID NO: 227976 - DNA, 23 bp, Mus musculus
tcactcagtcatctgtttctgtt

SEQ ID NO: 227977 - DNA, 23 bp, Mus musculus
ttgttgtctcagtgtctgtgtgg

SEQ ID NO: 227978 - DNA, 23 bp, Mus musculus
ttgttgtctcagtgtctgtgtgg

SEQ ID NO: 227979 - DNA, 22 bp, Mus musculus
tgttttgtgaccaattatatgg

SEQ ID NO: 227980 - DNA, 23 bp, Mus musculus
agtgtgtgcatgtgcatgtgtgt

SEQ ID NO: 227981 - DNA, 23 bp, Mus musculus
acacttaacctaggtttcctttg

SEQ ID NO: 227982 - DNA, 22 bp, Mus musculus
tgttttgtgaccaattatatgg

SEQ ID NO: 227983 - DNA, 23 bp, Mus musculus
agtgtgtgcatgtgcatgtgtgt

SEQ ID NO: 227984 - DNA, 22 bp, Mus musculus
acacttaacttaggtttccttt

SEQ ID NO: 227985 - DNA, 22 bp, Mus musculus
tgttttgtgaccaattatatgg

SEQ ID NO: 227986 - DNA, 22 bp, Mus musculus
tgttttgtgaccaattatatgg

SEQ ID NO: 227987 - DNA, 23 bp, Mus musculus
tcactcagtcatctgtttctgtt

SEQ ID NO: 227988 - DNA, 22 bp, Mus musculus
acacttaacttaggtttccttt

SEQ ID NO: 227989 - DNA, 23 bp, Mus musculus
tcactcagtcatctgtttctgtt

SEQ ID NO: 227990 - DNA, 22 bp, Mus musculus
tgttttgtgaccaattatatgg

SEQ ID NO: 227991 - DNA, 23 bp, Mus musculus
agtgtgtgcatgtgcatgtgtgt

SEQ ID NO: 227992 - DNA, 22 bp, Mus musculus
acacttaacttaggtttccttt

SEQ ID NO: 227993 - DNA, 23 bp, Mus musculus
agtgtgtgcatgtgcatgtgtgt

SEQ ID NO: 227994 - DNA, 23 bp, Mus musculus
tcactcagtcatctgtttctgtt

SEQ ID NO: 227995 - DNA, 23 bp, Mus musculus
agtgtgtgcatgtgcatgtgtgt

SEQ ID NO: 227996 - DNA, 22 bp, Mus musculus
acacttaacttaggtttccttt

SEQ ID NO: 227997 - DNA, 22 bp, Mus musculus
tgttttgtgaccaattatatgg

SEQ ID NO: 227998 - DNA, 20 bp, Mus musculus
ttcagcttcacaatgatggg

SEQ ID NO: 227999 - DNA, 23 bp, Mus musculus
tcactcagtcatctgtttctgtt

SEQ ID NO: 228000 - DNA, 23 bp, Mus musculus
tcactcagtcatctgtttctgtt

SEQ ID NO: 228001 - DNA, 23 bp, Mus musculus
ttgttgtctcagtgtctgtgtgg

SEQ ID NO: 228002 - DNA, 23 bp, Mus musculus
agtgtgtgcatgtgcatgtgtgt

SEQ ID NO: 228003 - DNA, 22 bp, Mus musculus
acacttaacttaggtttccttt

SEQ ID NO: 228004 - DNA, 22 bp, Mus musculus
cagtcttaggccatggtggtct

SEQ ID NO: 228005 - DNA, 21 bp, Mus musculus
tgttgcaatttatatttatgt

SEQ ID NO: 228006 - DNA, 18 bp, Drosophila melanogaster
gtatatgtatgtggtttg

SEQ ID NO: 228007 - DNA, 23 bp, Drosophila melanogaster
gtgcgtgagtgtctgtgtgggtc

SEQ ID NO: 228008 - DNA, 19 bp, Drosophila melanogaster
tttgcacatgtttcgcatt

SEQ ID NO: 228009 - DNA, 23 bp, Drosophila melanogaster
tgtgtctggctgtctggctgtta

SEQ ID NO: 228010 - DNA, 21 bp, Drosophila melanogaster
tctcatcatcggtaaggcaag

SEQ ID NO: 228011 - DNA, 23 bp, Drosophila melanogaster
gtgagtggttgtcttgtgtattt

SEQ ID NO: 228012 - DNA, 23 bp, Drosophila melanogaster
tcgagacacacaaaaggctcctc

SEQ ID NO: 228013 - DNA, 23 bp, Drosophila melanogaster
tgtgtctgtgtgccggtgtgtat

SEQ ID NO: 228014 - DNA, 22 bp, Drosophila melanogaster
tcggtgggtgtgtcctcgctca

SEQ ID NO: 228015 - DNA, 23 bp, Drosophila melanogaster
gtgtgcgtgtgagagagtgagtg

SEQ ID NO: 228016 - DNA, 23 bp, Drosophila melanogaster
tgagaacttttgataaatgcaga

SEQ ID NO: 228017 - DNA, 23 bp, Drosophila melanogaster
agtgtctgtctatgtgtctgtgc

SEQ ID NO: 228018 - DNA, 19 bp, Drosophila melanogaster
ctggctgactgtgtgtgtg

SEQ ID NO: 228019 - DNA, 18 bp, Drosophila melanogaster
ttcatatatatacacatt

SEQ ID NO: 228020 - DNA, 21 bp, Drosophila melanogaster
tgtgtacattacatatgtatg

SEQ ID NO: 228021 - DNA, 21 bp, Drosophila melanogaster
atgtatgtatgtatgtatgtg

SEQ ID NO: 228022 - DNA, 21 bp, Drosophila melanogaster
ttgtatgtatgtatgtttgac

SEQ ID NO: 228023 - DNA, 23 bp, Drosophila melanogaster
gagacccatttttgtggagcatg

SEQ ID NO: 228024 - DNA, 23 bp, Drosophila melanogaster
tggggctgtcagtggctctcaaa

SEQ ID NO: 228025 - DNA, 23 bp, Drosophila melanogaster
aaactgcattcgtattgtgtatc

SEQ ID NO: 228026 - DNA, 23 bp, Drosophila melanogaster
tctgtgtgtgtatctgtctctgc

SEQ ID NO: 228027 - DNA, 21 bp, Drosophila melanogaster
aggatgtacatatgtatgtat

SEQ ID NO: 228028 - DNA, 23 bp, Drosophila melanogaster
gtgagaactgtctgtggatatgt

SEQ ID NO: 228029 - DNA, 23 bp, Drosophila melanogaster
agtcagtcagtgagtctgcttag

SEQ ID NO: 228030 - DNA, 23 bp, Drosophila melanogaster
tagcttgtttcctattggatgct

SEQ ID NO: 228031 - DNA, 20 bp, Drosophila melanogaster
gtacaaatcaggctcaggct

SEQ ID NO: 228032 - DNA, 23 bp, Drosophila melanogaster
aacaactgcatctgcaactgcaa

SEQ ID NO: 228033 - DNA, 23 bp, Drosophila melanogaster
gcctgcctggctgactggctggc

SEQ ID NO: 228034 - DNA, 23 bp, Drosophila melanogaster
tctctcattctgtgcgtgtgtgc

SEQ ID NO: 228035 - DNA, 23 bp, Drosophila melanogaster
tatatgtatatgcatatgcgtgt

SEQ ID NO: 228036 - DNA, 23 bp, Drosophila melanogaster
aactggatgtgattggaaaattt

SEQ ID NO: 228037 - DNA, 19 bp, Drosophila melanogaster
aatctgcttagctaatgga

SEQ ID NO: 228038 - DNA, 22 bp, Drosophila melanogaster
aagtatgtatgtatgtatgtgg

SEQ ID NO: 228039 - DNA, 20 bp, Drosophila melanogaster
attgttattgtatcacctga

SEQ ID NO: 228040 - DNA, 21 bp, Drosophila melanogaster
aatacaatcgatttgaaatct

SEQ ID NO: 228041 - DNA, 21 bp, Drosophila melanogaster
ttgagtgcagacagtggccag

SEQ ID NO: 228042 - DNA, 23 bp, Drosophila melanogaster
tgcctgtgtgtctgtatgtgtgt

SEQ ID NO: 228043 - DNA, 23 bp, Drosophila melanogaster
tcaggtacctgaagtagcgcgcg

SEQ ID NO: 228044 - DNA, 23 bp, Drosophila melanogaster
attgtacttcatcaggtgctctg

SEQ ID NO: 228045 - DNA, 23 bp, Drosophila melanogaster
cacatgttgaagtacactcaata

SEQ ID NO: 228046 - DNA, 18 bp, Drosophila melanogaster
ttcaaaagttatcgacgt

SEQ ID NO: 228047 - DNA, 23 bp, Drosophila melanogaster
tgtgcctgtgtgcgtgcctcgct

SEQ ID NO: 228048 - DNA, 23 bp, Drosophila melanogaster
tttgccacgaattcggattcatc

SEQ ID NO: 228049 - DNA, 20 bp, Drosophila melanogaster
gcttgtttcaatttcatctg

SEQ ID NO: 228050 - DNA, 23 bp, Drosophila melanogaster
catatatatgtatgcatgtatgt

SEQ ID NO: 228051 - DNA, 19 bp, Drosophila melanogaster
tcgcatcctgcatctgagt

SEQ ID NO: 228052 - DNA, 23 bp, Drosophila melanogaster
tgtgtgtgtcagtgtgtgtgtgt

SEQ ID NO: 228053 - DNA, 23 bp, Drosophila melanogaster
actgataagttcatcaagtgctt

SEQ ID NO: 228054 - DNA, 23 bp, Drosophila melanogaster
aaatcctaggaattcatagcaaa

SEQ ID NO: 228055 - DNA, 18 bp, Drosophila melanogaster
acttaggttcttttttta

SEQ ID NO: 228056 - DNA, 22 bp, Drosophila melanogaster
atttctgccgctcatatgtacg

SEQ ID NO: 228057 - DNA, 23 bp, Drosophila melanogaster
gtgtgtgtgtgtgtgtgcgagag

SEQ ID NO: 228058 - DNA, 21 bp, Drosophila melanogaster
tagagctcgagtagcacatca

SEQ ID NO: 228059 - DNA, 23 bp, Drosophila melanogaster
agctgcatctgcatatggatctg

SEQ ID NO: 228060 - DNA, 21 bp, Drosophila melanogaster
tgagagtatctgtgtgtgcgt

SEQ ID NO: 228061 - DNA, 21 bp, Drosophila melanogaster
atactcataatacttaagtca

SEQ ID NO: 228062 - DNA, 19 bp, Drosophila melanogaster
atatgacccgtttttttga

SEQ ID NO: 228063 - DNA, 23 bp, Drosophila melanogaster
tctctgctactgactgtgtgtgt

SEQ ID NO: 228064 - DNA, 20 bp, Drosophila melanogaster
ttgtctggatggaactcttt

SEQ ID NO: 228065 - DNA, 23 bp, Drosophila melanogaster
tatgtatgtcgaagtgtttcaaa

SEQ ID NO: 228066 - DNA, 23 bp, Drosophila melanogaster
tctatgtatatgtatatgtatat

SEQ ID NO: 228067 - DNA, 23 bp, Drosophila melanogaster
tacttagtccttttcaattccct

SEQ ID NO: 228068 - DNA, 22 bp, Drosophila melanogaster
atgtctgcttgtcaaatggttg

SEQ ID NO: 228069 - DNA, 23 bp, Drosophila melanogaster
tatatgtatgtatagaagtgtgt

SEQ ID NO: 228070 - DNA, 23 bp, Drosophila melanogaster
tgactgggtcagtcagtccgtga

SEQ ID NO: 228071 - DNA, 21 bp, Drosophila melanogaster
tcaggctgcctgcctgttagc

SEQ ID NO: 228072 - DNA, 23 bp, Drosophila melanogaster
gtatgtatgtatgtatggatgtg

SEQ ID NO: 228073 - DNA, 23 bp, Drosophila melanogaster
aacagagctggccactgactgac

SEQ ID NO: 228074 - DNA, 23 bp, Drosophila melanogaster
tggagtggaaagttgtttgcagc

SEQ ID NO: 228075 - DNA, 21 bp, Drosophila melanogaster
atgagattgccattgcagtgt

SEQ ID NO: 228076 - DNA, 22 bp, Drosophila melanogaster
ctcactcgcactctgtgtgtat

SEQ ID NO: 228077 - DNA, 23 bp, Drosophila melanogaster
tctgtccgaccattagtattgat

SEQ ID NO: 228078 - DNA, 23 bp, Drosophila melanogaster
tctttatttataagtaagctgca

SEQ ID NO: 228079 - DNA, 23 bp, Drosophila melanogaster
aaaagtgaatccctattttatgt

SEQ ID NO: 228080 - DNA, 21 bp, Drosophila melanogaster
tatctgcgtgtgtgcgcgctt

SEQ ID NO: 228081 - DNA, 20 bp, Drosophila melanogaster
attccatttgtttttttttt

SEQ ID NO: 228082 - DNA, 18 bp, Drosophila melanogaster
ttgatcattaccagctca

SEQ ID NO: 228083 - DNA, 22 bp, Drosophila melanogaster
tgacgttgtacgttgattagat

SEQ ID NO: 228084 - DNA, 23 bp, Drosophila melanogaster
ctggcgagcttgttagatgcatg

SEQ ID NO: 228085 - DNA, 23 bp, Drosophila melanogaster
aaatttgtgtatttcttgttgag

SEQ ID NO: 228086 - DNA, 23 bp, Drosophila melanogaster
tctggctctgactctggctctcc

SEQ ID NO: 228087 - DNA, 21 bp, Drosophila melanogaster
cctgagcttgagtctcggcca

SEQ ID NO: 228088 - DNA, 21 bp, Drosophila melanogaster
tgtgattgtatttatatatgt

SEQ ID NO: 228089 - DNA, 20 bp, Drosophila melanogaster
taattgactgatgaattgac

SEQ ID NO: 228090 - DNA, 23 bp, Drosophila melanogaster
tgtgcatctgcatctgcattttt

SEQ ID NO: 228091 - DNA, 23 bp, Drosophila melanogaster
gtaaggtagtacattgtgctgag

SEQ ID NO: 228092 - DNA, 23 bp, Drosophila melanogaster
ctctgtcctaagtgtgtgtgtgt

SEQ ID NO: 228093 - DNA, 23 bp, Drosophila melanogaster
ttgtggaatagctagtgatattg

SEQ ID NO: 228094 - DNA, 23 bp, Drosophila melanogaster
gttactgcagcttgaactggatg

SEQ ID NO: 228095 - DNA, 20 bp, Drosophila melanogaster
gcagagagcagacaagaggg

SEQ ID NO: 228096 - DNA, 23 bp, Drosophila melanogaster
ttctttggtattctagctgtaga

SEQ ID NO: 228097 - DNA, 21 bp, Drosophila melanogaster
taaagcttttataccaaagct

SEQ ID NO: 228098 - DNA, 22 bp, Drosophila melanogaster
tcaggtacttagtgactctcaa

SEQ ID NO: 228099 - DNA, 23 bp, Drosophila melanogaster
gggggtcactctgtgcctgtgct

SEQ ID NO: 228100 - DNA, 23 bp, Drosophila melanogaster
ataaagctagattaccaaagcat

SEQ ID NO: 228101 - DNA, 23 bp, Drosophila melanogaster
tctttggtgattttagctgtatg

SEQ ID NO: 228102 - DNA, 20 bp, Drosophila melanogaster
tagagctttattaccaaaaa

SEQ ID NO: 228103 - DNA, 22 bp, Drosophila melanogaster
acgctctctctctctctctcag

SEQ ID NO: 228104 - DNA, 23 bp, Drosophila melanogaster
aagctgcaactgcaactggcgct

SEQ ID NO: 228105 - DNA, 18 bp, Drosophila melanogaster
agcaggcgaagaaggagc

SEQ ID NO: 228106 - DNA, 19 bp, Drosophila melanogaster
tgagcgaaatgagttgttt

SEQ ID NO: 228107 - DNA, 23 bp, Drosophila melanogaster
tgtccgtccgtccgtccgtcagt

SEQ ID NO: 228108 - DNA, 19 bp, Drosophila melanogaster
tgggtgggcattagctcgc

SEQ ID NO: 228109 - DNA, 20 bp, Drosophila melanogaster
cagcagaagatggagaggag

SEQ ID NO: 228110 - DNA, 22 bp, Drosophila melanogaster
acttatgtgcatatttatttgt

SEQ ID NO: 228111 - DNA, 23 bp, Drosophila melanogaster
gtgtgtgtgagagcgtttgaaaa

SEQ ID NO: 228112 - DNA, 23 bp, Drosophila melanogaster
taaggcacgcggtgaatgccaag

SEQ ID NO: 228113 - DNA, 21 bp, Drosophila melanogaster
agggtctgaaattttgcacac

SEQ ID NO: 228114 - DNA, 23 bp, Drosophila melanogaster
aatgtgttgaaaatcgtttgcac

SEQ ID NO: 228115 - DNA, 19 bp, Drosophila melanogaster
actgtgagcaaaacacgtc

SEQ ID NO: 228116 - DNA, 23 bp, Drosophila melanogaster
gtacacaacagaatttcttgaag

SEQ ID NO: 228117 - DNA, 23 bp, Drosophila melanogaster
tgtgtgtgtgatttcccagtttg

SEQ ID NO: 228118 - DNA, 20 bp, Drosophila melanogaster
aatggctcacacacactcac

SEQ ID NO: 228119 - DNA, 22 bp, Drosophila melanogaster
tgtgtgtgtctatgtcagtgtg

SEQ ID NO: 228120 - DNA, 23 bp, Drosophila melanogaster
gtcagtcagtcagtcagtcatct

SEQ ID NO: 228121 - DNA, 22 bp, Drosophila melanogaster
aacccgtaaatccgaacttgtg

SEQ ID NO: 228122 - DNA, 21 bp, Drosophila melanogaster
ttatgggagtctgtcaatgca

SEQ ID NO: 228123 - DNA, 22 bp, Drosophila melanogaster
tgaggtagtaggttgtatagta

SEQ ID NO: 228124 - DNA, 23 bp, Drosophila melanogaster
tacaatgtgctagctttctttgc

SEQ ID NO: 228125 - DNA, 23 bp, Drosophila melanogaster
tccctgagaccctaacttgtgac

SEQ ID NO: 228126 - DNA, 20 bp, Drosophila melanogaster
tggcagagtgggaaagttgt

SEQ ID NO: 228127 - DNA, 23 bp, Drosophila melanogaster
tgtatatcagttggatttagttg

SEQ ID NO: 228128 - DNA, 21 bp, Drosophila melanogaster
ctgactgatgtctgtgtgttc

SEQ ID NO: 228129 - DNA, 19 bp, Drosophila melanogaster
gtgtgtgagtgagagcgag

SEQ ID NO: 228130 - DNA, 23 bp, Drosophila melanogaster
tccgtctgtctgtctgtgcgtgc

SEQ ID NO: 228131 - DNA, 23 bp, Drosophila melanogaster
gtgactgtgcgtctgtgtgtgtg

SEQ ID NO: 228132 - DNA, 22 bp, Drosophila melanogaster
agacaaagcaatcagtcagtca

SEQ ID NO: 228133 - DNA, 23 bp, Drosophila melanogaster
tgtattagctttacaatagcttt

SEQ ID NO: 228134 - DNA, 23 bp, Drosophila melanogaster
attcagttagttattatgagcgt

SEQ ID NO: 228135 - DNA, 20 bp, Drosophila melanogaster
acacacagacgaatggacat

SEQ ID NO: 228136 - DNA, 23 bp, Drosophila melanogaster
gagagtgtgtgtgtgagtgtggc

SEQ ID NO: 228137 - DNA, 23 bp, Drosophila melanogaster
gcaactgcaactgcaacggcaac

SEQ ID NO: 228138 - DNA, 23 bp, Drosophila melanogaster
tggctgtctggctggctgactcg

SEQ ID NO: 228139 - DNA, 23 bp, Drosophila melanogaster
taaatttatgtacacggcatacg

SEQ ID NO: 228140 - DNA, 23 bp, Drosophila melanogaster
tggcaggctgtgtacttcgctgt

SEQ ID NO: 228141 - DNA, 22 bp, Drosophila melanogaster
tggaatgtaaagaagtatggag

SEQ ID NO: 228142 - DNA, 23 bp, Drosophila melanogaster
gcaacactgtgtgtagctggttg

SEQ ID NO: 228143 - DNA, 22 bp, Drosophila melanogaster
ttggtccccttcaaccagctgt

SEQ ID NO: 228144 - DNA, 20 bp, Drosophila melanogaster
aagaagaataaccatgaatc

SEQ ID NO: 228145 - DNA, 20 bp, Drosophila melanogaster
atgcaagttgaatgattttt

SEQ ID NO: 228146 - DNA, 21 bp, Drosophila melanogaster
ttatccttctaaatggtttga

SEQ ID NO: 228147 - DNA, 19 bp, Drosophila melanogaster
tgtggaatgttgtgtgctg

SEQ ID NO: 228148 - DNA, 23 bp, Drosophila melanogaster
tggcactgcgataactcacccga

SEQ ID NO: 228149 - DNA, 18 bp, Drosophila melanogaster
actaagttttggaagcgc

SEQ ID NO: 228150 - DNA, 23 bp, Drosophila melanogaster
atacctacaggaacatatttgta

SEQ ID NO: 228151 - DNA, 21 bp, Drosophila melanogaster
aataattaggttggacttgtt

SEQ ID NO: 228152 - DNA, 23 bp, Drosophila melanogaster
attttatgtttatgtacatgtat

SEQ ID NO: 228153 - DNA, 22 bp, Drosophila melanogaster
ctgtccgtctgtctgtccgtat

SEQ ID NO: 228154 - DNA, 23 bp, Drosophila melanogaster
tattcttgatcaggagcaacagt

SEQ ID NO: 228155 - DNA, 19 bp, Drosophila melanogaster
tgaccgtctgtccgactgt

SEQ ID NO: 228156 - DNA, 23 bp, Drosophila melanogaster
tacaatgtatatttatataagtg

SEQ ID NO: 228157 - DNA, 23 bp, Drosophila melanogaster
tcactctcgctctcactcgctct

SEQ ID NO: 228158 - DNA, 22 bp, Drosophila melanogaster
agcaactgcaagtgcaagtaca

SEQ ID NO: 228159 - DNA, 23 bp, Drosophila melanogaster
gctggctgactgactggctgact

SEQ ID NO: 228160 - DNA, 23 bp, Drosophila melanogaster
tctgtgtgtctgtctgtctgtct

SEQ ID NO: 228161 - DNA, 20 bp, Drosophila melanogaster
gagagcaaagttgactgcgc

SEQ ID NO: 228162 - DNA, 23 bp, Drosophila melanogaster
ttgcaacactctctgtgtgtgtg

SEQ ID NO: 228163 - DNA, 23 bp, Drosophila melanogaster
ttcaaagtggttgtgaaatgttt

SEQ ID NO: 228164 - DNA, 23 bp, Drosophila melanogaster
tatcacagccagctttgaggagc

SEQ ID NO: 228165 - DNA, 23 bp, Drosophila melanogaster
tcaaagtggttgtgaaatgcatt

SEQ ID NO: 228166 - DNA, 23 bp, Drosophila melanogaster
tatcacagccagctttgatgagc

SEQ ID NO: 228167 - DNA, 23 bp, Drosophila melanogaster
cctcatcaagtggttgtgatatg

SEQ ID NO: 228168 - DNA, 23 bp, Drosophila melanogaster
tatcacagccagctttgatgagc

SEQ ID NO: 228169 - DNA, 23 bp, Drosophila melanogaster
aagttgatgcatatgatttccat

SEQ ID NO: 228170 - DNA, 23 bp, Drosophila melanogaster
tggcaacgtgtgttctgtgtatc

SEQ ID NO: 228171 - DNA, 23 bp, Drosophila melanogaster
tgactggatgattgagtgagtga

SEQ ID NO: 228172 - DNA, 22 bp, Drosophila melanogaster
gtgactgactgattgagtgact

SEQ ID NO: 228173 - DNA, 23 bp, Drosophila melanogaster
ctgactgactggctggctggctg

SEQ ID NO: 228174 - DNA, 23 bp, Drosophila melanogaster
agaaagtgctgcagataaggttt

SEQ ID NO: 228175 - DNA, 20 bp, Drosophila melanogaster
aacagattacctgttgcacc

SEQ ID NO: 228176 - DNA, 23 bp, Drosophila melanogaster
tctccctctgttatcctttctgt

SEQ ID NO: 228177 - DNA, 23 bp, Drosophila melanogaster
tgactgactggctggctgagtga

SEQ ID NO: 228178 - DNA, 23 bp, Drosophila melanogaster
ttgtctgtgtgtgtcagtgggtg

SEQ ID NO: 228179 - DNA, 23 bp, Drosophila melanogaster
tgtgcgcttgtgtgatgatgttg

SEQ ID NO: 228180 - DNA, 18 bp, Drosophila melanogaster
aacagtcgtggcgactct

SEQ ID NO: 228181 - DNA, 23 bp, Drosophila melanogaster
taacacacacacccacctttatg

SEQ ID NO: 228182 - DNA, 22 bp, Drosophila melanogaster
attgttgtcttgcagcagctga

SEQ ID NO: 228183 - DNA, 23 bp, Drosophila melanogaster
aagtacatgtacatgtgtatgtc

SEQ ID NO: 228184 - DNA, 19 bp, Drosophila melanogaster
cgtatgtatgcatgtatgt

SEQ ID NO: 228185 - DNA, 19 bp, Drosophila melanogaster
acacgagcgaattccttgc

SEQ ID NO: 228186 - DNA, 23 bp, Drosophila melanogaster
aaatttgttttgtgactcattgt

SEQ ID NO: 228187 - DNA, 19 bp, Drosophila melanogaster
gtgtggaattttcactggc

SEQ ID NO: 228188 - DNA, 23 bp, Drosophila melanogaster
tctgcgtgctagtgtgtgtgtta

SEQ ID NO: 228189 - DNA, 20 bp, Drosophila melanogaster
cgtgcacataaaatgtgtat

SEQ ID NO: 228190 - DNA, 19 bp, Drosophila melanogaster
acactcacagactttctgc

SEQ ID NO: 228191 - DNA, 22 bp, Drosophila melanogaster
cagcttgtgtgtatttggttaa

SEQ ID NO: 228192 - DNA, 23 bp, Drosophila melanogaster
ctttggtaatctagctttatgaa

SEQ ID NO: 228193 - DNA, 23 bp, Drosophila melanogaster
acaggactcaagtgagacagcac

SEQ ID NO: 228194 - DNA, 22 bp, Drosophila melanogaster
tttgtgagttatgtctgagctc

SEQ ID NO: 228195 - DNA, 19 bp, Drosophila melanogaster
agggtagaaggatgcatac

SEQ ID NO: 228196 - DNA, 19 bp, Drosophila melanogaster
tgtatgtatgtatgtatcc

SEQ ID NO: 228197 - DNA, 23 bp, Drosophila melanogaster
agagtgagttcttagtgtgcccg

SEQ ID NO: 228198 - DNA, 23 bp, Drosophila melanogaster
actctgtgcctgtgtgtgtgcgt

SEQ ID NO: 228199 - DNA, 19 bp, Drosophila melanogaster
ttagcgcataaatttcatg

SEQ ID NO: 228200 - DNA, 23 bp, Drosophila melanogaster
agtacctcactcagtctaatggc

SEQ ID NO: 228201 - DNA, 22 bp, Drosophila melanogaster
agatatcatcatcatcatcatc

SEQ ID NO: 228202 - DNA, 23 bp, Drosophila melanogaster
aagctgcaactgcaactgcaact

SEQ ID NO: 228203 - DNA, 23 bp, Drosophila melanogaster
ggtttggacttttctgagtggca

SEQ ID NO: 228204 - DNA, 21 bp, Drosophila melanogaster
tgtgagtgtctgattggtgtc

SEQ ID NO: 228205 - DNA, 19 bp, Drosophila melanogaster
attgcatcagtgttggcgt

SEQ ID NO: 228206 - DNA, 23 bp, Drosophila melanogaster
tgtctgcaactcgttcacggtgc

SEQ ID NO: 228207 - DNA, 23 bp, Drosophila melanogaster
cacgtcctgctaatgtttgcatg

SEQ ID NO: 228208 - DNA, 23 bp, Drosophila melanogaster
tactcgtatatgaaactccatcc

SEQ ID NO: 228209 - DNA, 23 bp, Drosophila melanogaster
tgcctctcagtctgttatgggtc

SEQ ID NO: 228210 - DNA, 22 bp, Drosophila melanogaster
ttccatggctgctgttgttgcg

SEQ ID NO: 228211 - DNA, 23 bp, Drosophila melanogaster
ccgtccgtccgtccgtccgtctg

SEQ ID NO: 228212 - DNA, 22 bp, Drosophila melanogaster
agatgtgttatcctgctgatga

SEQ ID NO: 228213 - DNA, 21 bp, Drosophila melanogaster
atggcgaagatggcatgatgt

SEQ ID NO: 228214 - DNA, 23 bp, Drosophila melanogaster
gtatgaatgtatgtcaaattctc

SEQ ID NO: 228215 - DNA, 23 bp, Drosophila melanogaster
tgagtactgtttttgttgatttg

SEQ ID NO: 228216 - DNA, 23 bp, Drosophila melanogaster
tcactcactcggtttctcactcg

SEQ ID NO: 228217 - DNA, 23 bp, Drosophila melanogaster
catagaggaatacatatgtatgt

SEQ ID NO: 228218 - DNA, 19 bp, Drosophila melanogaster
gactttggtatatttgtgt

SEQ ID NO: 228219 - DNA, 22 bp, Drosophila melanogaster
actcacacactcataaacccac

SEQ ID NO: 228220 - DNA, 18 bp, Drosophila melanogaster
cacacacactcgcacaca

SEQ ID NO: 228221 - DNA, 23 bp, Drosophila melanogaster
tttaagcaatatagttgatatgt

SEQ ID NO: 228222 - DNA, 23 bp, Drosophila melanogaster
ttaatggcactggaagaattcac

SEQ ID NO: 228223 - DNA, 21 bp, Drosophila melanogaster
tcttagtggcatctatggtgc

SEQ ID NO: 228224 - DNA, 23 bp, Drosophila melanogaster
tgtgactggctgagtgtttggct

SEQ ID NO: 228225 - DNA, 20 bp, Drosophila melanogaster
agtcaggctgactggctcgt

SEQ ID NO: 228226 - DNA, 22 bp, Drosophila melanogaster
attatgtttatcattatgttta

SEQ ID NO: 228227 - DNA, 22 bp, Drosophila melanogaster
atatatggggcctaatgttgcc

SEQ ID NO: 228228 - DNA, 20 bp, Drosophila melanogaster
cacacacactcacaccactg

SEQ ID NO: 228229 - DNA, 21 bp, Drosophila melanogaster
attctgtgcgtatgtgtctgt

SEQ ID NO: 228230 - DNA, 23 bp, Drosophila melanogaster
atgaccaatcaattgacacagat

SEQ ID NO: 228231 - DNA, 22 bp, Drosophila melanogaster
gctcactcgcacactcacgtaa

SEQ ID NO: 228232 - DNA, 20 bp, Drosophila melanogaster
taatggaatattaggcaaag

SEQ ID NO: 228233 - DNA, 21 bp, Drosophila melanogaster
acttgcactgtccgcggacag

SEQ ID NO: 228234 - DNA, 21 bp, Drosophila melanogaster
attgagttgataaagctttcg

SEQ ID NO: 228235 - DNA, 22 bp, Drosophila melanogaster
tccgtgagagcacttgtcgtgt

SEQ ID NO: 228236 - DNA, 23 bp, Drosophila melanogaster
tatgtggctatgtttgtacaaca

SEQ ID NO: 228237 - DNA, 23 bp, Drosophila melanogaster
aagttgtattactttagccactg

SEQ ID NO: 228238 - DNA, 21 bp, Drosophila melanogaster
agtgagcagtgagtgtgcagt

SEQ ID NO: 228239 - DNA, 23 bp, Drosophila melanogaster
tgttgcatgcatttgcattgtta

SEQ ID NO: 228240 - DNA, 22 bp, Drosophila melanogaster
tagagtgagccaaatgtgtggg

SEQ ID NO: 228241 - DNA, 23 bp, Drosophila melanogaster
acgttatatgtatgtatgtatgt

SEQ ID NO: 228242 - DNA, 23 bp, Drosophila melanogaster
tctgagtgcgtcagtctgtcatt

SEQ ID NO: 228243 - DNA, 22 bp, Drosophila melanogaster
tatatgcatatatatacatgtt

SEQ ID NO: 228244 - DNA, 19 bp, Drosophila melanogaster
atcaggtaggtttgcattt

SEQ ID NO: 228245 - DNA, 23 bp, Drosophila melanogaster
ttttatgtcagactgctgcagga

SEQ ID NO: 228246 - DNA, 23 bp, Drosophila melanogaster
tgcctgcctgcctgcctgcctac

SEQ ID NO: 228247 - DNA, 23 bp, Drosophila melanogaster
agtttgttgaacttggtatattc

SEQ ID NO: 228248 - DNA, 22 bp, Drosophila melanogaster
aatgcaaggattcaataggttt

SEQ ID NO: 228249 - DNA, 23 bp, Drosophila melanogaster
ctcctctctcactgtcagcggat

SEQ ID NO: 228250 - DNA, 22 bp, Drosophila melanogaster
gtccgtcagtctgccagtccgt

SEQ ID NO: 228251 - DNA, 20 bp, Drosophila melanogaster
attcaggcagtcagtcagtc

SEQ ID NO: 228252 - DNA, 23 bp, Drosophila melanogaster
gcctctgtctcagtctccgtttc

SEQ ID NO: 228253 - DNA, 23 bp, Drosophila melanogaster
tcaaagtggcagtgacatgttgt

SEQ ID NO: 228254 - DNA, 23 bp, Drosophila melanogaster
tatcacagccagctttgaggagc

SEQ ID NO: 228255 - DNA, 20 bp, Drosophila melanogaster
gaaataatggaagtggctgg

SEQ ID NO: 228256 - DNA, 23 bp, Drosophila melanogaster
gtctgtctgtctgtcagtcagtc

SEQ ID NO: 228257 - DNA, 19 bp, Drosophila melanogaster
acagaacacacagaactga

SEQ ID NO: 228258 - DNA, 23 bp, Drosophila melanogaster
tgtgtgtgtgtgagtgcgtgtgt

SEQ ID NO: 228259 - DNA, 18 bp, Drosophila melanogaster
tatgaagacaacgtgttg

SEQ ID NO: 228260 - DNA, 21 bp, Drosophila melanogaster
tgccagtttgcctgtttgcct

SEQ ID NO: 228261 - DNA, 21 bp, Drosophila melanogaster
tatccgacagatacaaaagtg

SEQ ID NO: 228262 - DNA, 23 bp, Drosophila melanogaster
agtctgtgtctgtgagtcagcgt

SEQ ID NO: 228263 - DNA, 23 bp, Drosophila melanogaster
ttgttgttgctcgatgtgttttc

SEQ ID NO: 228264 - DNA, 18 bp, Drosophila melanogaster
gctagatacacacactct

SEQ ID NO: 228265 - DNA, 23 bp, Drosophila melanogaster
tgcctgtgtgcgtgagtgcgtgc

SEQ ID NO: 228266 - DNA, 21 bp, Drosophila melanogaster
atatagtacgtgtatatgtat

SEQ ID NO: 228267 - DNA, 18 bp, Drosophila melanogaster
tttggataaacagaaaat

SEQ ID NO: 228268 - DNA, 21 bp, Drosophila melanogaster
atatagtacgtgtatatgtat

SEQ ID NO: 228269 - DNA, 18 bp, Drosophila melanogaster
tttggataaacagaaaat

SEQ ID NO: 228270 - DNA, 23 bp, Drosophila melanogaster
tccgtccgtccgtctgtcagtct

SEQ ID NO: 228271 - DNA, 23 bp, Drosophila melanogaster
tgactgcctcgctgtgtggcagg

SEQ ID NO: 228272 - DNA, 19 bp, Drosophila melanogaster
atgtatgtttgtatattgc

SEQ ID NO: 228273 - DNA, 19 bp, Drosophila melanogaster
tatatcaagtttagcttag

SEQ ID NO: 228274 - DNA, 19 bp, Drosophila melanogaster
accggatgcagtttgtggt

SEQ ID NO: 228275 - DNA, 23 bp, Drosophila melanogaster
cactgacacgtttgactcactca

SEQ ID NO: 228276 - DNA, 23 bp, Drosophila melanogaster
tggtgtgcatctgtgtgtgggtg

SEQ ID NO: 228277 - DNA, 19 bp, Drosophila melanogaster
tttatagttctgcgccagg

SEQ ID NO: 228278 - DNA, 22 bp, Drosophila melanogaster
taacgtacttagacttaaagta

SEQ ID NO: 228279 - DNA, 22 bp, Drosophila melanogaster
aaaaagcacttagagcaccgtg

SEQ ID NO: 228280 - DNA, 20 bp, Drosophila melanogaster
gcatcagaggtggcatcagt

SEQ ID NO: 228281 - DNA, 23 bp, Drosophila melanogaster
gattgctgtctgtccgactgtcg

SEQ ID NO: 228282 - DNA, 20 bp, Drosophila melanogaster
tgaatgaatgaatgactgcg

SEQ ID NO: 228283 - DNA, 20 bp, Drosophila melanogaster
tcagttcagttcagttcggt

SEQ ID NO: 228284 - DNA, 23 bp, Drosophila melanogaster
aattgatgatgttgatgttgatg

SEQ ID NO: 228285 - DNA, 23 bp, Drosophila melanogaster
gttgactttgatttgatatggtg

SEQ ID NO: 228286 - DNA, 19 bp, Drosophila melanogaster
tgtgtgaagtgtgtgagct

SEQ ID NO: 228287 - DNA, 23 bp, Drosophila melanogaster
tcagttgttgcattgccacagtg

SEQ ID NO: 228288 - DNA, 21 bp, Drosophila melanogaster
ttgcataatgaatgcagatgc

SEQ ID NO: 228289 - DNA, 22 bp, Drosophila melanogaster
tgagagagcacacacagacagt

SEQ ID NO: 228290 - DNA, 21 bp, Drosophila melanogaster
tctggacttttaatgtaatct

SEQ ID NO: 228291 - DNA, 23 bp, Drosophila melanogaster
gtgatgattacatggtaaagagt

SEQ ID NO: 228292 - DNA, 21 bp, Drosophila melanogaster
taaatatcttgtggcagtggt

SEQ ID NO: 228293 - DNA, 23 bp, Drosophila melanogaster
gaggtcctttcaggttgtcaatt

SEQ ID NO: 228294 - DNA, 21 bp, Drosophila melanogaster
attgcaattatatttgtttgt

SEQ ID NO: 228295 - DNA, 18 bp, Drosophila melanogaster
agcaagagtgataaagca

SEQ ID NO: 228296 - DNA, 18 bp, Drosophila melanogaster
tcgctcgctcgctgactg

SEQ ID NO: 228297 - DNA, 23 bp, Drosophila melanogaster
ctgtgcgtgtgtgtgtgcctgtg

SEQ ID NO: 228298 - DNA, 18 bp, Drosophila melanogaster
acacccaccgattggcca

SEQ ID NO: 228299 - DNA, 23 bp, Drosophila melanogaster
gttacaatcttgctgatgcagtt

SEQ ID NO: 228300 - DNA, 23 bp, Drosophila melanogaster
ctgtatctcagtatctcactgtc

SEQ ID NO: 228301 - DNA, 23 bp, Drosophila melanogaster
gttttacctacttaattgattgc

SEQ ID NO: 228302 - DNA, 23 bp, Drosophila melanogaster
ttctaaaaagtaggtgtcttaga

SEQ ID NO: 228303 - DNA, 19 bp, Drosophila melanogaster
ttgtgtgccagacttcgcc

SEQ ID NO: 228304 - DNA, 23 bp, Drosophila melanogaster
gtcagtcagtccgtctgttttcc

SEQ ID NO: 228305 - DNA, 23 bp, Drosophila melanogaster
tgttgatgatgatgatgctgctg

SEQ ID NO: 228306 - DNA, 18 bp, Drosophila melanogaster
tgccatcgtcttcgtctg

SEQ ID NO: 228307 - DNA, 20 bp, Drosophila melanogaster
tgcaatagaaatcccactct

SEQ ID NO: 228308 - DNA, 23 bp, Drosophila melanogaster
gtgtctgtgtctgtctgcaatcg

SEQ ID NO: 228309 - DNA, 20 bp, Drosophila melanogaster
ctgacacacatacgagtgtg

SEQ ID NO: 228310 - DNA, 18 bp, Drosophila melanogaster
tgaatgtttgtatgtatg

SEQ ID NO: 228311 - DNA, 23 bp, Drosophila melanogaster
gagtcagctctagctgtgttggt

SEQ ID NO: 228312 - DNA, 18 bp, Drosophila melanogaster
ttctgtttacaagcctat

SEQ ID NO: 228313 - DNA, 23 bp, Drosophila melanogaster
atgtatagttgtatgtagatttc

SEQ ID NO: 228314 - DNA, 23 bp, Drosophila melanogaster
gatgaaggagctgaggatggcat

SEQ ID NO: 228315 - DNA, 21 bp, Drosophila melanogaster
attatctggagttgcggcaca

SEQ ID NO: 228316 - DNA, 23 bp, Drosophila melanogaster
gtgtcactgtatgagtgtgtgtc

SEQ ID NO: 228317 - DNA, 21 bp, Drosophila melanogaster
tatgtcgcaaggctattccag

SEQ ID NO: 228318 - DNA, 23 bp, Drosophila melanogaster
tgcaactgcaactgcatctgcca

SEQ ID NO: 228319 - DNA, 19 bp, Drosophila melanogaster
aaagtcagtgtttttctta

SEQ ID NO: 228320 - DNA, 21 bp, Drosophila melanogaster
tgtagatgtatagttttgcgg

SEQ ID NO: 228321 - DNA, 21 bp, Drosophila melanogaster
acatatgttatgtacgtgtat

SEQ ID NO: 228322 - DNA, 23 bp, Drosophila melanogaster
ttgcgtatgcgtatgtttatgtt

SEQ ID NO: 228323 - DNA, 21 bp, Drosophila melanogaster
gagtgagtgagagagggagcg

SEQ ID NO: 228324 - DNA, 18 bp, Drosophila melanogaster
accatatcatatcagtgt

SEQ ID NO: 228325 - DNA, 22 bp, Drosophila melanogaster
atatatgtacatatatatgggt

SEQ ID NO: 228326 - DNA, 23 bp, Drosophila melanogaster
atttacgttgcatatgaaatgat

SEQ ID NO: 228327 - DNA, 22 bp, Drosophila melanogaster
atgcaagtcgaggtcctccaca

SEQ ID NO: 228328 - DNA, 23 bp, Drosophila melanogaster
aggcagctagtcagtttgtcact

SEQ ID NO: 228329 - DNA, 23 bp, Drosophila melanogaster
tctgcatatttcaatgttttcgc

SEQ ID NO: 228330 - DNA, 23 bp, Drosophila melanogaster
ccgtctgtgtctgtgtctccggc

SEQ ID NO: 228331 - DNA, 23 bp, Drosophila melanogaster
ctgtggctctgactttggacggt

SEQ ID NO: 228332 - DNA, 23 bp, Drosophila melanogaster
tcagtctttttctctctcctata

SEQ ID NO: 228333 - DNA, 23 bp, Drosophila melanogaster
tgtgatttatctgcttggacatc

SEQ ID NO: 228334 - DNA, 23 bp, Drosophila melanogaster
cacacatacacactctctcttaa

SEQ ID NO: 228335 - DNA, 20 bp, Drosophila melanogaster
tcagccagccactcatttcg

SEQ ID NO: 228336 - DNA, 23 bp, Drosophila melanogaster
gctgactgactgactgactgact

SEQ ID NO: 228337 - DNA, 22 bp, Drosophila melanogaster
tccgagggagaaaatgttgtat

SEQ ID NO: 228338 - DNA, 21 bp, Drosophila melanogaster
aattgttgttcgctattcgtg

SEQ ID NO: 228339 - DNA, 19 bp, Drosophila melanogaster
aaggtggacatcagttagt

SEQ ID NO: 228340 - DNA, 23 bp, Drosophila melanogaster
tatcacgatgttttagttacctt

SEQ ID NO: 228341 - DNA, 21 bp, Drosophila melanogaster
aatgcgttctgtatacgtatg

SEQ ID NO: 228342 - DNA, 23 bp, Drosophila melanogaster
taaggaacatgtggaggcagcac

SEQ ID NO: 228343 - DNA, 21 bp, Drosophila melanogaster
tgtgtgcctgtctgagtggct

SEQ ID NO: 228344 - DNA, 18 bp, Drosophila melanogaster
tatgtgttagtcatgttc

SEQ ID NO: 228345 - DNA, 21 bp, Drosophila melanogaster
tctgcatctgcaaatgtatct

SEQ ID NO: 228346 - DNA, 23 bp, Drosophila melanogaster
agactgactggctcactggctca

SEQ ID NO: 228347 - DNA, 23 bp, Drosophila melanogaster
ttgtcattctcccgcatctatat

SEQ ID NO: 228348 - DNA, 23 bp, Drosophila melanogaster
acactctcacccagacaattggc

SEQ ID NO: 228349 - DNA, 23 bp, Drosophila melanogaster
ctcgtgtgactctgactctgact

SEQ ID NO: 228350 - DNA, 20 bp, Drosophila melanogaster
gtgaagactttgaaagccca

SEQ ID NO: 228351 - DNA, 20 bp, Drosophila melanogaster
gtgaagactttgaaagccca

SEQ ID NO: 228352 - DNA, 21 bp, Drosophila melanogaster
tcggtcggtcggtcggtcggt

SEQ ID NO: 228353 - DNA, 20 bp, Drosophila melanogaster
aatgagcttccattacttcg

SEQ ID NO: 228354 - DNA, 23 bp, Drosophila melanogaster
tcagtactctccaacaggtggcg

SEQ ID NO: 228355 - DNA, 23 bp, Drosophila melanogaster
tctcgttgagttttgtttaaatg

SEQ ID NO: 228356 - DNA, 18 bp, Drosophila melanogaster
tagaatctaagctataga

SEQ ID NO: 228357 - DNA, 23 bp, Drosophila melanogaster
gtcagtcagtcagtcagccagtc

SEQ ID NO: 228358 - DNA, 22 bp, Drosophila melanogaster
tacactgttctacataatgcat

SEQ ID NO: 228359 - DNA, 18 bp, Drosophila melanogaster
tgtgtgtgtgtatatgtg

SEQ ID NO: 228360 - DNA, 23 bp, Drosophila melanogaster
tgtatatatgtaggtgtataggt

SEQ ID NO: 228361 - DNA, 22 bp, Drosophila melanogaster
attagagtcgccttttgatgtg

SEQ ID NO: 228362 - DNA, 23 bp, Drosophila melanogaster
acacacagacgtatgtatctgtg

SEQ ID NO: 228363 - DNA, 23 bp, Drosophila melanogaster
tcagttcggatgggtgtgtgtgt

SEQ ID NO: 228364 - DNA, 23 bp, Drosophila melanogaster
tttgcaagtgtgtgtgagtgtgc

SEQ ID NO: 228365 - DNA, 23 bp, Drosophila melanogaster
tggctggctggctggctgggtgg

SEQ ID NO: 228366 - DNA, 21 bp, Drosophila melanogaster
atgatggttcacaacgaccgt

SEQ ID NO: 228367 - DNA, 23 bp, Drosophila melanogaster
gtcggtgggactttcgtccgttt

SEQ ID NO: 228368 - DNA, 20 bp, Drosophila melanogaster
tctctcactgatttggcggc

SEQ ID NO: 228369 - DNA, 19 bp, Drosophila melanogaster
aaacacagccagcaatcag

SEQ ID NO: 228370 - DNA, 23 bp, Drosophila melanogaster
gcgtgtctgactctgagtctgcg

SEQ ID NO: 228371 - DNA, 19 bp, Drosophila melanogaster
gttgtcgctctcctggctc

SEQ ID NO: 228372 - DNA, 18 bp, Drosophila melanogaster
gttctgccgcttcactgt

SEQ ID NO: 228373 - DNA, 19 bp, Drosophila melanogaster
acaggtggcctttcttgtc

SEQ ID NO: 228374 - DNA, 23 bp, Drosophila melanogaster
tatgtatgtacatgtgtgagcta

SEQ ID NO: 228375 - DNA, 23 bp, Drosophila melanogaster
taatactgtcaggtaaagatgtc

SEQ ID NO: 228376 - DNA, 23 bp, Drosophila melanogaster
taaagttctgcttttgtagtagt

SEQ ID NO: 228377 - DNA, 18 bp, Drosophila melanogaster
tttactacgtacacaggc

SEQ ID NO: 228378 - DNA, 19 bp, Drosophila melanogaster
atgacattcaaaatatttg

SEQ ID NO: 228379 - DNA, 22 bp, Drosophila melanogaster
gtcagcctgtctgtcagggtca

SEQ ID NO: 228380 - DNA, 23 bp, Drosophila melanogaster
ccatctgtccgtctctgtctgtg

SEQ ID NO: 228381 - DNA, 19 bp, Drosophila melanogaster
aatgacacggaaagaatgg

SEQ ID NO: 228382 - DNA, 18 bp, Drosophila melanogaster
gtgcgctacacttgtttc

SEQ ID NO: 228383 - DNA, 19 bp, Drosophila melanogaster
aagaggaaaatctattgct

SEQ ID NO: 228384 - DNA, 22 bp, Drosophila melanogaster
aaagagagtggctttgtttttt

SEQ ID NO: 228385 - DNA, 23 bp, Drosophila melanogaster
tatgcgtgctagtgtttgcctgt

SEQ ID NO: 228386 - DNA, 18 bp, Drosophila melanogaster
agggcatatagtttgccg

SEQ ID NO: 228387 - DNA, 23 bp, Drosophila melanogaster
gtctcacgctctctgtgtccctc

SEQ ID NO: 228388 - DNA, 19 bp, Drosophila melanogaster
acactagcgacacaattag

SEQ ID NO: 228389 - DNA, 23 bp, Drosophila melanogaster
actctggctgtgactgcgactgt

SEQ ID NO: 228390 - DNA, 23 bp, Drosophila melanogaster
tggctggctgactgcctgcctgg

SEQ ID NO: 228391 - DNA, 21 bp, Drosophila melanogaster
agtcaatcactcactcactta

SEQ ID NO: 228392 - DNA, 21 bp, Drosophila melanogaster
actctttgtctggcaattaat

SEQ ID NO: 228393 - DNA, 18 bp, Drosophila melanogaster
ttgattcgactaattgcc

SEQ ID NO: 228394 - DNA, 19 bp, Drosophila melanogaster
gataagattgatgtgtgta

SEQ ID NO: 228395 - DNA, 23 bp, Drosophila melanogaster
tatgtatataagtatttgtatgt

SEQ ID NO: 228396 - DNA, 21 bp, Drosophila melanogaster
gagagaggagagagtgttgca

SEQ ID NO: 228397 - DNA, 23 bp, Drosophila melanogaster
tttaagcttgtattcagctgcgt

SEQ ID NO: 228398 - DNA, 19 bp, Drosophila melanogaster
cactgtagatacagtgctc

SEQ ID NO: 228399 - DNA, 23 bp, Drosophila melanogaster
tgttgtggtgctactggtccctg

SEQ ID NO: 228400 - DNA, 23 bp, Drosophila melanogaster
aacaaaaggttctctgcgttatt

SEQ ID NO: 228401 - DNA, 18 bp, Drosophila melanogaster
agttgattaggagctgtc

SEQ ID NO: 228402 - DNA, 23 bp, Drosophila melanogaster
catatctatcagtttgtttgctc

SEQ ID NO: 228403 - DNA, 23 bp, Drosophila melanogaster
tgtctctctgtctgtctgtctgc

SEQ ID NO: 228404 - DNA, 23 bp, Drosophila melanogaster
agtgactgagtgactgactattt

SEQ ID NO: 228405 - DNA, 23 bp, Drosophila melanogaster
tgaaactgcaattgcatctgcaa

SEQ ID NO: 228406 - DNA, 21 bp, Drosophila melanogaster
atgataatgatgatgatggtg

SEQ ID NO: 228407 - DNA, 23 bp, Drosophila melanogaster
aagaaagcattcatatgtgacac

SEQ ID NO: 228408 - DNA, 22 bp, Drosophila melanogaster
tgtttgtatctacaaattggaa

SEQ ID NO: 228409 - DNA, 22 bp, Drosophila melanogaster
gcatgcatattaaatgagattt

SEQ ID NO: 228410 - DNA, 23 bp, Drosophila melanogaster
ctgcctgactgcctgactagcag

SEQ ID NO: 228411 - DNA, 23 bp, Drosophila melanogaster
tactccgatctctctatctctct

SEQ ID NO: 228412 - DNA, 23 bp, Drosophila melanogaster
gcctgcctgcctgcctggctgcg

SEQ ID NO: 228413 - DNA, 23 bp, Drosophila melanogaster
ccgtgtctgtgtctgtgtctgtg

SEQ ID NO: 228414 - DNA, 23 bp, Drosophila melanogaster
attgagtgtgaacatgcaagaaa

SEQ ID NO: 228415 - DNA, 22 bp, Drosophila melanogaster
atgattagtgagaggtttggtt

SEQ ID NO: 228416 - DNA, 23 bp, Drosophila melanogaster
cagcgtgtgtgtgtgtgtgagcg

SEQ ID NO: 228417 - DNA, 23 bp, Drosophila melanogaster
tgactgactatagctatactacg

SEQ ID NO: 228418 - DNA, 22 bp, Drosophila melanogaster
gtgtggaattgcatgtgcaaca

SEQ ID NO: 228419 - DNA, 23 bp, Drosophila melanogaster
tctgcatctatgtatctgtgtat

SEQ ID NO: 228420 - DNA, 23 bp, Drosophila melanogaster
tatctgtgcattgcatttgcatt

SEQ ID NO: 228421 - DNA, 22 bp, Drosophila melanogaster
atctgcatctgcatctgcatgt

SEQ ID NO: 228422 - DNA, 23 bp, Drosophila melanogaster
gtcagagtcagagtcagtgtctc

SEQ ID NO: 228423 - DNA, 20 bp, Drosophila melanogaster
tcgcaggctcttttgtgcgc

SEQ ID NO: 228424 - DNA, 21 bp, Drosophila melanogaster
ttgctgcttctgaattctgct

SEQ ID NO: 228425 - DNA, 23 bp, Drosophila melanogaster
ctgtgtgtgtgggtgactgtgtg

SEQ ID NO: 228426 - DNA, 18 bp, Drosophila melanogaster
agttactacttgccgtgg

SEQ ID NO: 228427 - DNA, 23 bp, Drosophila melanogaster
tccgtctctgtatttgtgactgg

SEQ ID NO: 228428 - DNA, 23 bp, Drosophila melanogaster
tttgatgcttctgcttgggttcg

SEQ ID NO: 228429 - DNA, 22 bp, Drosophila melanogaster
aaaagtgctaatggctatcata

SEQ ID NO: 228430 - DNA, 23 bp, Drosophila melanogaster
tctctctgtctctctgattctct

SEQ ID NO: 228431 - DNA, 23 bp, Drosophila melanogaster
gcgagtgtgtgtgcctgtgcgtc

SEQ ID NO: 228432 - DNA, 23 bp, Drosophila melanogaster
tactgcaactgcaactgctggtg

SEQ ID NO: 228433 - DNA, 21 bp, Drosophila melanogaster
tttacgacgttttatatggga

SEQ ID NO: 228434 - DNA, 23 bp, Drosophila melanogaster
ccgactgactgactgtctgcccg

SEQ ID NO: 228435 - DNA, 23 bp, Drosophila melanogaster
tgtcgctgcctctgtctctgcca

SEQ ID NO: 228436 - DNA, 23 bp, Drosophila melanogaster
caggtgagagtgagagttttggc

SEQ ID NO: 228437 - DNA, 23 bp, Drosophila melanogaster
tctgtgtgtgcgtctctctctca

SEQ ID NO: 228438 - DNA, 19 bp, Drosophila melanogaster
tgtgtgtgagagtgtgcgc

SEQ ID NO: 228439 - DNA, 23 bp, Drosophila melanogaster
actgactgactgactggctggct

SEQ ID NO: 228440 - DNA, 19 bp, Drosophila melanogaster
gcttttgtgtcgtgtgtgt

SEQ ID NO: 228441 - DNA, 23 bp, Drosophila melanogaster
gtgtgtgtgtcagcgtgtgtgtg

SEQ ID NO: 228442 - DNA, 22 bp, Drosophila melanogaster
tgagggtctgtcagtcactcaa

SEQ ID NO: 228443 - DNA, 20 bp, Drosophila melanogaster
agtgcatttatgtatatgta

SEQ ID NO: 228444 - DNA, 22 bp, Drosophila melanogaster
tctggggagttgtaggcaaagt

SEQ ID NO: 228445 - DNA, 22 bp, Drosophila melanogaster
caagtggctggctgtgttgaca

SEQ ID NO: 228446 - DNA, 21 bp, Drosophila melanogaster
atatagtacgtgtatatgtat

SEQ ID NO: 228447 - DNA, 18 bp, Drosophila melanogaster
tttggataaacagaaaat

SEQ ID NO: 228448 - DNA, 22 bp, Drosophila melanogaster
tgtcagccagtcactcagtctg

SEQ ID NO: 228449 - DNA, 20 bp, Drosophila melanogaster
tctctgtctctgttatttgc

SEQ ID NO: 228450 - DNA, 18 bp, Drosophila melanogaster
ttgcagaacagaacagtt

SEQ ID NO: 228451 - DNA, 19 bp, Drosophila melanogaster
tgtgtgtgtgtgtgcgtct

SEQ ID NO: 228452 - DNA, 22 bp, Drosophila melanogaster
tattgcacttttcacagcccga

SEQ ID NO: 228453 - DNA, 21 bp, Drosophila melanogaster
ttaagtttgaagcgatttggt

SEQ ID NO: 228454 - DNA, 22 bp, Drosophila melanogaster
tattgcacttgagacggcctga

SEQ ID NO: 228455 - DNA, 23 bp, Drosophila melanogaster
atattgcacattcaccggcctga

SEQ ID NO: 228456 - DNA, 22 bp, Drosophila melanogaster
tattgcacacttcccggccttt

SEQ ID NO: 228457 - DNA, 23 bp, Drosophila melanogaster
ccttgtcgctgctgtttctgtct

SEQ ID NO: 228458 - DNA, 20 bp, Drosophila melanogaster
tactgcataaagtcaaatag

SEQ ID NO: 228459 - DNA, 23 bp, Drosophila melanogaster
tgtcagtgcgtcagtcagccact

SEQ ID NO: 228460 - DNA, 23 bp, Drosophila melanogaster
catctgcctgtctgtctcactgc

SEQ ID NO: 228461 - DNA, 23 bp, Drosophila melanogaster
tgactgactgactggctgactgg

SEQ ID NO: 228462 - DNA, 18 bp, Drosophila melanogaster
ggatggctgactggctgc

SEQ ID NO: 228463 - DNA, 22 bp, Drosophila melanogaster
gcactgggtaaagtttgtccta

SEQ ID NO: 228464 - DNA, 19 bp, Drosophila melanogaster
atgcatcttgtgcagttat

SEQ ID NO: 228465 - DNA, 23 bp, Drosophila melanogaster
tcactgggcaaagtgtgtctcaa

SEQ ID NO: 228466 - DNA, 22 bp, Drosophila melanogaster
ataaagctagacaaccattgaa

SEQ ID NO: 228467 - DNA, 23 bp, Drosophila melanogaster
aaaggaacgatcgttgtgatatg

SEQ ID NO: 228468 - DNA, 22 bp, Drosophila melanogaster
taacatatcacagtgattttcc

SEQ ID NO: 228469 - DNA, 22 bp, Drosophila melanogaster
tagagggaatagttgctgtgct

SEQ ID NO: 228470 - DNA, 22 bp, Drosophila melanogaster
tatcacagtggctgttcttttt

SEQ ID NO: 228471 - DNA, 21 bp, Drosophila melanogaster
tctgctgctgatatattattg

SEQ ID NO: 228472 - DNA, 23 bp, Drosophila melanogaster
tatcacagtggctgttctttttg

SEQ ID NO: 228473 - DNA, 22 bp, Drosophila melanogaster
tatcacagtggctgttcttttt

SEQ ID NO: 228474 - DNA, 23 bp, Drosophila melanogaster
tagacacatgtattgtatgcctt

SEQ ID NO: 228475 - DNA, 23 bp, Drosophila melanogaster
ttctgcaactgtatctggaagat

SEQ ID NO: 228476 - DNA, 21 bp, Drosophila melanogaster
tacaaatgtgtatttctatat

SEQ ID NO: 228477 - DNA, 20 bp, Drosophila melanogaster
tatacatagaatccggtatg

SEQ ID NO: 228478 - DNA, 23 bp, Drosophila melanogaster
tcgaatgaacaatggatttcatg

SEQ ID NO: 228479 - DNA, 19 bp, Drosophila melanogaster
ttacagcggcaattagtcg

SEQ ID NO: 228480 - DNA, 19 bp, Drosophila melanogaster
atcagatttttgattgcgc

SEQ ID NO: 228481 - DNA, 23 bp, Drosophila melanogaster
ttgagactgtgcttgttcttatg

SEQ ID NO: 228482 - DNA, 23 bp, Drosophila melanogaster
ctataagtctgaagtttggtcca

SEQ ID NO: 228483 - DNA, 23 bp, Drosophila melanogaster
aaagccagtggttatgtatatat

SEQ ID NO: 228484 - DNA, 23 bp, Drosophila melanogaster
tttggctttaatttgcattgaaa

SEQ ID NO: 228485 - DNA, 22 bp, Drosophila melanogaster
catgactatgtaagttctcaca

SEQ ID NO: 228486 - DNA, 23 bp, Drosophila melanogaster
tatctgcatctgcatctgcatct

SEQ ID NO: 228487 - DNA, 23 bp, Drosophila melanogaster
tctctgtctgtgtgtctgggtgg

SEQ ID NO: 228488 - DNA, 18 bp, Drosophila melanogaster
cactggtacatgtgacag

SEQ ID NO: 228489 - DNA, 23 bp, Drosophila melanogaster
gtgtctgactgactggctgactg

SEQ ID NO: 228490 - DNA, 18 bp, Drosophila melanogaster
caatcgcactcacagcct

SEQ ID NO: 228491 - DNA, 23 bp, Drosophila melanogaster
tggcaagatgtcggcatagctga

SEQ ID NO: 228492 - DNA, 23 bp, Drosophila melanogaster
tctagtcagttgttcaatggaac

SEQ ID NO: 228493 - DNA, 21 bp, Drosophila melanogaster
gtagtctactgtttatgtact

SEQ ID NO: 228494 - DNA, 18 bp, Drosophila melanogaster
tcttgttgcctgttaagt

SEQ ID NO: 228495 - DNA, 23 bp, Drosophila melanogaster
ttttcattgtatttgaaatgctg

SEQ ID NO: 228496 - DNA, 23 bp, Drosophila melanogaster
attgcatgcctcgctgtttgact

SEQ ID NO: 228497 - DNA, 21 bp, Drosophila melanogaster
tatatgtggctatatataggg

SEQ ID NO: 228498 - DNA, 23 bp, Drosophila melanogaster
tttgtgtgcgaaagaaatgtgag

SEQ ID NO: 228499 - DNA, 23 bp, Drosophila melanogaster
atgaagttacacacacacatacc

SEQ ID NO: 228500 - DNA, 23 bp, Drosophila melanogaster
tttatttgtgtggaaaatttccc

SEQ ID NO: 228501 - DNA, 23 bp, Drosophila melanogaster
tttcttcctgttgaacaggactt

SEQ ID NO: 228502 - DNA, 18 bp, Drosophila melanogaster
tatatctttatctgcatg

SEQ ID NO: 228503 - DNA, 18 bp, Drosophila melanogaster
acaatgatgatgatggtg

SEQ ID NO: 228504 - DNA, 23 bp, Drosophila melanogaster
tacttgtgctatataattgtgta

SEQ ID NO: 228505 - DNA, 23 bp, Drosophila melanogaster
tgtagtgtagaaagttgattgga

SEQ ID NO: 228506 - DNA, 21 bp, Drosophila melanogaster
cgtgtgtgcgtgtgtctctcg

SEQ ID NO: 228507 - DNA, 23 bp, Drosophila melanogaster
tcaatgtgaattatttattagct

SEQ ID NO: 228508 - DNA, 23 bp, Drosophila melanogaster
ttgtcaatggttctggagctgga

SEQ ID NO: 228509 - DNA, 21 bp, Drosophila melanogaster
atgctgcatttcaaatgcttt

SEQ ID NO: 228510 - DNA, 22 bp, Drosophila melanogaster
tgtattgtatgtgaaattagct

SEQ ID NO: 228511 - DNA, 22 bp, Drosophila melanogaster
ataatgcacatctctatgtatg

SEQ ID NO: 228512 - DNA, 19 bp, Drosophila melanogaster
tgactgacaaactgactga

SEQ ID NO: 228513 - DNA, 23 bp, Drosophila melanogaster
gtctgtctgcctgccagcctggc

SEQ ID NO: 228514 - DNA, 20 bp, Drosophila melanogaster
gtcagtcagtcagtcagtca

SEQ ID NO: 228515 - DNA, 23 bp, Drosophila melanogaster
tactgaagttgttgtgttgttga

SEQ ID NO: 228516 - DNA, 23 bp, Drosophila melanogaster
attgagtcgctgcctggctgcct

SEQ ID NO: 228517 - DNA, 23 bp, Drosophila melanogaster
tctgtgcgtgtgtgcgtgcgtgt

SEQ ID NO: 228518 - DNA, 23 bp, Drosophila melanogaster
aaatcacaggattatactgtgag

SEQ ID NO: 228519 - DNA, 19 bp, Drosophila melanogaster
tctctctcgctctttctcg

SEQ ID NO: 228520 - DNA, 23 bp, Drosophila melanogaster
tggctggctggatggctgggtgg

SEQ ID NO: 228521 - DNA, 23 bp, Drosophila melanogaster
tatattcttgatcagggtcacta

SEQ ID NO: 228522 - DNA, 21 bp, Drosophila melanogaster
ccttatcattctctcgccccg

SEQ ID NO: 228523 - DNA, 22 bp, Drosophila melanogaster
tggacggagaactgataagggc

SEQ ID NO: 228524 - DNA, 22 bp, Drosophila melanogaster
gtgcaaaagtgtggaaaccgtt

SEQ ID NO: 228525 - DNA, 23 bp, Drosophila melanogaster
atgtatatgcatcgtgtgtgtat

SEQ ID NO: 228526 - DNA, 23 bp, Drosophila melanogaster
atgtggatgtggatgtgcttgtg

SEQ ID NO: 228527 - DNA, 19 bp, Drosophila melanogaster
gatgtgtaatgtttgtgct

SEQ ID NO: 228528 - DNA, 23 bp, Drosophila melanogaster
aatgctatatatatatatgtata

SEQ ID NO: 228529 - DNA, 22 bp, Drosophila melanogaster
tgactgcctgcctggctggctg

SEQ ID NO: 228530 - DNA, 23 bp, Drosophila melanogaster
aaagagagctgtccgtcgacagt

SEQ ID NO: 228531 - DNA, 23 bp, Drosophila melanogaster
tgtcatggaattgctctctttgt

SEQ ID NO: 228532 - DNA, 23 bp, Drosophila melanogaster
aagagagctatccgtcgacagtc

SEQ ID NO: 228533 - DNA, 23 bp, Drosophila melanogaster
tgtcatggaattgctctctttgt

SEQ ID NO: 228534 - DNA, 21 bp, Drosophila melanogaster
ctgtgcttttctatttgatta

SEQ ID NO: 228535 - DNA, 19 bp, Drosophila melanogaster
tatggtgtatcttatgtag

SEQ ID NO: 228536 - DNA, 23 bp, Drosophila melanogaster
ttagttatactagaaagctgatc

SEQ ID NO: 228537 - DNA, 23 bp, Drosophila melanogaster
atgagcaactgcaactccaattg

SEQ ID NO: 228538 - DNA, 23 bp, Drosophila melanogaster
ctcagcgagtctgtctgtctgtc

SEQ ID NO: 228539 - DNA, 23 bp, Drosophila melanogaster
attgagagcttgagtacgtggac

SEQ ID NO: 228540 - DNA, 21 bp, Drosophila melanogaster
tatgtcgcaaggctattccag

SEQ ID NO: 228541 - DNA, 23 bp, Drosophila melanogaster
tttctctgccaccctctctctta

SEQ ID NO: 228542 - DNA, 22 bp, Drosophila melanogaster
cacggggtgtaaaaagagagag

SEQ ID NO: 228543 - DNA, 23 bp, Drosophila melanogaster
tctatatgcatctctttaggtat

SEQ ID NO: 228544 - DNA, 23 bp, Drosophila melanogaster
ttctactgcatcaggatgtgctc

SEQ ID NO: 228545 - DNA, 19 bp, Drosophila melanogaster
ctgagcttgcgattcttgt

SEQ ID NO: 228546 - DNA, 23 bp, Drosophila melanogaster
ggatgtgaatgtggatgtggctg

SEQ ID NO: 228547 - DNA, 21 bp, Drosophila melanogaster
tatgtcgcaaggctattccag

SEQ ID NO: 228548 - DNA, 21 bp, Drosophila melanogaster
tcttgctttgactcactcaac

SEQ ID NO: 228549 - DNA, 21 bp, Drosophila melanogaster
atcacaacctccttgagtgag

SEQ ID NO: 228550 - DNA, 23 bp, Drosophila melanogaster
gtatcagtgtctgtgtctgtaca

SEQ ID NO: 228551 - DNA, 21 bp, Drosophila melanogaster
ttaatgtgtcttgttttgtcc

SEQ ID NO: 228552 - DNA, 18 bp, Drosophila melanogaster
tgtggtggatagtggctg

SEQ ID NO: 228553 - DNA, 23 bp, Drosophila melanogaster
tcattccgtctgtctgtctgtgt

SEQ ID NO: 228554 - DNA, 23 bp, Drosophila melanogaster
acacactgtggcacacactccct

SEQ ID NO: 228555 - DNA, 23 bp, Drosophila melanogaster
gcgagtgtgtgtgagtgggtctg

SEQ ID NO: 228556 - DNA, 22 bp, Drosophila melanogaster
aaaagtggacggtaaagttggg

SEQ ID NO: 228557 - DNA, 23 bp, Drosophila melanogaster
ttttactagacgaggtgctacat

SEQ ID NO: 228558 - DNA, 21 bp, Drosophila melanogaster
tctgtctccagatgtgggtga

SEQ ID NO: 228559 - DNA, 23 bp, Drosophila melanogaster
ctctgtgtgtctgtgagtctgcg

SEQ ID NO: 228560 - DNA, 23 bp, Drosophila melanogaster
agactgtctcagattaagtcgcg

SEQ ID NO: 228561 - DNA, 20 bp, Drosophila melanogaster
tgtggctctcaggtggttgt

SEQ ID NO: 228562 - DNA, 22 bp, Drosophila melanogaster
atgtggatgtgcatctgaatgg

SEQ ID NO: 228563 - DNA, 23 bp, Drosophila melanogaster
actgaaactgcatctgaattcga

SEQ ID NO: 228564 - DNA, 23 bp, Drosophila melanogaster
gtttgctacaattttaaatagtt

SEQ ID NO: 228565 - DNA, 23 bp, Drosophila melanogaster
atatatgtgcatgcaatttgaag

SEQ ID NO: 228566 - DNA, 23 bp, Drosophila melanogaster
atgtatgtatgtatgtatgtatg

SEQ ID NO: 228567 - DNA, 23 bp, Drosophila melanogaster
aaagtgtgtgccacagttgcccc

SEQ ID NO: 228568 - DNA, 20 bp, Drosophila melanogaster
tgagtgatgtgagtgggcac

SEQ ID NO: 228569 - DNA, 23 bp, Drosophila melanogaster
cactcgctcagtcactcattcac

SEQ ID NO: 228570 - DNA, 23 bp, Drosophila melanogaster
ataaagtatgtacatatgtatgt

SEQ ID NO: 228571 - DNA, 20 bp, Drosophila melanogaster
tacccttgtatatgtatact

SEQ ID NO: 228572 - DNA, 20 bp, Drosophila melanogaster
tcaccttgctctttgcagtt

SEQ ID NO: 228573 - DNA, 23 bp, Drosophila melanogaster
tgagatcattttgaaagctgatt

SEQ ID NO: 228574 - DNA, 19 bp, Drosophila melanogaster
aacgtgcgtaaagtgggcg

SEQ ID NO: 228575 - DNA, 23 bp, Drosophila melanogaster
gcgtgtgtgtgaatgtcggtgtg

SEQ ID NO: 228576 - DNA, 23 bp, Drosophila melanogaster
tgtcagtgtgtgtaagtcgagac

SEQ ID NO: 228577 - DNA, 23 bp, Drosophila melanogaster
tctggcttgtagtatgaggaatg

SEQ ID NO: 228578 - DNA, 23 bp, Drosophila melanogaster
cacagacagtctgtctgccagtg

SEQ ID NO: 228579 - DNA, 23 bp, Drosophila melanogaster
ctagcctctactaggctttgtct

SEQ ID NO: 228580 - DNA, 18 bp, Drosophila melanogaster
tataagaggttaggtgta

SEQ ID NO: 228581 - DNA, 22 bp, Drosophila melanogaster
ttgtccacagtctggtggtatt

SEQ ID NO: 228582 - DNA, 23 bp, Drosophila melanogaster
tgtcagtgtctgtcagtctgcgg

SEQ ID NO: 228583 - DNA, 21 bp, Drosophila melanogaster
agtgtgggtgtgtgtgtgcgt

SEQ ID NO: 228584 - DNA, 22 bp, Drosophila melanogaster
tgttcaaaccaattcaatttgc

SEQ ID NO: 228585 - DNA, 19 bp, Drosophila melanogaster
taacaggaaattttggttt

SEQ ID NO: 228586 - DNA, 21 bp, Drosophila melanogaster
atccacctcatcttcatcatc

SEQ ID NO: 228587 - DNA, 23 bp, Drosophila melanogaster
gtcggtgtctgtgtccgtgtgtg

SEQ ID NO: 228588 - DNA, 18 bp, Drosophila melanogaster
aagtgaccggtgggtgga

SEQ ID NO: 228589 - DNA, 23 bp, Drosophila melanogaster
actgactgtctgtctgtctgtct

SEQ ID NO: 228590 - DNA, 23 bp, Drosophila melanogaster
tgatgatgatgatgatggtggat

SEQ ID NO: 228591 - DNA, 20 bp, Drosophila melanogaster
aatgcaaccactggcacaga

SEQ ID NO: 228592 - DNA, 23 bp, Drosophila melanogaster
aatgcgtttatctggtgctggga

SEQ ID NO: 228593 - DNA, 23 bp, Drosophila melanogaster
tgactgactgactgactgccagc

SEQ ID NO: 228594 - DNA, 22 bp, Drosophila melanogaster
ttagtcagctttgtttttgttt

SEQ ID NO: 228595 - DNA, 18 bp, Drosophila melanogaster
tctcacactgacagaccc

SEQ ID NO: 228596 - DNA, 23 bp, Drosophila melanogaster
aactgtgtgtctatgtctgtgga

SEQ ID NO: 228597 - DNA, 23 bp, Drosophila melanogaster
actgactggctgactgattggct

SEQ ID NO: 228598 - DNA, 23 bp, Drosophila melanogaster
catttcgagttgcactttttggc

SEQ ID NO: 228599 - DNA, 23 bp, Drosophila melanogaster
tcactgtgtgcctctctgttatt

SEQ ID NO: 228600 - DNA, 19 bp, Drosophila melanogaster
tccgcttgttcttgctgca

SEQ ID NO: 228601 - DNA, 23 bp, Drosophila melanogaster
agagcaactgcatctggaagaca

SEQ ID NO: 228602 - DNA, 22 bp, Drosophila melanogaster
tgtgagcgaccgattgatgagc

SEQ ID NO: 228603 - DNA, 23 bp, Drosophila melanogaster
tgatgatgatgatgatggtggca

SEQ ID NO: 228604 - DNA, 19 bp, Drosophila melanogaster
aggctcactcagtcactaa

SEQ ID NO: 228605 - DNA, 23 bp, Drosophila melanogaster
tcactagcaactgattcggctta

SEQ ID NO: 228606 - DNA, 23 bp, Drosophila melanogaster
aactgcaacagcaacagcaacag

SEQ ID NO: 228607 - DNA, 23 bp, Drosophila melanogaster
gttggctctgtgtttccctctct

SEQ ID NO: 228608 - DNA, 22 bp, Drosophila melanogaster
gtcttaattgaggtcccactgt

SEQ ID NO: 228609 - DNA, 23 bp, Drosophila melanogaster
tgcctggctggctggatggctgc

SEQ ID NO: 228610 - DNA, 23 bp, Drosophila melanogaster
tctgtatctgtagctgtagctct

SEQ ID NO: 228611 - DNA, 23 bp, Drosophila melanogaster
gtatctgcatctgcatgtgtatg

SEQ ID NO: 228612 - DNA, 23 bp, Drosophila melanogaster
cgctgcctgcctgtctgcctgcc

SEQ ID NO: 228613 - DNA, 23 bp, Drosophila melanogaster
agtcagtgagttagttggttgtt

SEQ ID NO: 228614 - DNA, 23 bp, Drosophila melanogaster
ttgtgtggatgtggatgtggatg

SEQ ID NO: 228615 - DNA, 23 bp, Drosophila melanogaster
aatgcaattgcagctgcatctgg

SEQ ID NO: 228616 - DNA, 19 bp, Drosophila melanogaster
acgagcaagcaataacagt

SEQ ID NO: 228617 - DNA, 19 bp, Drosophila melanogaster
gagagccacagactctggc

SEQ ID NO: 228618 - DNA, 23 bp, Drosophila melanogaster
tggctgagtgcctgggtcgctga

SEQ ID NO: 228619 - DNA, 21 bp, Drosophila melanogaster
tatgtcgcaaggctattccag

SEQ ID NO: 228620 - DNA, 23 bp, Drosophila melanogaster
cagcgaggtatagagttcctacg

SEQ ID NO: 228621 - DNA, 23 bp, Drosophila melanogaster
taggaacttaataccgtgctctt

SEQ ID NO: 228622 - DNA, 23 bp, Drosophila melanogaster
tagcaagtgaaatgtgtttccat

SEQ ID NO: 228623 - DNA, 23 bp, Drosophila melanogaster
cagcgaggtatagagttcctacg

SEQ ID NO: 228624 - DNA, 22 bp, Drosophila melanogaster
taggaacttcataccgtgctct

SEQ ID NO: 228625 - DNA, 19 bp, Drosophila melanogaster
gtatgtatgtatgtatgta

SEQ ID NO: 228626 - DNA, 23 bp, Drosophila melanogaster
tcagtcacagtgactgacagccg

SEQ ID NO: 228627 - DNA, 20 bp, Drosophila melanogaster
atgtgtgtcatgtgtatgtg

SEQ ID NO: 228628 - DNA, 23 bp, Drosophila melanogaster
actgtatctgtgtatctgtatat

SEQ ID NO: 228629 - DNA, 23 bp, Drosophila melanogaster
tgcgtgtgtctgtctgtgtctgg

SEQ ID NO: 228630 - DNA, 21 bp, Drosophila melanogaster
tatgtcgcaaggctattccag

SEQ ID NO: 228631 - DNA, 23 bp, Drosophila melanogaster
tttgtgaccgacactaacgggta

SEQ ID NO: 228632 - DNA, 21 bp, Drosophila melanogaster
aggattactcgtttttgcgat

SEQ ID NO: 228633 - DNA, 21 bp, Drosophila melanogaster
tattcgagccaataagttcgg

SEQ ID NO: 228634 - DNA, 21 bp, Drosophila melanogaster
agcaactgagtatgtctgtca

SEQ ID NO: 228635 - DNA, 23 bp, Drosophila melanogaster
ctgggtctgagtctgtgtttgtg

SEQ ID NO: 228636 - DNA, 23 bp, Drosophila melanogaster
tgtgtttcgctttggtgtgatca

SEQ ID NO: 228637 - DNA, 19 bp, Drosophila melanogaster
acacacactgtcacccgag

SEQ ID NO: 228638 - DNA, 21 bp, Drosophila melanogaster
cagtgtgtgtgtgtgtgtgtg

SEQ ID NO: 228639 - DNA, 23 bp, Drosophila melanogaster
tctggaactgcaactggaactgg

SEQ ID NO: 228640 - DNA, 22 bp, Drosophila melanogaster
caataccatttcatttgtttca

SEQ ID NO: 228641 - DNA, 23 bp, Drosophila melanogaster
gttgagggttgtggtgactctct

SEQ ID NO: 228642 - DNA, 23 bp, Drosophila melanogaster
tatagcatctgcatctgcatctg

SEQ ID NO: 228643 - DNA, 23 bp, Drosophila melanogaster
cattgcaaatgcatctgtatctg

SEQ ID NO: 228644 - DNA, 23 bp, Drosophila melanogaster
aaggacgtgtgtgtgtgtgtgtg

SEQ ID NO: 228645 - DNA, 18 bp, Drosophila melanogaster
attccatttgaaaataag

SEQ ID NO: 228646 - DNA, 23 bp, Drosophila melanogaster
aatgtttattaatatttgacatt

SEQ ID NO: 228647 - DNA, 22 bp, Drosophila melanogaster
tggcaaatgtttccaatctgtg

SEQ ID NO: 228648 - DNA, 23 bp, Drosophila melanogaster
tctcagtcgattttctttgtata

SEQ ID NO: 228649 - DNA, 19 bp, Drosophila melanogaster
aaaagtgaaggaagtgaag

SEQ ID NO: 228650 - DNA, 23 bp, Drosophila melanogaster
aatatttaagtggagcctgcgac

SEQ ID NO: 228651 - DNA, 19 bp, Drosophila melanogaster
taagtcacttgagcgtttg

SEQ ID NO: 228652 - DNA, 20 bp, Drosophila melanogaster
aggcagcgtgtgtacacttg

SEQ ID NO: 228653 - DNA, 23 bp, Drosophila melanogaster
tctgcgtgcgtgtgtgcgtgaaa

SEQ ID NO: 228654 - DNA, 18 bp, Drosophila melanogaster
aatacgtattgtatattt

SEQ ID NO: 228655 - DNA, 23 bp, Drosophila melanogaster
acatgtgcattttctctttattc

SEQ ID NO: 228656 - DNA, 21 bp, Drosophila melanogaster
tactaagtttttgataaaccg

SEQ ID NO: 228657 - DNA, 22 bp, Drosophila melanogaster
tcatcgtatgtatagcatagtt

SEQ ID NO: 228658 - DNA, 23 bp, Drosophila melanogaster
ttatgtacatgcttgtatagatg

SEQ ID NO: 228659 - DNA, 21 bp, Drosophila melanogaster
tttgatgatgatgatgatgat

SEQ ID NO: 228660 - DNA, 23 bp, Drosophila melanogaster
aatgtcgaagagtgtattgtgat

SEQ ID NO: 228661 - DNA, 22 bp, Drosophila melanogaster
aagcaatagcagctttttgttc

SEQ ID NO: 228662 - DNA, 23 bp, Drosophila melanogaster
tatgtatgtatgtatgtgtgagg

SEQ ID NO: 228663 - DNA, 23 bp, Drosophila melanogaster
gctggctggctgactgcctggaa

SEQ ID NO: 228664 - DNA, 19 bp, Drosophila melanogaster
tatgcatataagtatgcac

SEQ ID NO: 228665 - DNA, 21 bp, Drosophila melanogaster
tatgtctgtttatatgtatgt

SEQ ID NO: 228666 - DNA, 22 bp, Drosophila melanogaster
tgtccttgttgcttctttagtt

SEQ ID NO: 228667 - DNA, 22 bp, Drosophila melanogaster
tgtccttgttgcttctttagtt

SEQ ID NO: 228668 - DNA, 23 bp, Drosophila melanogaster
taattgctgctgttgctgttgca

SEQ ID NO: 228669 - DNA, 23 bp, Drosophila melanogaster
ctgcaactgcaactgctgctgct

SEQ ID NO: 228670 - DNA, 22 bp, Drosophila melanogaster
taggtacatatacatatgtgta

SEQ ID NO: 228671 - DNA, 23 bp, Drosophila melanogaster
atatggtttatgtatcttctttg

SEQ ID NO: 228672 - DNA, 20 bp, Drosophila melanogaster
agaccgggcgagtatctgga

SEQ ID NO: 228673 - DNA, 23 bp, Drosophila melanogaster
tgtatataattaggtgtgggtgt

SEQ ID NO: 228674 - DNA, 23 bp, Drosophila melanogaster
tgattgtccaaacgcaattcttg

SEQ ID NO: 228675 - DNA, 23 bp, Drosophila melanogaster
atctatatctatatctatccaca

SEQ ID NO: 228676 - DNA, 23 bp, Drosophila melanogaster
ttatgtatgtgtatttgtagatg

SEQ ID NO: 228677 - DNA, 23 bp, Drosophila melanogaster
tgcatctttactgttgttcatat

SEQ ID NO: 228678 - DNA, 23 bp, Drosophila melanogaster
ttttgattgttgctcagaaagcc

SEQ ID NO: 228679 - DNA, 19 bp, Drosophila melanogaster
agcaataattgaaaccaga

SEQ ID NO: 228680 - DNA, 23 bp, Drosophila melanogaster
tgaacttgagtggctgagttcac

SEQ ID NO: 228681 - DNA, 23 bp, Drosophila melanogaster
tgtattatgatattgtagttcta

SEQ ID NO: 228682 - DNA, 23 bp, Drosophila melanogaster
gagtgactgacttgagtaactga

SEQ ID NO: 228683 - DNA, 21 bp, Drosophila melanogaster
gagtcccagtcagtctctcta

SEQ ID NO: 228684 - DNA, 23 bp, Drosophila melanogaster
ttccactttctgaggctgcatct

SEQ ID NO: 228685 - DNA, 23 bp, Drosophila melanogaster
tctttggttatctagctgtatga

SEQ ID NO: 228686 - DNA, 22 bp, Drosophila melanogaster
ataaagctagcttaccgaagtt

SEQ ID NO: 228687 - DNA, 18 bp, Drosophila melanogaster
tctgtgactcagtgcatc

SEQ ID NO: 228688 - DNA, 22 bp, Drosophila melanogaster
aggtgcattgtagtcgcattgt

SEQ ID NO: 228689 - DNA, 23 bp, Drosophila melanogaster
tacaacttcagtgcaagctctgt

SEQ ID NO: 228690 - DNA, 19 bp, Drosophila melanogaster
tggatcagggcgagatagt

SEQ ID NO: 228691 - DNA, 23 bp, Drosophila melanogaster
atctctctgactctcacactctc

SEQ ID NO: 228692 - DNA, 20 bp, Drosophila melanogaster
taaaagtataatatccttac

SEQ ID NO: 228693 - DNA, 23 bp, Drosophila melanogaster
gatggctggctggctgactgact

SEQ ID NO: 228694 - DNA, 21 bp, Drosophila melanogaster
tatgtcgcaaggctattccag

SEQ ID NO: 228695 - DNA, 22 bp, Drosophila melanogaster
gtcgatcggtgggtcgatcggt

SEQ ID NO: 228696 - DNA, 23 bp, Drosophila melanogaster
ttgactgttgatgatcttcatca

SEQ ID NO: 228697 - DNA, 23 bp, Drosophila melanogaster
ctgcaactgcaactgcaactgaa

SEQ ID NO: 228698 - DNA, 23 bp, Drosophila melanogaster
aggctgtgtgcgaaacttgagat

SEQ ID NO: 228699 - DNA, 21 bp, Drosophila melanogaster
tgaaatggataagaagcgtat

SEQ ID NO: 228700 - DNA, 23 bp, Drosophila melanogaster
aagggaatagtttctgctcggtt

SEQ ID NO: 228701 - DNA, 23 bp, Drosophila melanogaster
cactcgctctgtgcctgtgcgtg

SEQ ID NO: 228702 - DNA, 23 bp, Drosophila melanogaster
caactgactgactgactagctac

SEQ ID NO: 228703 - DNA, 23 bp, Drosophila melanogaster
ttctctcaggttaagagcgtgtg

SEQ ID NO: 228704 - DNA, 23 bp, Drosophila melanogaster
ttggtttacctttctgtatacat

SEQ ID NO: 228705 - DNA, 23 bp, Drosophila melanogaster
tgtctgtccgtccgtatatctgt

SEQ ID NO: 228706 - DNA, 23 bp, Drosophila melanogaster
atacctgcaggtatatatatgac

SEQ ID NO: 228707 - DNA, 22 bp, Drosophila melanogaster
tcactagctgagtaacgggtat

SEQ ID NO: 228708 - DNA, 23 bp, Drosophila melanogaster
gtgtgggtgtggcagtattgtgc

SEQ ID NO: 228709 - DNA, 20 bp, Drosophila melanogaster
acggacagaccctccgtctg

SEQ ID NO: 228710 - DNA, 21 bp, Drosophila melanogaster
tatgtcgcaaggctattccag

SEQ ID NO: 228711 - DNA, 18 bp, Drosophila melanogaster
cttctcgcgaatcgagtc

SEQ ID NO: 228712 - DNA, 23 bp, Drosophila melanogaster
agtccgtgtgtctgtgagtcagt

SEQ ID NO: 228713 - DNA, 23 bp, Drosophila melanogaster
tcagtcacttattcagtcagtca

SEQ ID NO: 228714 - DNA, 22 bp, Drosophila melanogaster
gagcccgagtcaaatagctgac

SEQ ID NO: 228715 - DNA, 22 bp, Drosophila melanogaster
gtctgtccggctgtctgtccgt

SEQ ID NO: 228716 - DNA, 22 bp, Drosophila melanogaster
gacagagctgcgtgtgtgtgag

SEQ ID NO: 228717 - DNA, 23 bp, Drosophila melanogaster
ctcgtcgctgttgtgcctccagt

SEQ ID NO: 228718 - DNA, 23 bp, Drosophila melanogaster
tgaacacaatttgttgtgcttgc

SEQ ID NO: 228719 - DNA, 22 bp, Drosophila melanogaster
tatgtcagtgcaaagtttcggt

SEQ ID NO: 228720 - DNA, 23 bp, Drosophila melanogaster
atgtgagctgatttcgctttgtg

SEQ ID NO: 228721 - DNA, 21 bp, Drosophila melanogaster
ataatttttcaaggataccta

SEQ ID NO: 228722 - DNA, 23 bp, Drosophila melanogaster
gtctctctctgtctgcctctcgc

SEQ ID NO: 228723 - DNA, 23 bp, Drosophila melanogaster
gtgagtgtgtgtgtgtccgtaag

SEQ ID NO: 228724 - DNA, 21 bp, Drosophila melanogaster
agccagagacaatatgttcat

SEQ ID NO: 228725 - DNA, 23 bp, Drosophila melanogaster
gaagtcttctgtttttgttctta

SEQ ID NO: 228726 - DNA, 23 bp, Drosophila melanogaster
aactgactgactgactggctgcc

SEQ ID NO: 228727 - DNA, 22 bp, Drosophila melanogaster
attctgactggctgactgactc

SEQ ID NO: 228728 - DNA, 23 bp, Drosophila melanogaster
tacatttttgttcatattggttt

SEQ ID NO: 228729 - DNA, 23 bp, Drosophila melanogaster
tatgtacgtacatactcatatgt

SEQ ID NO: 228730 - DNA, 20 bp, Drosophila melanogaster
tatgttaggtatacatatgt

SEQ ID NO: 228731 - DNA, 23 bp, Drosophila melanogaster
cagtctgtctgtctgtgcttatg

SEQ ID NO: 228732 - DNA, 18 bp, Drosophila melanogaster
aacatccgtctcgctctg

SEQ ID NO: 228733 - DNA, 22 bp, Drosophila melanogaster
tctgagtatgtatgtatgtatg

SEQ ID NO: 228734 - DNA, 20 bp, Drosophila melanogaster
attaacgaaggttaggaaac

SEQ ID NO: 228735 - DNA, 23 bp, Drosophila melanogaster
agtgcgtgcgtgcgtgcgtgtgt

SEQ ID NO: 228736 - DNA, 20 bp, Drosophila melanogaster
agacaaaagagttgcttcgg

SEQ ID NO: 228737 - DNA, 23 bp, Drosophila melanogaster
gtgtagctcctttgcataaccga

SEQ ID NO: 228738 - DNA, 21 bp, Drosophila melanogaster
tgttgcagacaacacggttgg

SEQ ID NO: 228739 - DNA, 23 bp, Drosophila melanogaster
gtgactgtgtgtgtgtgcctggg

SEQ ID NO: 228740 - DNA, 23 bp, Drosophila melanogaster
tgcgagggtgtgtgtgtgtgtgt

SEQ ID NO: 228741 - DNA, 20 bp, Drosophila melanogaster
ctagttgtatgcatgtatgt

SEQ ID NO: 228742 - DNA, 19 bp, Drosophila melanogaster
tctctcagtgctaagccgc

SEQ ID NO: 228743 - DNA, 20 bp, Drosophila melanogaster
attttttgttttagttggcc

SEQ ID NO: 228744 - DNA, 23 bp, Drosophila melanogaster
cctggtgtctttgtatctatttc

SEQ ID NO: 228745 - DNA, 22 bp, Drosophila melanogaster
tccacagcattagaaatcacat

SEQ ID NO: 228746 - DNA, 23 bp, Drosophila melanogaster
cttggcactgggagaattcacag

SEQ ID NO: 228747 - DNA, 19 bp, Drosophila melanogaster
tattattctgtggttctgc

SEQ ID NO: 228748 - DNA, 23 bp, Drosophila melanogaster
tctgtccgtccgtccgtctgtcc

SEQ ID NO: 228749 - DNA, 22 bp, Drosophila melanogaster
gtgtcagtgtgagtgtgcgtgt

SEQ ID NO: 228750 - DNA, 23 bp, Drosophila melanogaster
atattatattgaaaggttattaa

SEQ ID NO: 228751 - DNA, 21 bp, Drosophila melanogaster
tatatgtatgtatatgtatgt

SEQ ID NO: 228752 - DNA, 23 bp, Drosophila melanogaster
tatatgtatatgtatatgtatgt

SEQ ID NO: 228753 - DNA, 23 bp, Drosophila melanogaster
gttaatgaagtgggactgtattg

SEQ ID NO: 228754 - DNA, 21 bp, Drosophila melanogaster
aatctccttcttcagcttcgt

SEQ ID NO: 228755 - DNA, 21 bp, Drosophila melanogaster
tatcatcgatttggaatgttt

SEQ ID NO: 228756 - DNA, 23 bp, Drosophila melanogaster
tgtcagaaaagtcacaccagaat

SEQ ID NO: 228757 - DNA, 23 bp, Drosophila melanogaster
ctgaaactggatgtggaactgga

SEQ ID NO: 228758 - DNA, 23 bp, Drosophila melanogaster
ggggtggctctctctcactcact

SEQ ID NO: 228759 - DNA, 23 bp, Drosophila melanogaster
ttgctgcaactgcaactgcaact

SEQ ID NO: 228760 - DNA, 23 bp, Drosophila melanogaster
ctggctgactggctggctggctg

SEQ ID NO: 228761 - DNA, 21 bp, Drosophila melanogaster
ttgttccttcttatggccttt

SEQ ID NO: 228762 - DNA, 23 bp, Drosophila melanogaster
ttaatctgcaactccatgtgcat

SEQ ID NO: 228763 - DNA, 21 bp, Drosophila melanogaster
acacacactgggattgtgggg

SEQ ID NO: 228764 - DNA, 19 bp, Drosophila melanogaster
tcactcactcacatccgcc

SEQ ID NO: 228765 - DNA, 23 bp, Drosophila melanogaster
cattcagtcagaagtgacagacg

SEQ ID NO: 228766 - DNA, 22 bp, Drosophila melanogaster
tagcaccattcgaaatcagtgc

SEQ ID NO: 228767 - DNA, 23 bp, Drosophila melanogaster
aatgactgtgtgtgactctctcg

SEQ ID NO: 228768 - DNA, 22 bp, Drosophila melanogaster
cactgactcactgactgaatgc

SEQ ID NO: 228769 - DNA, 19 bp, Drosophila melanogaster
tacccagtggatggcaaag

SEQ ID NO: 228770 - DNA, 23 bp, Drosophila melanogaster
acatatgtacatatgtatttatg

SEQ ID NO: 228771 - DNA, 23 bp, Drosophila melanogaster
tgactgactgactggctggctga

SEQ ID NO: 228772 - DNA, 20 bp, Drosophila melanogaster
atgcacgacaataaaatgtg

SEQ ID NO: 228773 - DNA, 23 bp, Drosophila melanogaster
gtgatgtatgcatgtatgtatgt

SEQ ID NO: 228774 - DNA, 21 bp, Drosophila melanogaster
aggcaattaaatcgtatgtca

SEQ ID NO: 228775 - DNA, 18 bp, Drosophila melanogaster
agcagcagcaactgcagc

SEQ ID NO: 228776 - DNA, 23 bp, Drosophila melanogaster
ctgcaactgcatctgcatctgaa

SEQ ID NO: 228777 - DNA, 23 bp, Drosophila melanogaster
tgcctgggtgcctcggtgcctgg

SEQ ID NO: 228778 - DNA, 23 bp, Drosophila melanogaster
gctggctggctggctggctggct

SEQ ID NO: 228779 - DNA, 23 bp, Drosophila melanogaster
tgcgtgtctgtctgtatgtctgc

SEQ ID NO: 228780 - DNA, 22 bp, Drosophila melanogaster
tgtgtctgtgtatgctgtttgt

SEQ ID NO: 228781 - DNA, 23 bp, Drosophila melanogaster
cttctgtatcttttgcagtgtga

SEQ ID NO: 228782 - DNA, 19 bp, Drosophila melanogaster
atgctgggtaatgaatgtg

SEQ ID NO: 228783 - DNA, 23 bp, Drosophila melanogaster
gcttttcacgatgataatgatag

SEQ ID NO: 228784 - DNA, 23 bp, Drosophila melanogaster
atcatgatcatcatgatgatggt

SEQ ID NO: 228785 - DNA, 23 bp, Drosophila melanogaster
ttgatgttgatgttgatgctgct

SEQ ID NO: 228786 - DNA, 19 bp, Drosophila melanogaster
tggcatggtcacggcattg

SEQ ID NO: 228787 - DNA, 19 bp, Drosophila melanogaster
tgtgtgtttgtgataaagc

SEQ ID NO: 228788 - DNA, 21 bp, Drosophila melanogaster
atatgtacatatgcatacatt

SEQ ID NO: 228789 - DNA, 23 bp, Drosophila melanogaster
tgcctggctgcctgactgcctgg

SEQ ID NO: 228790 - DNA, 23 bp, Drosophila melanogaster
actctcactcgcacacataccac

SEQ ID NO: 228791 - DNA, 23 bp, Drosophila melanogaster
aacctccaacacagattccattc

SEQ ID NO: 228792 - DNA, 23 bp, Drosophila melanogaster
gaaagtgcaactgcaactgctgc

SEQ ID NO: 228793 - DNA, 18 bp, Drosophila melanogaster
tcagagttaagccaaccg

SEQ ID NO: 228794 - DNA, 23 bp, Drosophila melanogaster
agcgtctggctggctctttgcca

SEQ ID NO: 228795 - DNA, 23 bp, Drosophila melanogaster
tttgtagcttgtatagttttcat

SEQ ID NO: 228796 - DNA, 22 bp, Drosophila melanogaster
ttaagcaacttcaccgcgctgt

SEQ ID NO: 228797 - DNA, 21 bp, Drosophila melanogaster
ctctgcctctcactcacactt

SEQ ID NO: 228798 - DNA, 19 bp, Drosophila melanogaster
gagggagaatttcgtgtgt

SEQ ID NO: 228799 - DNA, 23 bp, Drosophila melanogaster
ttcaatgtcgattagttatattt

SEQ ID NO: 228800 - DNA, 23 bp, Drosophila melanogaster
acatgtgtgtgtgtgtgtgtgcg

SEQ ID NO: 228801 - DNA, 22 bp, Drosophila melanogaster
aaagtatacgaacaggtatata

SEQ ID NO: 228802 - DNA, 23 bp, Drosophila melanogaster
atatatacatgttcttgtacctt

SEQ ID NO: 228803 - DNA, 22 bp, Drosophila melanogaster
ttctgtgtctgtgagtccgtgt

SEQ ID NO: 228804 - DNA, 23 bp, Drosophila melanogaster
actcacttctgtgtctgtctgtc

SEQ ID NO: 228805 - DNA, 23 bp, Drosophila melanogaster
tgtgtgtgtgtgtgagtgcgaag

SEQ ID NO: 228806 - DNA, 18 bp, Drosophila melanogaster
tttacacacccacacaca

SEQ ID NO: 228807 - DNA, 21 bp, Drosophila melanogaster
taacactgtgtatatatgtgc

SEQ ID NO: 228808 - DNA, 23 bp, Drosophila melanogaster
ttattctgctagttgtttgtggt

SEQ ID NO: 228809 - DNA, 23 bp, Drosophila melanogaster
cacagagtctctgtttctgtttg

SEQ ID NO: 228810 - DNA, 21 bp, Drosophila melanogaster
ttcggtgttgaaggcaatgtc

SEQ ID NO: 228811 - DNA, 22 bp, Drosophila melanogaster
agagcatcactgtgcgttacct

SEQ ID NO: 228812 - DNA, 23 bp, Drosophila melanogaster
tgactgttcagactgtgctcatt

SEQ ID NO: 228813 - DNA, 23 bp, Drosophila melanogaster
gactggctgactgactgactgag

SEQ ID NO: 228814 - DNA, 23 bp, Drosophila melanogaster
tgaactcctcgttgagacagtca

SEQ ID NO: 228815 - DNA, 22 bp, Drosophila melanogaster
agcaacaatatcagcatgggtt

SEQ ID NO: 228816 - DNA, 23 bp, Drosophila melanogaster
tagcatgtatgtatgtatgtatg

SEQ ID NO: 228817 - DNA, 19 bp, Drosophila melanogaster
agcgtgtttttgcgctagt

SEQ ID NO: 228818 - DNA, 20 bp, Drosophila melanogaster
tatcgattgcagcgagctga

SEQ ID NO: 228819 - DNA, 23 bp, Drosophila melanogaster
tcactgatgacagtcagctgttt

SEQ ID NO: 228820 - DNA, 23 bp, Drosophila melanogaster
tcagcgggatatctatatgtatg

SEQ ID NO: 228821 - DNA, 23 bp, Drosophila melanogaster
aagtacgtatggatgaattcaga

SEQ ID NO: 228822 - DNA, 21 bp, Drosophila melanogaster
tatgtcgcaaggctattccag

SEQ ID NO: 228823 - DNA, 23 bp, Drosophila melanogaster
gtgcagtcagtcagtcagtcagt

SEQ ID NO: 228824 - DNA, 23 bp, Drosophila melanogaster
gcatgtgcatgtgcatgtgcatg

SEQ ID NO: 228825 - DNA, 23 bp, Drosophila melanogaster
tgtgtgcatgtgttgctgctgca

SEQ ID NO: 228826 - DNA, 22 bp, Drosophila melanogaster
tgggaactggaactgcaattgg

SEQ ID NO: 228827 - DNA, 18 bp, Drosophila melanogaster
atcgaccttgaagagcac

SEQ ID NO: 228828 - DNA, 19 bp, Drosophila melanogaster
tgtatgtgtgttataatcc

SEQ ID NO: 228829 - DNA, 23 bp, Drosophila melanogaster
ggagtcttttgttattgttgtgc

SEQ ID NO: 228830 - DNA, 22 bp, Drosophila melanogaster
ttacacgcagagaaaatttgca

SEQ ID NO: 228831 - DNA, 23 bp, Drosophila melanogaster
tggaaatgtaatctgattagagg

SEQ ID NO: 228832 - DNA, 19 bp, Drosophila melanogaster
ttccaaccttgattgttgc

SEQ ID NO: 228833 - DNA, 21 bp, Drosophila melanogaster
ctagtgagtatgtgtgtgtgc

SEQ ID NO: 228834 - DNA, 23 bp, Drosophila melanogaster
agagtgtctctgtgtctctggac

SEQ ID NO: 228835 - DNA, 21 bp, Drosophila melanogaster
aatcgtatagaacaggggaag

SEQ ID NO: 228836 - DNA, 21 bp, Drosophila melanogaster
tgactgcgagacagcctttga

SEQ ID NO: 228837 - DNA, 19 bp, Drosophila melanogaster
tgtgggtgtgggcctggct

SEQ ID NO: 228838 - DNA, 21 bp, Drosophila melanogaster
tctatggtctggcatctgttg

SEQ ID NO: 228839 - DNA, 23 bp, Drosophila melanogaster
ggctggctgttgatgctgtgatg

SEQ ID NO: 228840 - DNA, 23 bp, Drosophila melanogaster
tcagatgtctgtcagtcaggcag

SEQ ID NO: 228841 - DNA, 23 bp, Drosophila melanogaster
tgtgcgtgtgtgtgtgagtgtgc

SEQ ID NO: 228842 - DNA, 23 bp, Drosophila melanogaster
agtcactcagttagtcattcagc

SEQ ID NO: 228843 - DNA, 23 bp, Drosophila melanogaster
tgactgtggctgtgactgtgact

SEQ ID NO: 228844 - DNA, 19 bp, Drosophila melanogaster
gagagctcaagagagaaaa

SEQ ID NO: 228845 - DNA, 23 bp, Drosophila melanogaster
ctctttctctctctggcagctgt

SEQ ID NO: 228846 - DNA, 23 bp, Drosophila melanogaster
atgtcgtaaagcagctgagtgtg

SEQ ID NO: 228847 - DNA, 23 bp, Drosophila melanogaster
ttggtttctgtcggtctcttggg

SEQ ID NO: 228848 - DNA, 23 bp, Drosophila melanogaster
tcatcatcgtacactctgactca

SEQ ID NO: 228849 - DNA, 23 bp, Drosophila melanogaster
tctgcgactgcaactgcatttgg

SEQ ID NO: 228850 - DNA, 22 bp, Drosophila melanogaster
agttgagtggattgtcgagtgg

SEQ ID NO: 228851 - DNA, 23 bp, Drosophila melanogaster
ggcgaaaccttgaacaagcctgt

SEQ ID NO: 228852 - DNA, 23 bp, Drosophila melanogaster
tatggcacgcaatttgtttggtt

SEQ ID NO: 228853 - DNA, 22 bp, Drosophila melanogaster
atttgttgtcgtgcagctgatg

SEQ ID NO: 228854 - DNA, 23 bp, Drosophila melanogaster
gtagctgcaactgcaactgcaat

SEQ ID NO: 228855 - DNA, 23 bp, Drosophila melanogaster
tgaacacagctggtggtatccag

SEQ ID NO: 228856 - DNA, 23 bp, Drosophila melanogaster
tgtcaggagtgcatttgcactga

SEQ ID NO: 228857 - DNA, 23 bp, Drosophila melanogaster
taaatgcactatctggtacgaca

SEQ ID NO: 228858 - DNA, 22 bp, Drosophila melanogaster
tggcagtgtggttagctggttg

SEQ ID NO: 228859 - DNA, 22 bp, Drosophila melanogaster
attcacagccactatcttcact

SEQ ID NO: 228860 - DNA, 22 bp, Drosophila melanogaster
tcactgggctttgtttatctca

SEQ ID NO: 228861 - DNA, 23 bp, Drosophila melanogaster
aacacattcagcaaacattacac

SEQ ID NO: 228862 - DNA, 23 bp, Drosophila melanogaster
gtgcatatatctacatgcacgaa

SEQ ID NO: 228863 - DNA, 22 bp, Drosophila melanogaster
agcagaatatcttacaggtaag

SEQ ID NO: 228864 - DNA, 23 bp, Drosophila melanogaster
tataatgcttgcttttcatagga

SEQ ID NO: 228865 - DNA, 18 bp, Drosophila melanogaster
acgcacagaagtaggggc

SEQ ID NO: 228866 - DNA, 23 bp, Drosophila melanogaster
ctgtgactctgtggctgtggctg

SEQ ID NO: 228867 - DNA, 21 bp, Drosophila melanogaster
agtctgcgtgtgtgtgtgtgt

SEQ ID NO: 228868 - DNA, 23 bp, Drosophila melanogaster
atgcaagtgcaatggtatctgag

SEQ ID NO: 228869 - DNA, 22 bp, Drosophila melanogaster
atgcatgtatatatatgtgtct

SEQ ID NO: 228870 - DNA, 21 bp, Drosophila melanogaster
tatatgtcactatatatgtgt

SEQ ID NO: 228871 - DNA, 18 bp, Drosophila melanogaster
gaaagtggaaattgtttc

SEQ ID NO: 228872 - DNA, 22 bp, Drosophila melanogaster
attctgcggccacaggaggtac

SEQ ID NO: 228873 - DNA, 23 bp, Drosophila melanogaster
gtctctctcactgggtttctgga

SEQ ID NO: 228874 - DNA, 21 bp, Drosophila melanogaster
gtctgtctgtcagtccatctg

SEQ ID NO: 228875 - DNA, 20 bp, Drosophila melanogaster
tgtgccttgagttagggttt

SEQ ID NO: 228876 - DNA, 21 bp, Drosophila melanogaster
acacacgcacacattcgggga

SEQ ID NO: 228877 - DNA, 23 bp, Drosophila melanogaster
atatttccagttcaagcgttttg

SEQ ID NO: 228878 - DNA, 20 bp, Drosophila melanogaster
tgtatctatctatctcactg

SEQ ID NO: 228879 - DNA, 23 bp, Drosophila melanogaster
ctctcaagtgtttcgtgtttgtg

SEQ ID NO: 228880 - DNA, 21 bp, Drosophila melanogaster
ttgtgcactttatgcagttgt

SEQ ID NO: 228881 - DNA, 23 bp, Drosophila melanogaster
gtctgtatgtctgtctgtctgcc

SEQ ID NO: 228882 - DNA, 23 bp, Drosophila melanogaster
tgtgtctgtgagtcagtctggcg

SEQ ID NO: 228883 - DNA, 23 bp, Drosophila melanogaster
ctgctgctgatgctgctgctgct

SEQ ID NO: 228884 - DNA, 23 bp, Drosophila melanogaster
tgtggctgtctgtctgtctggcg

SEQ ID NO: 228885 - DNA, 23 bp, Drosophila melanogaster
cactcggtgtctctctctctctc

SEQ ID NO: 228886 - DNA, 22 bp, Drosophila melanogaster
tagtgcattttcataagtgtgt

SEQ ID NO: 228887 - DNA, 21 bp, Drosophila melanogaster
tgtgcttggcattggcagtgc

SEQ ID NO: 228888 - DNA, 23 bp, Drosophila melanogaster
attgcttctgattatgtacttga

SEQ ID NO: 228889 - DNA, 21 bp, Drosophila melanogaster
aagagttgtcattgtgttgtt

SEQ ID NO: 228890 - DNA, 23 bp, Drosophila melanogaster
ccgtctcacactccgtgtttccc

SEQ ID NO: 228891 - DNA, 20 bp, Drosophila melanogaster
attcgaattgcagctcagac

SEQ ID NO: 228892 - DNA, 23 bp, Drosophila melanogaster
acgtatactgaatgtatcctgag

SEQ ID NO: 228893 - DNA, 23 bp, Drosophila melanogaster
ggtataccttcagtatacgtaac

SEQ ID NO: 228894 - DNA, 20 bp, Drosophila melanogaster
tgactctatatatgtatgta

SEQ ID NO: 228895 - DNA, 18 bp, Drosophila melanogaster
acatgtatgtgtatcggg

SEQ ID NO: 228896 - DNA, 21 bp, Drosophila melanogaster
aggtatacacacacacgcaca

SEQ ID NO: 228897 - DNA, 22 bp, Drosophila melanogaster
tcaacctttttaaagccatttt

SEQ ID NO: 228898 - DNA, 19 bp, Drosophila melanogaster
tatctgggtgttttggcat

SEQ ID NO: 228899 - DNA, 23 bp, Drosophila melanogaster
attctggcttttctgtctgaggt

SEQ ID NO: 228900 - DNA, 23 bp, Drosophila melanogaster
aagagtacatgttctgcatcgga

SEQ ID NO: 228901 - DNA, 22 bp, Drosophila melanogaster
agacgggtagtgttcctggtca

SEQ ID NO: 228902 - DNA, 20 bp, Drosophila melanogaster
tatagctagcaattcgtatg

SEQ ID NO: 228903 - DNA, 23 bp, Drosophila melanogaster
tcagtacagcatcagcatcagca

SEQ ID NO: 228904 - DNA, 23 bp, Drosophila melanogaster
ttgtgtgtgacagtttttcgtgt

SEQ ID NO: 228905 - DNA, 23 bp, Drosophila melanogaster
atccgtccgtctgtctgtctgtc

SEQ ID NO: 228906 - DNA, 23 bp, Drosophila melanogaster
caatttttgattttgattactcg

SEQ ID NO: 228907 - DNA, 23 bp, Drosophila melanogaster
tgtctgactgactgaatgactga

SEQ ID NO: 228908 - DNA, 23 bp, Drosophila melanogaster
aatgcaactgcaactgcaactgc

SEQ ID NO: 228909 - DNA, 21 bp, Drosophila melanogaster
tgacgaactaactgactctct

SEQ ID NO: 228910 - DNA, 23 bp, Drosophila melanogaster
tgggagagtgtgtaaattgtctt

SEQ ID NO: 228911 - DNA, 22 bp, Drosophila melanogaster
tatccccctggtcgaaatctgt

SEQ ID NO: 228912 - DNA, 23 bp, Drosophila melanogaster
gtgtgtgagcttgtgttttggaa

SEQ ID NO: 228913 - DNA, 23 bp, Drosophila melanogaster
cgtgactggttttactgtctctg

SEQ ID NO: 228914 - DNA, 20 bp, Drosophila melanogaster
tatccagtgctttacttacc

SEQ ID NO: 228915 - DNA, 19 bp, Drosophila melanogaster
gggaactggatgggattcg

SEQ ID NO: 228916 - DNA, 23 bp, Drosophila melanogaster
atgtatgtatgtatgtatatgcg

SEQ ID NO: 228917 - DNA, 19 bp, Drosophila melanogaster
accaaaacacacactcgca

SEQ ID NO: 228918 - DNA, 19 bp, Drosophila melanogaster
tgtgtggcaggcaaaaagg

SEQ ID NO: 228919 - DNA, 22 bp, Drosophila melanogaster
ttaattgtaaagaagtttcgag

SEQ ID NO: 228920 - DNA, 20 bp, Drosophila melanogaster
gtggagagcgtgctgactga

SEQ ID NO: 228921 - DNA, 22 bp, Drosophila melanogaster
aattgagaatttcaagttgtga

SEQ ID NO: 228922 - DNA, 23 bp, Drosophila melanogaster
tcctgacacactcacacacacac

SEQ ID NO: 228923 - DNA, 22 bp, Drosophila melanogaster
ttgcagtagtcatgtaatcgca

SEQ ID NO: 228924 - DNA, 20 bp, Drosophila melanogaster
ctctgactgactggctggct

SEQ ID NO: 228925 - DNA, 19 bp, Drosophila melanogaster
taaagtgggttgcaattct

SEQ ID NO: 228926 - DNA, 23 bp, Drosophila melanogaster
tgaggaagagcaagtgaaagtgg

SEQ ID NO: 228927 - DNA, 23 bp, Drosophila melanogaster
aatggtactaattgaaatcatat

SEQ ID NO: 228928 - DNA, 22 bp, Drosophila melanogaster
tgagcaagttgcatgttttttt

SEQ ID NO: 228929 - DNA, 23 bp, Drosophila melanogaster
ttgactgactgactgactggctg

SEQ ID NO: 228930 - DNA, 23 bp, Drosophila melanogaster
tgtgtctgcgtctgtgtctggat

SEQ ID NO: 228931 - DNA, 23 bp, Drosophila melanogaster
acacgctaacattctgtttgtat

SEQ ID NO: 228932 - DNA, 23 bp, Drosophila melanogaster
ttattgctgtgctactgctactg

SEQ ID NO: 228933 - DNA, 22 bp, Drosophila melanogaster
atttgctaatgataagcctctg

SEQ ID NO: 228934 - DNA, 23 bp, Drosophila melanogaster
gctggcaacatgttctagctgtc

SEQ ID NO: 228935 - DNA, 18 bp, Drosophila melanogaster
gccattgtacagacttgg

SEQ ID NO: 228936 - DNA, 23 bp, Drosophila melanogaster
tcgctcagtgggtcactggatgg

SEQ ID NO: 228937 - DNA, 22 bp, Drosophila melanogaster
tctctctatctctgccatgttt

SEQ ID NO: 228938 - DNA, 23 bp, Drosophila melanogaster
acacacactcactctgtgccgct

SEQ ID NO: 228939 - DNA, 23 bp, Drosophila melanogaster
gcagtcagtcagtcagtcagtcc

SEQ ID NO: 228940 - DNA, 23 bp, Drosophila melanogaster
ataaaatgcagaaaaggatgttc

SEQ ID NO: 228941 - DNA, 22 bp, Drosophila melanogaster
caactgctgcaactgcaactgc

SEQ ID NO: 228942 - DNA, 23 bp, Drosophila melanogaster
aactgcaactgcaactgcagcac

SEQ ID NO: 228943 - DNA, 23 bp, Drosophila melanogaster
tagtatagtatagtatatagttt

SEQ ID NO: 228944 - DNA, 18 bp, Drosophila melanogaster
tgcttaagtgatcatatt

SEQ ID NO: 228945 - DNA, 19 bp, Drosophila melanogaster
tgtcgcaggataccttggt

SEQ ID NO: 228946 - DNA, 23 bp, Drosophila melanogaster
gagcaagagcaagagcaactgca

SEQ ID NO: 228947 - DNA, 18 bp, Drosophila melanogaster
gtattgtagattggggat

SEQ ID NO: 228948 - DNA, 23 bp, Drosophila melanogaster
tagtggagtcaggcagtggctat

SEQ ID NO: 228949 - DNA, 22 bp, Drosophila melanogaster
acactcgcagtggcacacaact

SEQ ID NO: 228950 - DNA, 23 bp, Drosophila melanogaster
acattgcacttgtcccggcctat

SEQ ID NO: 228951 - DNA, 22 bp, Drosophila melanogaster
atttatgtagatctgctagtgt

SEQ ID NO: 228952 - DNA, 21 bp, Drosophila melanogaster
atatagtacgtgtatatgtat

SEQ ID NO: 228953 - DNA, 18 bp, Drosophila melanogaster
tttggataaacagaaaat

SEQ ID NO: 228954 - DNA, 23 bp, Drosophila melanogaster
gtcggtctgtcggtctgtcggtc

SEQ ID NO: 228955 - DNA, 23 bp, Drosophila melanogaster
gactgagtgtggagtgtgtgtgc

SEQ ID NO: 228956 - DNA, 20 bp, Drosophila melanogaster
tgagagaacacacactgcac

SEQ ID NO: 228957 - DNA, 23 bp, Drosophila melanogaster
ttgtatgcacacaaaggaaatgc

SEQ ID NO: 228958 - DNA, 23 bp, Drosophila melanogaster
aaatgtgtgtgaatgtgtttaca

SEQ ID NO: 228959 - DNA, 22 bp, Drosophila melanogaster
atttgaagaatgttgaatagtt

SEQ ID NO: 228960 - DNA, 21 bp, Drosophila melanogaster
tgcctggctgcgagtttgcca

SEQ ID NO: 228961 - DNA, 23 bp, Drosophila melanogaster
tcctggccgtgagtgtgtacaca

SEQ ID NO: 228962 - DNA, 21 bp, Drosophila melanogaster
agtgctttactcgcacactca

SEQ ID NO: 228963 - DNA, 19 bp, Drosophila melanogaster
tgtctctgtatccatgtgt

SEQ ID NO: 228964 - DNA, 20 bp, Drosophila melanogaster
tatgagtgtgcctatgctgt

SEQ ID NO: 228965 - DNA, 23 bp, Drosophila melanogaster
gcaacagtgtctcagttgcttgt

SEQ ID NO: 228966 - DNA, 21 bp, Drosophila melanogaster
tggcatggtggctcgatggca

SEQ ID NO: 228967 - DNA, 21 bp, Drosophila melanogaster
tcagtggagtggcacagacac

SEQ ID NO: 228968 - DNA, 23 bp, Drosophila melanogaster
tttctggctgtgactctgactct

SEQ ID NO: 228969 - DNA, 21 bp, Drosophila melanogaster
tctccgggtgaaatacggcca

SEQ ID NO: 228970 - DNA, 23 bp, Drosophila melanogaster
tacgtatccttgatgcagccaaa

SEQ ID NO: 228971 - DNA, 20 bp, Drosophila melanogaster
tgagtagcagcaagtacgag

SEQ ID NO: 228972 - DNA, 23 bp, Drosophila melanogaster
gcgtgtgagtgtgtctattatca

SEQ ID NO: 228973 - DNA, 19 bp, Drosophila melanogaster
tctcacacacacatacacg

SEQ ID NO: 228974 - DNA, 18 bp, Drosophila melanogaster
tgaggttttgtacgcaaa

SEQ ID NO: 228975 - DNA, 20 bp, Drosophila melanogaster
agtgtctgttgccaaatgct

SEQ ID NO: 228976 - DNA, 23 bp, Drosophila melanogaster
ctgagtgactgactggctggctg

SEQ ID NO: 228977 - DNA, 18 bp, Drosophila melanogaster
agctgcagagtttatatt

SEQ ID NO: 228978 - DNA, 18 bp, Drosophila melanogaster
tatatttatccagcaaaa

SEQ ID NO: 228979 - DNA, 23 bp, Drosophila melanogaster
ttttgcacatgtgacgagcaata

SEQ ID NO: 228980 - DNA, 23 bp, Drosophila melanogaster
gtctgtctgtctgtctgtgggtg

SEQ ID NO: 228981 - DNA, 19 bp, Drosophila melanogaster
tctcgcacacacactcgca

SEQ ID NO: 228982 - DNA, 18 bp, Drosophila melanogaster
gtcctgtgtgtgtgtgtg

SEQ ID NO: 228983 - DNA, 22 bp, Drosophila melanogaster
tgactagatccacactcattaa

SEQ ID NO: 228984 - DNA, 23 bp, Drosophila melanogaster
gagtgactgactggctgactggc

SEQ ID NO: 228985 - DNA, 23 bp, Drosophila melanogaster
agcatgtgtgcgtgtgtgtgtgt

SEQ ID NO: 228986 - DNA, 22 bp, Drosophila melanogaster
ctgtgtgcctgcctggctggct

SEQ ID NO: 228987 - DNA, 23 bp, Drosophila melanogaster
gcctgactttatagcttcagatc

SEQ ID NO: 228988 - DNA, 23 bp, Drosophila melanogaster
ttctatcgctctgtatgtcaaga

SEQ ID NO: 228989 - DNA, 20 bp, Drosophila melanogaster
tctgggtccctgtatcgctg

SEQ ID NO: 228990 - DNA, 23 bp, Drosophila melanogaster
tgagaccatcgttatcgaatgtt

SEQ ID NO: 228991 - DNA, 23 bp, Drosophila melanogaster
ataaacagagatatgccaaatgt

SEQ ID NO: 228992 - DNA, 23 bp, Drosophila melanogaster
atgtggatgtggatgtggatgtg

SEQ ID NO: 228993 - DNA, 23 bp, Drosophila melanogaster
gctgactggctgactggctgact

SEQ ID NO: 228994 - DNA, 22 bp, Drosophila melanogaster
agacagaccagtcagtccacac

SEQ ID NO: 228995 - DNA, 22 bp, Drosophila melanogaster
aggattgtatggatgtgtgtgc

SEQ ID NO: 228996 - DNA, 23 bp, Drosophila melanogaster
ctctgtcagtgagtgagttgtgt

SEQ ID NO: 228997 - DNA, 21 bp, Drosophila melanogaster
actcttagcaagtgtctcgct

SEQ ID NO: 228998 - DNA, 20 bp, Drosophila melanogaster
atatgtttatagtgtgtaac

SEQ ID NO: 228999 - DNA, 18 bp, Drosophila melanogaster
actaaagaactttgtagc

SEQ ID NO: 229000 - DNA, 23 bp, Drosophila melanogaster
ccagagtgcgtgtgtctgcgtgt

SEQ ID NO: 229001 - DNA, 23 bp, Drosophila melanogaster
atgtatgtatgtttgttgaagaa

SEQ ID NO: 229002 - DNA, 18 bp, Drosophila melanogaster
caatagaaatgccaatgc

SEQ ID NO: 229003 - DNA, 20 bp, Drosophila melanogaster
tcggtcggtgggtgggagcc

SEQ ID NO: 229004 - DNA, 22 bp, Drosophila melanogaster
ccagaccgtctctctcacgctc

SEQ ID NO: 229005 - DNA, 21 bp, Drosophila melanogaster
actcttagcaagtgtctcgct

SEQ ID NO: 229006 - DNA, 23 bp, Drosophila melanogaster
tgtgtgtgtgtgtgactgccata

SEQ ID NO: 229007 - DNA, 23 bp, Drosophila melanogaster
cactgtctctctctctgctctcg

SEQ ID NO: 229008 - DNA, 19 bp, Drosophila melanogaster
tggcgagttgaggggtatg

SEQ ID NO: 229009 - DNA, 18 bp, Drosophila melanogaster
tggctcagacggcagctg

SEQ ID NO: 229010 - DNA, 23 bp, Drosophila melanogaster
tatttctgcaagtgtatctgcta

SEQ ID NO: 229011 - DNA, 23 bp, Drosophila melanogaster
ctgttgatgttgttgatgctgct

SEQ ID NO: 229012 - DNA, 23 bp, Drosophila melanogaster
tcgttcttccttcaatttcgaat

SEQ ID NO: 229013 - DNA, 22 bp, Drosophila melanogaster
ttctccatttgttttgctgatc

SEQ ID NO: 229014 - DNA, 23 bp, Drosophila melanogaster
aaaatgcaaaagtttcggtttct

SEQ ID NO: 229015 - DNA, 23 bp, Drosophila melanogaster
atatgtatgtatgtatatgtgag

SEQ ID NO: 229016 - DNA, 23 bp, Drosophila melanogaster
tacacacagacacacactcgctg

SEQ ID NO: 229017 - DNA, 23 bp, Drosophila melanogaster
gagtgtctgtctgtctgtgtggt

SEQ ID NO: 229018 - DNA, 18 bp, Drosophila melanogaster
ttcagctggccaaaggtg

SEQ ID NO: 229019 - DNA, 23 bp, Drosophila melanogaster
gagtacagtgggtacagtggggc

SEQ ID NO: 229020 - DNA, 19 bp, Drosophila melanogaster
gcactgactcactgactca

SEQ ID NO: 229021 - DNA, 23 bp, Drosophila melanogaster
ctgtgtgggtgtgcaaagtgtgt

SEQ ID NO: 229022 - DNA, 23 bp, Drosophila melanogaster
atcgatttgtctctgtcgctgtc

SEQ ID NO: 229023 - DNA, 23 bp, Drosophila melanogaster
tggccctgctcctgctgctgcag

SEQ ID NO: 229024 - DNA, 23 bp, Drosophila melanogaster
aatcggttagaattcgtatgagc

SEQ ID NO: 229025 - DNA, 23 bp, Drosophila melanogaster
tcgattttgtgccgcgtgcgtgt

SEQ ID NO: 229026 - DNA, 18 bp, Drosophila melanogaster
tgtatgtatgtatattcg

SEQ ID NO: 229027 - DNA, 20 bp, Drosophila melanogaster
attgcatggcaaagctgtcg

SEQ ID NO: 229028 - DNA, 23 bp, Drosophila melanogaster
tgtcgttctctgtctctgtcact

SEQ ID NO: 229029 - DNA, 20 bp, Drosophila melanogaster
tgatgatgatgatgatgatg

SEQ ID NO: 229030 - DNA, 23 bp, Drosophila melanogaster
ccgtgcgtccgtccgtgcgtccg

SEQ ID NO: 229031 - DNA, 23 bp, Drosophila melanogaster
tgtgtctatgtgtgtgtgtgtgg

SEQ ID NO: 229032 - DNA, 23 bp, Drosophila melanogaster
ttgatggttgttgaggcgtttca

SEQ ID NO: 229033 - DNA, 19 bp, Drosophila melanogaster
atcccttaaaaaaccattc

SEQ ID NO: 229034 - DNA, 20 bp, Drosophila melanogaster
agagccggacgaaaatcgat

SEQ ID NO: 229035 - DNA, 22 bp, Drosophila melanogaster
tgtatcgatgttctttctggaa

SEQ ID NO: 229036 - DNA, 22 bp, Drosophila melanogaster
tcgaatttaaacaagtttgcag

SEQ ID NO: 229037 - DNA, 23 bp, Drosophila melanogaster
ctctgtgtgtgtgtgtgtgagcg

SEQ ID NO: 229038 - DNA, 23 bp, Drosophila melanogaster
ttaagtagacattagattggttt

SEQ ID NO: 229039 - DNA, 23 bp, Drosophila melanogaster
tgactgactgactgactgcttca

SEQ ID NO: 229040 - DNA, 23 bp, Drosophila melanogaster
tgtgtgtgtatgtgtgtgcttgt

SEQ ID NO: 229041 - DNA, 23 bp, Drosophila melanogaster
tcgttagcatatcaaaaggtgtc

SEQ ID NO: 229042 - DNA, 23 bp, Drosophila melanogaster
cgactctggctctgtgactccga

SEQ ID NO: 229043 - DNA, 22 bp, Drosophila melanogaster
ggcacacacagtcgcacacaca

SEQ ID NO: 229044 - DNA, 20 bp, Drosophila melanogaster
tgtccagcagaatgatggct

SEQ ID NO: 229045 - DNA, 20 bp, Drosophila melanogaster
ttgtcgctcgctgtgtgtgt

SEQ ID NO: 229046 - DNA, 22 bp, Drosophila melanogaster
aatgtgcgagtgtgtgtgtgct

SEQ ID NO: 229047 - DNA, 23 bp, Drosophila melanogaster
gtgtgtctggctgcgtgtgtgca

SEQ ID NO: 229048 - DNA, 18 bp, Drosophila melanogaster
ctctctatctctctcgtt

SEQ ID NO: 229049 - DNA, 21 bp, Drosophila melanogaster
tcagtcagtcactctctgggc

SEQ ID NO: 229050 - DNA, 22 bp, Drosophila melanogaster
tggaaatgtgtgtgtgaggttg

SEQ ID NO: 229051 - DNA, 23 bp, Drosophila melanogaster
ctgtcagtcagtcagtcagttag

SEQ ID NO: 229052 - DNA, 21 bp, Drosophila melanogaster
agtgcatatggttgtcccact

SEQ ID NO: 229053 - DNA, 23 bp, Drosophila melanogaster
agtctgcttctgtctctgtctgt

SEQ ID NO: 229054 - DNA, 21 bp, Drosophila melanogaster
tgtctgttgattttttttcga

SEQ ID NO: 229055 - DNA, 23 bp, Drosophila melanogaster
gctggctggctggctggctggct

SEQ ID NO: 229056 - DNA, 23 bp, Drosophila melanogaster
gctgagtgtgtgtgtgtgcgtat

SEQ ID NO: 229057 - DNA, 20 bp, Drosophila melanogaster
cacactctcgctcacaccta

SEQ ID NO: 229058 - DNA, 19 bp, Drosophila melanogaster
acagcatgtcgatttccca

SEQ ID NO: 229059 - DNA, 23 bp, Drosophila melanogaster
ggaaagaaatgtagtttgtgaaa

SEQ ID NO: 229060 - DNA, 21 bp, Drosophila melanogaster
tgcattgtacagaagtatgtg

SEQ ID NO: 229061 - DNA, 22 bp, Drosophila melanogaster
gaggaggagcacatggtcaagt

SEQ ID NO: 229062 - DNA, 21 bp, Drosophila melanogaster
tcagtgttttagtagttgtgt

SEQ ID NO: 229063 - DNA, 23 bp, Drosophila melanogaster
tcagtcactgattcacttctggg

SEQ ID NO: 229064 - DNA, 18 bp, Drosophila melanogaster
agccagatgaatggattg

SEQ ID NO: 229065 - DNA, 22 bp, Drosophila melanogaster
gagtgtgcgtttgttttgtgca

SEQ ID NO: 229066 - DNA, 23 bp, Drosophila melanogaster
tcggtcggtcggtgggtcggtca

SEQ ID NO: 229067 - DNA, 23 bp, Drosophila melanogaster
acactgatgggaatgtgattgta

SEQ ID NO: 229068 - DNA, 22 bp, Drosophila melanogaster
tgtcaagaactttctctgtgac

SEQ ID NO: 229069 - DNA, 23 bp, Drosophila melanogaster
catcacagtctgagttcttgctg

SEQ ID NO: 229070 - DNA, 19 bp, Drosophila melanogaster
tggaatgttgttggctttt

SEQ ID NO: 229071 - DNA, 22 bp, Drosophila melanogaster
tctgcctcgctctgtctcactc

SEQ ID NO: 229072 - DNA, 19 bp, Drosophila melanogaster
ggaacagagtggcagtgga

SEQ ID NO: 229073 - DNA, 18 bp, Drosophila melanogaster
ttcatagtctcagtcgtt

SEQ ID NO: 229074 - DNA, 21 bp, Drosophila melanogaster
agtggttaaacatctggcaga

SEQ ID NO: 229075 - DNA, 22 bp, Drosophila melanogaster
tgacacgctctctgtctgtctg

SEQ ID NO: 229076 - DNA, 23 bp, Drosophila melanogaster
tagtctgtctgtctgtctgcatg

SEQ ID NO: 229077 - DNA, 19 bp, Drosophila melanogaster
taaagtgacagcgatatct

SEQ ID NO: 229078 - DNA, 19 bp, Drosophila melanogaster
ggctgaagttgcctgtctg

SEQ ID NO: 229079 - DNA, 18 bp, Drosophila melanogaster
tctaatttaagcggtgag

SEQ ID NO: 229080 - DNA, 20 bp, Drosophila melanogaster
tgtcagtctgtgtgtcggct

SEQ ID NO: 229081 - DNA, 19 bp, Drosophila melanogaster
ttaaatctcacattgcttt

SEQ ID NO: 229082 - DNA, 23 bp, Drosophila melanogaster
acacacacgctttacatagtgag

SEQ ID NO: 229083 - DNA, 23 bp, Drosophila melanogaster
tatgcgtctgtccgtctgtctat

SEQ ID NO: 229084 - DNA, 23 bp, Drosophila melanogaster
tcggtcggtcggtcggtcggtct

SEQ ID NO: 229085 - DNA, 21 bp, Drosophila melanogaster
agttgcacattgtgttaacac

SEQ ID NO: 229086 - DNA, 23 bp, Drosophila melanogaster
acacactgacacaaatacacgac

SEQ ID NO: 229087 - DNA, 21 bp, Drosophila melanogaster
aattctcgatcagcttgctat

SEQ ID NO: 229088 - DNA, 23 bp, Drosophila melanogaster
tatgcatgtatatataggtgttt

SEQ ID NO: 229089 - DNA, 18 bp, Drosophila melanogaster
atctccatgagtaggcaa

SEQ ID NO: 229090 - DNA, 19 bp, Drosophila melanogaster
tgtctgtcagtgggtcagt

SEQ ID NO: 229091 - DNA, 20 bp, Drosophila melanogaster
tgatgctgatgctgtactga

SEQ ID NO: 229092 - DNA, 23 bp, Drosophila melanogaster
tcttgaccaggaacactacccgt

SEQ ID NO: 229093 - DNA, 19 bp, Drosophila melanogaster
agacggacatgggtagtga

SEQ ID NO: 229094 - DNA, 20 bp, Drosophila melanogaster
cagaacatgtactctttgct

SEQ ID NO: 229095 - DNA, 23 bp, Drosophila melanogaster
actgagactgcatctgcatttgg

SEQ ID NO: 229096 - DNA, 23 bp, Drosophila melanogaster
acttggctgtgtctgtgcgtctc

SEQ ID NO: 229097 - DNA, 23 bp, Drosophila melanogaster
tcactgcgactcagtcggtctga

SEQ ID NO: 229098 - DNA, 23 bp, Drosophila melanogaster
accctggcacacacactcagtca

SEQ ID NO: 229099 - DNA, 23 bp, Drosophila melanogaster
aaaagcttgaaaagtgaaagcaa

SEQ ID NO: 229100 - DNA, 20 bp, Drosophila melanogaster
agacaggcgcacatacccat

SEQ ID NO: 229101 - DNA, 23 bp, Drosophila melanogaster
tacgatgatgatgatgatgatga

SEQ ID NO: 229102 - DNA, 23 bp, Drosophila melanogaster
tatcacagccattttgatgagtt

SEQ ID NO: 229103 - DNA, 22 bp, Drosophila melanogaster
tatcacagccattttgacgagt

SEQ ID NO: 229104 - DNA, 23 bp, Drosophila melanogaster
tcgctgtctgtgtgtgtgcgtgt

SEQ ID NO: 229105 - DNA, 23 bp, Drosophila melanogaster
cgtctcagtgtgtgtgtgtgtgc

SEQ ID NO: 229106 - DNA, 23 bp, Drosophila melanogaster
tgtatatgtatgtatatatatgt

SEQ ID NO: 229107 - DNA, 23 bp, Drosophila melanogaster
atatctatgtatatgtattgtat

SEQ ID NO: 229108 - DNA, 23 bp, Drosophila melanogaster
tctgctcacacacacacacactc

SEQ ID NO: 229109 - DNA, 22 bp, Drosophila melanogaster
actcagacccactcattgtcct

SEQ ID NO: 229110 - DNA, 20 bp, Drosophila melanogaster
tgacggtggactgcgagcag

SEQ ID NO: 229111 - DNA, 23 bp, Drosophila melanogaster
ctatctgcatctgcatctgcatc

SEQ ID NO: 229112 - DNA, 23 bp, Drosophila melanogaster
tctgactcgctggctgcatggct

SEQ ID NO: 229113 - DNA, 23 bp, Drosophila melanogaster
atgtatgtatgtatgtatgtatg

SEQ ID NO: 229114 - DNA, 23 bp, Drosophila melanogaster
tatgctatatatgcgtttgtttg

SEQ ID NO: 229115 - DNA, 23 bp, Drosophila melanogaster
tgtctctggctgtggctctgact

SEQ ID NO: 229116 - DNA, 21 bp, Drosophila melanogaster
taccaacagagaattatttga

SEQ ID NO: 229117 - DNA, 23 bp, Drosophila melanogaster
tccggctctctctctctcgctca

SEQ ID NO: 229118 - DNA, 23 bp, Drosophila melanogaster
gagtgtgtgcgtgtgtctgggcc

SEQ ID NO: 229119 - DNA, 20 bp, Drosophila melanogaster
ggccctgtctgtgtctgtgt

SEQ ID NO: 229120 - DNA, 23 bp, Drosophila melanogaster
tcactccgtccctgtctcgctgc

SEQ ID NO: 229121 - DNA, 23 bp, Drosophila melanogaster
agactgtgacagtcactcacttt

SEQ ID NO: 229122 - DNA, 18 bp, Drosophila melanogaster
ttcagcttgattgttttc

SEQ ID NO: 229123 - DNA, 23 bp, Drosophila melanogaster
atgtgttgtgtttttgcagttgt

SEQ ID NO: 229124 - DNA, 18 bp, Drosophila melanogaster
gtagctggtagccatgtt

SEQ ID NO: 229125 - DNA, 21 bp, Drosophila melanogaster
tatgtcgcaaggctattccag

SEQ ID NO: 229126 - DNA, 23 bp, Drosophila melanogaster
tgatgatgatgatgatgatgagg

SEQ ID NO: 229127 - DNA, 21 bp, Drosophila melanogaster
caaagtcgttaacatggtggt

SEQ ID NO: 229128 - DNA, 18 bp, Drosophila melanogaster
gatcttttaaaatgagaa

SEQ ID NO: 229129 - DNA, 23 bp, Drosophila melanogaster
tactgtcagtgaatccgtctggt

SEQ ID NO: 229130 - DNA, 23 bp, Drosophila melanogaster
gcaactgcaactgcaactgcaac

SEQ ID NO: 229131 - DNA, 21 bp, Drosophila melanogaster
gttcttattgttctccttgtc

SEQ ID NO: 229132 - DNA, 18 bp, Drosophila melanogaster
tgcgagatctggacatag

SEQ ID NO: 229133 - DNA, 23 bp, Drosophila melanogaster
aagctttgcatatgtattgggtt

SEQ ID NO: 229134 - DNA, 18 bp, Drosophila melanogaster
taagtgtgttattaatgc

SEQ ID NO: 229135 - DNA, 21 bp, Drosophila melanogaster
taaaatgtcaattgctatgct

SEQ ID NO: 229136 - DNA, 23 bp, Drosophila melanogaster
attgtgagcagagtgtggactga

SEQ ID NO: 229137 - DNA, 18 bp, Drosophila melanogaster
tctgaatatatatatttg

SEQ ID NO: 229138 - DNA, 23 bp, Drosophila melanogaster
tctacgtgtgtgtatttggatga

SEQ ID NO: 229139 - DNA, 23 bp, Drosophila melanogaster
tccgtctgtccgtccgtctgtcg

SEQ ID NO: 229140 - DNA, 23 bp, Drosophila melanogaster
gctggctggctggctggctgcct

SEQ ID NO: 229141 - DNA, 19 bp, Drosophila melanogaster
tcacacacacgcacacttg

SEQ ID NO: 229142 - DNA, 23 bp, Drosophila melanogaster
acgtgctggctgtgtgtggccgt

SEQ ID NO: 229143 - DNA, 23 bp, Drosophila melanogaster
tggcagtcagtcagtcggtcagg

SEQ ID NO: 229144 - DNA, 23 bp, Drosophila melanogaster
aagtgtatatgtgtatttttcat

SEQ ID NO: 229145 - DNA, 23 bp, Drosophila melanogaster
tacttagaaatctgagctatttg

SEQ ID NO: 229146 - DNA, 23 bp, Drosophila melanogaster
gagcgactgcctcagtctgtcag

SEQ ID NO: 229147 - DNA, 23 bp, Drosophila melanogaster
gctggctggctggctggctggct

SEQ ID NO: 229148 - DNA, 23 bp, Drosophila melanogaster
tcgggtcggtctgtctgtcagtt

SEQ ID NO: 229149 - DNA, 22 bp, Drosophila melanogaster
atcagtgctttaaactctgtta

SEQ ID NO: 229150 - DNA, 23 bp, Drosophila melanogaster
taccctgtagatccgaatttgtt

SEQ ID NO: 229151 - DNA, 23 bp, Drosophila melanogaster
attcggttctagagaggtttgtg

SEQ ID NO: 229152 - DNA, 23 bp, Drosophila melanogaster
tttctgtcagtgactctttgggt

SEQ ID NO: 229153 - DNA, 23 bp, Drosophila melanogaster
tgcctgaatccctgtgtgtgtgt

SEQ ID NO: 229154 - DNA, 23 bp, Drosophila melanogaster
agtctgttagtcagtcagtaagc

SEQ ID NO: 229155 - DNA, 23 bp, Drosophila melanogaster
tcagtgcctcagtcccagcctct

SEQ ID NO: 229156 - DNA, 20 bp, Drosophila melanogaster
tgtgtgaatgtctctcgctg

SEQ ID NO: 229157 - DNA, 20 bp, Drosophila melanogaster
tcaggcagctagtcagccag

SEQ ID NO: 229158 - DNA, 23 bp, Drosophila melanogaster
atatgtatgtatgtatgtgtgtg

SEQ ID NO: 229159 - DNA, 23 bp, Drosophila melanogaster
gtgttgtgttattgttgctgtga

SEQ ID NO: 229160 - DNA, 23 bp, Drosophila melanogaster
tgtacttcaatgcatatgcatgt

SEQ ID NO: 229161 - DNA, 23 bp, Drosophila melanogaster
cgtatgcatgtatgtatgtatgt

SEQ ID NO: 229162 - DNA, 21 bp, Drosophila melanogaster
ttacacagatatttgctgggt

SEQ ID NO: 229163 - DNA, 18 bp, Drosophila melanogaster
tacgacaacaattgttgt

SEQ ID NO: 229164 - DNA, 23 bp, Drosophila melanogaster
ctgcgtctgtgtctgtggctgtg

SEQ ID NO: 229165 - DNA, 23 bp, Drosophila melanogaster
gcatgtgcatgtgcatgtgcatc

SEQ ID NO: 229166 - DNA, 23 bp, Drosophila melanogaster
tgtgtacatgtgtatgtatatgt

SEQ ID NO: 229167 - DNA, 23 bp, Drosophila melanogaster
tttgcctgtgtgtccgtatgcct

SEQ ID NO: 229168 - DNA, 22 bp, Drosophila melanogaster
gtctgtctacctgtctgtctga

SEQ ID NO: 229169 - DNA, 19 bp, Drosophila melanogaster
ctgtgcctgtgtcagtgtc

SEQ ID NO: 229170 - DNA, 21 bp, Drosophila melanogaster
acagtcgcagtcacagtcgca

SEQ ID NO: 229171 - DNA, 23 bp, Drosophila melanogaster
tcagtcagtcagtcagtcagttg

SEQ ID NO: 229172 - DNA, 21 bp, Drosophila melanogaster
tctgcatgtacatatgtacat

SEQ ID NO: 229173 - DNA, 23 bp, Drosophila melanogaster
gtgcttctgtgtttctctatttc

SEQ ID NO: 229174 - DNA, 23 bp, Drosophila melanogaster
tggttcatccatgtagtctgcat

SEQ ID NO: 229175 - DNA, 23 bp, Drosophila melanogaster
tctctgtctgcttatcagtccga

SEQ ID NO: 229176 - DNA, 23 bp, Drosophila melanogaster
gtccgtctgtctgtctgtccatc

SEQ ID NO: 229177 - DNA, 23 bp, Drosophila melanogaster
gtctgtctgtctgtcggtctgtg

SEQ ID NO: 229178 - DNA, 23 bp, Drosophila melanogaster
tgagtcagtgagtcagtgggtgg

SEQ ID NO: 229179 - DNA, 20 bp, Drosophila melanogaster
tggcaactctagacaaacat

SEQ ID NO: 229180 - DNA, 20 bp, Drosophila melanogaster
ctgtatctctgtctgcgtct

SEQ ID NO: 229181 - DNA, 22 bp, Drosophila melanogaster
actcacacactcgcacacttga

SEQ ID NO: 229182 - DNA, 22 bp, Drosophila melanogaster
gctgcctgatgttgctgttgct

SEQ ID NO: 229183 - DNA, 23 bp, Drosophila melanogaster
actgcaactgcaactgcaacagc

SEQ ID NO: 229184 - DNA, 19 bp, Drosophila melanogaster
tatgtatatgtatatcttt

SEQ ID NO: 229185 - DNA, 23 bp, Drosophila melanogaster
tgtttgtatgtatgtatgtatgt

SEQ ID NO: 229186 - DNA, 23 bp, Drosophila melanogaster
aacattgatgacgacgaagtgga

SEQ ID NO: 229187 - DNA, 23 bp, Drosophila melanogaster
tgtgtgtgtgtgtgtgtcaaatt

SEQ ID NO: 229188 - DNA, 23 bp, Drosophila melanogaster
atagactgtcagaaatgtttgat

SEQ ID NO: 229189 - DNA, 23 bp, Drosophila melanogaster
cagactgtctgcctgtctgcccc

SEQ ID NO: 229190 - DNA, 21 bp, Drosophila melanogaster
tcggaagactgtatctattgt

SEQ ID NO: 229191 - DNA, 23 bp, Drosophila melanogaster
tgtgcctgtgtgcgtgcgtgagt

SEQ ID NO: 229192 - DNA, 23 bp, Drosophila melanogaster
atgtatgtatatgtatatgtttg

SEQ ID NO: 229193 - DNA, 23 bp, Drosophila melanogaster
gcctgtgcctgtgtgtgtgtgtg

SEQ ID NO: 229194 - DNA, 19 bp, Drosophila melanogaster
tgtatgtatgtatgtatgt

SEQ ID NO: 229195 - DNA, 22 bp, Drosophila melanogaster
tttggtatcaaagcaatttgtt

SEQ ID NO: 229196 - DNA, 22 bp, Drosophila melanogaster
agtgaccagactaggtgttgta

SEQ ID NO: 229197 - DNA, 21 bp, Drosophila melanogaster
tcagtcagtcgaggcgattgt

SEQ ID NO: 229198 - DNA, 23 bp, Drosophila melanogaster
ctttgatagaactcgctgtgttc

SEQ ID NO: 229199 - DNA, 23 bp, Drosophila melanogaster
gaacagcattgtactgggcaatc

SEQ ID NO: 229200 - DNA, 23 bp, Drosophila melanogaster
aaatctgcaataggaaagtattt

SEQ ID NO: 229201 - DNA, 20 bp, Drosophila melanogaster
tctatgtatgttagtagtgg

SEQ ID NO: 229202 - DNA, 23 bp, Drosophila melanogaster
ttttatgactatttgttgttgtc

SEQ ID NO: 229203 - DNA, 23 bp, Drosophila melanogaster
tacctgcatgtgcatgtgtatct

SEQ ID NO: 229204 - DNA, 21 bp, Drosophila melanogaster
tatttgaatatatgtatgtat

SEQ ID NO: 229205 - DNA, 19 bp, Drosophila melanogaster
tatatgcatgtatacacat

SEQ ID NO: 229206 - DNA, 21 bp, Drosophila melanogaster
atgcatgtatgtatgtatgta

SEQ ID NO: 229207 - DNA, 23 bp, Drosophila melanogaster
gcttctgccattgaaatctgaga

SEQ ID NO: 229208 - DNA, 18 bp, Drosophila melanogaster
agatgcacgtacctatgt

SEQ ID NO: 229209 - DNA, 22 bp, Drosophila melanogaster
tgagtgccagccatttgtctgt

SEQ ID NO: 229210 - DNA, 23 bp, Drosophila melanogaster
tgtgtgcgcgtgtgtttatgcgt

SEQ ID NO: 229211 - DNA, 20 bp, Drosophila melanogaster
ctgtgcatgtatgtatatat

SEQ ID NO: 229212 - DNA, 23 bp, Drosophila melanogaster
tgtacatgctgcagtgtctgtgt

SEQ ID NO: 229213 - DNA, 23 bp, Drosophila melanogaster
aatgtggcactcgctctctttct

SEQ ID NO: 229214 - DNA, 23 bp, Drosophila melanogaster
aactctgaatctctgtttgtgtg

SEQ ID NO: 229215 - DNA, 19 bp, Drosophila melanogaster
gtgactggattggcatttg

SEQ ID NO: 229216 - DNA, 23 bp, Drosophila melanogaster
tctgtgtatctgcatgtgtatgt

SEQ ID NO: 229217 - DNA, 23 bp, Drosophila melanogaster
tctgcctgcgtgtctgtctgcgt

SEQ ID NO: 229218 - DNA, 21 bp, Drosophila melanogaster
tttcacattgatttacgtggg

SEQ ID NO: 229219 - DNA, 22 bp, Drosophila melanogaster
acacacacacacattcatgtat

SEQ ID NO: 229220 - DNA, 21 bp, Drosophila melanogaster
tggtgtgtaagtttgtgtgca

SEQ ID NO: 229221 - DNA, 23 bp, Drosophila melanogaster
tacttaatcgatatgatatgata

SEQ ID NO: 229222 - DNA, 22 bp, Drosophila melanogaster
taaacggtcgaaagcaatgctt

SEQ ID NO: 229223 - DNA, 23 bp, Drosophila melanogaster
tgtatctgcatctgcatcggttt

SEQ ID NO: 229224 - DNA, 23 bp, Drosophila melanogaster
tgtttagtgagtttgctgtttgt

SEQ ID NO: 229225 - DNA, 23 bp, Drosophila melanogaster
aggatgatgatgatggtgctgct

SEQ ID NO: 229226 - DNA, 23 bp, Drosophila melanogaster
acattcacttaggctaatgtgta

SEQ ID NO: 229227 - DNA, 23 bp, Drosophila melanogaster
ctccaactccaactccatctcca

SEQ ID NO: 229228 - DNA, 18 bp, Drosophila melanogaster
cacagggaaatcgctgcg

SEQ ID NO: 229229 - DNA, 23 bp, Drosophila melanogaster
tttgcaagtcaaatgaaattatt

SEQ ID NO: 229230 - DNA, 21 bp, Drosophila melanogaster
tatcacagccattttgacgag

SEQ ID NO: 229231 - DNA, 23 bp, Drosophila melanogaster
cagtgtgtgcgtgtgtgtgtgcc

SEQ ID NO: 229232 - DNA, 22 bp, Drosophila melanogaster
tgcaatatatatatgtatgtag

SEQ ID NO: 229233 - DNA, 19 bp, Drosophila melanogaster
tatgtgtatgtatggttag

SEQ ID NO: 229234 - DNA, 23 bp, Drosophila melanogaster
tctcgctgttttagtgtgtgtgt

SEQ ID NO: 229235 - DNA, 23 bp, Drosophila melanogaster
acacacacacccttgcatttccc

SEQ ID NO: 229236 - DNA, 23 bp, Drosophila melanogaster
aaatgtgattttcattttataag

SEQ ID NO: 229237 - DNA, 23 bp, Drosophila melanogaster
atctgcatctgcatctgcatccg

SEQ ID NO: 229238 - DNA, 23 bp, Drosophila melanogaster
ctctctgcatatgtatctgtatc

SEQ ID NO: 229239 - DNA, 23 bp, Drosophila melanogaster
atatctgtatctgtatctgtgtg

SEQ ID NO: 229240 - DNA, 19 bp, Drosophila melanogaster
actaagctagtttagctga

SEQ ID NO: 229241 - DNA, 23 bp, Drosophila melanogaster
tcgctcactctcactctccgtcg

SEQ ID NO: 229242 - DNA, 22 bp, Drosophila melanogaster
gtgagcgagtgagtgcgagtgc

SEQ ID NO: 229243 - DNA, 22 bp, Drosophila melanogaster
aatgtcttcttcttgctgccat

SEQ ID NO: 229244 - DNA, 22 bp, Drosophila melanogaster
ttaacagcaggtattgctgtct

SEQ ID NO: 229245 - DNA, 23 bp, Drosophila melanogaster
tgcaaagtaaataagtttcatgt

SEQ ID NO: 229246 - DNA, 21 bp, Drosophila melanogaster
ttattattagttgtcggggcg

SEQ ID NO: 229247 - DNA, 22 bp, Drosophila melanogaster
gagttgtcgatgtcaaaacgtt

SEQ ID NO: 229248 - DNA, 18 bp, Drosophila melanogaster
taagtggaacaccaattg

SEQ ID NO: 229249 - DNA, 23 bp, Drosophila melanogaster
atatgtatatgtatatgtatatg

SEQ ID NO: 229250 - DNA, 20 bp, Drosophila melanogaster
tatgcaatttgttgcggctg

SEQ ID NO: 229251 - DNA, 23 bp, Drosophila melanogaster
tcagctggatttcatttgaattt

SEQ ID NO: 229252 - DNA, 23 bp, Drosophila melanogaster
ttgtgtctgtatatgattatgtg

SEQ ID NO: 229253 - DNA, 23 bp, Drosophila melanogaster
ttcactgtactttgacagcactg

SEQ ID NO: 229254 - DNA, 23 bp, Drosophila melanogaster
ctgtcagtcagtcagtcagtcag

SEQ ID NO: 229255 - DNA, 20 bp, Drosophila melanogaster
atttgattgaataacaagag

SEQ ID NO: 229256 - DNA, 19 bp, Drosophila melanogaster
atcgcatttcagttgcttc

SEQ ID NO: 229257 - DNA, 23 bp, Drosophila melanogaster
agagctgtatgtgtgtttgtgca

SEQ ID NO: 229258 - DNA, 23 bp, Drosophila melanogaster
aatgtgtgtttactctctctctc

SEQ ID NO: 229259 - DNA, 23 bp, Drosophila melanogaster
tgtatgtatgtatgtatgtgcat

SEQ ID NO: 229260 - DNA, 23 bp, Drosophila melanogaster
ttctagttggtatgtgtgtgtat

SEQ ID NO: 229261 - DNA, 22 bp, Drosophila melanogaster
gcaacacaagtttttatgttgt

SEQ ID NO: 229262 - DNA, 18 bp, Drosophila melanogaster
taacagacatgggaactg

SEQ ID NO: 229263 - DNA, 23 bp, Drosophila melanogaster
tgtctgtgtgtgagtgtgtgtgt

SEQ ID NO: 229264 - DNA, 23 bp, Drosophila melanogaster
acatatgtatgtatatatgtatg

SEQ ID NO: 229265 - DNA, 23 bp, Drosophila melanogaster
cgcagtctctctctctctctctt

SEQ ID NO: 229266 - DNA, 23 bp, Drosophila melanogaster
atttatgtgctctgtctgtgtga

SEQ ID NO: 229267 - DNA, 18 bp, Drosophila melanogaster
tgagacaatgcattttga

SEQ ID NO: 229268 - DNA, 18 bp, Drosophila melanogaster
cttcactgtcggtaaaat

SEQ ID NO: 229269 - DNA, 23 bp, Drosophila melanogaster
aactctagtattttagttgtaca

SEQ ID NO: 229270 - DNA, 20 bp, Drosophila melanogaster
tgtatgtatatataatctgg

SEQ ID NO: 229271 - DNA, 22 bp, Drosophila melanogaster
aaagtgggtgtgcttgttttca

SEQ ID NO: 229272 - DNA, 22 bp, Drosophila melanogaster
ctggctggatattatttcatta

SEQ ID NO: 229273 - DNA, 20 bp, Drosophila melanogaster
tattgctggaaatttatgtt

SEQ ID NO: 229274 - DNA, 23 bp, Drosophila melanogaster
catacagtcaaaagcgtgcaact

SEQ ID NO: 229275 - DNA, 20 bp, Drosophila melanogaster
tttgcatttatttacatttg

SEQ ID NO: 229276 - DNA, 23 bp, Drosophila melanogaster
aatggaaccattcgaattctagt

SEQ ID NO: 229277 - DNA, 23 bp, Drosophila melanogaster
tgaggagtatgcatgtacataca

SEQ ID NO: 229278 - DNA, 23 bp, Drosophila melanogaster
attgctcatcttcagcgctgtgt

SEQ ID NO: 229279 - DNA, 22 bp, Drosophila melanogaster
agtatgaaaataaataagttcg

SEQ ID NO: 229280 - DNA, 23 bp, Drosophila melanogaster
tttatcagcttgttttctgggct

SEQ ID NO: 229281 - DNA, 23 bp, Drosophila melanogaster
taaatatcagctggtaattctgg

SEQ ID NO: 229282 - DNA, 23 bp, Drosophila melanogaster
taatctcaatttgtaaatgtgag

SEQ ID NO: 229283 - DNA, 23 bp, Drosophila melanogaster
actcactttgcaattggagattg

SEQ ID NO: 229284 - DNA, 23 bp, Drosophila melanogaster
tgagtattacatcaggtactggt

SEQ ID NO: 229285 - DNA, 18 bp, Drosophila melanogaster
accagtacttatgtcata

SEQ ID NO: 229286 - DNA, 22 bp, Drosophila melanogaster
tatgtatgtatgtatatgtatg

SEQ ID NO: 229287 - DNA, 22 bp, Drosophila melanogaster
tatgtacattatgtatgtgtat

SEQ ID NO: 229288 - DNA, 22 bp, Drosophila melanogaster
taagcaagtatctatctatcta

SEQ ID NO: 229289 - DNA, 20 bp, Drosophila melanogaster
tatattgtcttcttggcatt

SEQ ID NO: 229290 - DNA, 23 bp, Drosophila melanogaster
tgcatctgcaactgcaactgcag

SEQ ID NO: 229291 - DNA, 23 bp, Drosophila melanogaster
tgactgtgtgcgtgcgtctgtgc

SEQ ID NO: 229292 - DNA, 23 bp, Drosophila melanogaster
tatcacagttgtctctgtccaga

SEQ ID NO: 229293 - DNA, 19 bp, Drosophila melanogaster
cgtgtgcttgtgagtttta

SEQ ID NO: 229294 - DNA, 23 bp, Drosophila melanogaster
cctctctctgtctgccagcctct

SEQ ID NO: 229295 - DNA, 21 bp, Drosophila melanogaster
ggctgtctgtctgtcggactg

SEQ ID NO: 229296 - DNA, 22 bp, Drosophila melanogaster
cacacacactgaggcacaagtt

SEQ ID NO: 229297 - DNA, 19 bp, Drosophila melanogaster
tgtgcgtgtgacagcggct

SEQ ID NO: 229298 - DNA, 18 bp, Drosophila melanogaster
agaatggctatattttgt

SEQ ID NO: 229299 - DNA, 23 bp, Drosophila melanogaster
agaaacaggaacagcaactgttc

SEQ ID NO: 229300 - DNA, 21 bp, Drosophila melanogaster
ttgcagcggtatttatttcgc

SEQ ID NO: 229301 - DNA, 23 bp, Drosophila melanogaster
tcagactctgagtgtcatggcat

SEQ ID NO: 229302 - DNA, 23 bp, Drosophila melanogaster
ctgttgctccagctccagctgca

SEQ ID NO: 229303 - DNA, 23 bp, Drosophila melanogaster
ctgtaactcgaactggaactgga

SEQ ID NO: 229304 - DNA, 23 bp, Drosophila melanogaster
tgtatgtatgtgttgtagctata

SEQ ID NO: 229305 - DNA, 23 bp, Drosophila melanogaster
actgcctggttgactgcctgcct

SEQ ID NO: 229306 - DNA, 21 bp, Drosophila melanogaster
aaggttctcctccagcagcag

SEQ ID NO: 229307 - DNA, 23 bp, Drosophila melanogaster
gcctgcctgcctgcctgcctgcc

SEQ ID NO: 229308 - DNA, 23 bp, Drosophila melanogaster
tcagtcagtcagtcagctatgtt

SEQ ID NO: 229309 - DNA, 23 bp, Drosophila melanogaster
gtccgtgtgtctgtgtgcgtgcg

SEQ ID NO: 229310 - DNA, 21 bp, Drosophila melanogaster
atgtgtgtgtgtgtgtagtac

SEQ ID NO: 229311 - DNA, 22 bp, Drosophila melanogaster
acaccggactctttgtgtctaa

SEQ ID NO: 229312 - DNA, 23 bp, Drosophila melanogaster
gctcactcgctctcacttctgag

SEQ ID NO: 229313 - DNA, 21 bp, Drosophila melanogaster
gagtgagcgtgtgagtgccgg

SEQ ID NO: 229314 - DNA, 23 bp, Drosophila melanogaster
ggctggctgtctgtctgtctatc

SEQ ID NO: 229315 - DNA, 23 bp, Drosophila melanogaster
atgacacaaagaggatgtggatg

SEQ ID NO: 229316 - DNA, 23 bp, Drosophila melanogaster
tgtggatgtggatgtggatgtgg

SEQ ID NO: 229317 - DNA, 23 bp, Drosophila melanogaster
taactgtgcatctgcatctgcat

SEQ ID NO: 229318 - DNA, 23 bp, Drosophila melanogaster
ggctgactgcctctctggatgac

SEQ ID NO: 229319 - DNA, 20 bp, Drosophila melanogaster
aacagtatatatataacagt

SEQ ID NO: 229320 - DNA, 23 bp, Drosophila melanogaster
tcactgtacattgaaagctgagg

SEQ ID NO: 229321 - DNA, 18 bp, Drosophila melanogaster
tttgtttgaaattttacc

SEQ ID NO: 229322 - DNA, 20 bp, Drosophila melanogaster
acccactgtctgtctgtctg

SEQ ID NO: 229323 - DNA, 23 bp, Drosophila melanogaster
tgagtctcactgtcagcctacga

SEQ ID NO: 229324 - DNA, 22 bp, Drosophila melanogaster
ttacagattgcttaagttgtca

SEQ ID NO: 229325 - DNA, 22 bp, Drosophila melanogaster
atttgtttttcaattaggttcc

SEQ ID NO: 229326 - DNA, 23 bp, Drosophila melanogaster
gttgtagttgaagcttgtatagt

SEQ ID NO: 229327 - DNA, 21 bp, Drosophila melanogaster
ttgtggttcatatatgtatgt

SEQ ID NO: 229328 - DNA, 18 bp, Drosophila melanogaster
tgacggtcagccagccgg

SEQ ID NO: 229329 - DNA, 23 bp, Drosophila melanogaster
cgttgttttgttaggaatacaat

SEQ ID NO: 229330 - DNA, 19 bp, Drosophila melanogaster
gctatactcatcgtataga

SEQ ID NO: 229331 - DNA, 21 bp, Drosophila melanogaster
tatagagggtggtatgcatat

SEQ ID NO: 229332 - DNA, 22 bp, Drosophila melanogaster
ctggatctcccatgcatacgat

SEQ ID NO: 229333 - DNA, 22 bp, Drosophila melanogaster
atacgcttattttcgaatctgt

SEQ ID NO: 229334 - DNA, 20 bp, Drosophila melanogaster
gtctgtgtgtatgatgatgg

SEQ ID NO: 229335 - DNA, 23 bp, Drosophila melanogaster
tggatctccaacagcaactggag

SEQ ID NO: 229336 - DNA, 22 bp, Drosophila melanogaster
tctaaatatgtatgtatgtatt

SEQ ID NO: 229337 - DNA, 18 bp, Drosophila melanogaster
acatgtgagtgtgttgtc

SEQ ID NO: 229338 - DNA, 23 bp, Drosophila melanogaster
ttatatgcatatacatatgtatg

SEQ ID NO: 229339 - DNA, 21 bp, Drosophila melanogaster
tagtgcattatttaagcaaca

SEQ ID NO: 229340 - DNA, 19 bp, Drosophila melanogaster
ctacacacacacacacata

SEQ ID NO: 229341 - DNA, 22 bp, Drosophila melanogaster
gtgtgagtctgtgtgtgtgtgt

SEQ ID NO: 229342 - DNA, 23 bp, Drosophila melanogaster
ctttcactgccaactttgacgtt

SEQ ID NO: 229343 - DNA, 20 bp, Drosophila melanogaster
ttcatcagtggcatagttct

SEQ ID NO: 229344 - DNA, 23 bp, Drosophila melanogaster
tgcgtgtgtgcctgtgtgtgtga

SEQ ID NO: 229345 - DNA, 23 bp, Drosophila melanogaster
tgtcgctctctcgctctggcagg

SEQ ID NO: 229346 - DNA, 23 bp, Drosophila melanogaster
agtaaaatgatgttgatgtttct

SEQ ID NO: 229347 - DNA, 18 bp, Drosophila melanogaster
ttggaggtgagggtggtg

SEQ ID NO: 229348 - DNA, 23 bp, Drosophila melanogaster
tgtctccctgtgtctctggcccc

SEQ ID NO: 229349 - DNA, 18 bp, Drosophila melanogaster
tcgccctctctgtcgctc

SEQ ID NO: 229350 - DNA, 22 bp, Drosophila melanogaster
agaattgtttgtatattttgat

SEQ ID NO: 229351 - DNA, 23 bp, Drosophila melanogaster
cagcagaagaaggagagcgatta

SEQ ID NO: 229352 - DNA, 23 bp, Drosophila melanogaster
ttttcactcacttttatcactct

SEQ ID NO: 229353 - DNA, 23 bp, Drosophila melanogaster
atgtatgtatgtatgtatatttg

SEQ ID NO: 229354 - DNA, 23 bp, Drosophila melanogaster
tatgtatgtatatgtaggagaat

SEQ ID NO: 229355 - DNA, 23 bp, Drosophila melanogaster
tctactggtagttgagctgagtg

SEQ ID NO: 229356 - DNA, 23 bp, Drosophila melanogaster
gggacatgaagatatgtatgtat

SEQ ID NO: 229357 - DNA, 23 bp, Drosophila melanogaster
tatgtatgtatgtctatatgtac

SEQ ID NO: 229358 - DNA, 22 bp, Drosophila melanogaster
tgtgtgtgtgtgtgtgtgcgag

SEQ ID NO: 229359 - DNA, 23 bp, Drosophila melanogaster
ggctgcctggctccctggctggc

SEQ ID NO: 229360 - DNA, 23 bp, Drosophila melanogaster
ggtccctgtctgtgccactgact

SEQ ID NO: 229361 - DNA, 23 bp, Drosophila melanogaster
ttgatttgttaagaagtttgatg

SEQ ID NO: 229362 - DNA, 22 bp, Drosophila melanogaster
tatcttaatctagcatatccca

SEQ ID NO: 229363 - DNA, 23 bp, Drosophila melanogaster
atttatgtacatccgttcgtttt

SEQ ID NO: 229364 - DNA, 23 bp, Drosophila melanogaster
actgccactctgacccactgtgc

SEQ ID NO: 229365 - DNA, 23 bp, Drosophila melanogaster
tgtcgctgtgtgtgtgcgtgagt

SEQ ID NO: 229366 - DNA, 18 bp, Drosophila melanogaster
atgtatgtatgtatatgc

SEQ ID NO: 229367 - DNA, 22 bp, Drosophila melanogaster
acttatgtggatgatgttacct

SEQ ID NO: 229368 - DNA, 23 bp, Drosophila melanogaster
acgtctgtgtctgtgtgtgagcg

SEQ ID NO: 229369 - DNA, 22 bp, Drosophila melanogaster
atattggaatatcaaaatgaga

SEQ ID NO: 229370 - DNA, 21 bp, Drosophila melanogaster
tctcgccctctctcactcact

SEQ ID NO: 229371 - DNA, 21 bp, Drosophila melanogaster
tcgctgcgtgcctgtatcgct

SEQ ID NO: 229372 - DNA, 20 bp, Drosophila melanogaster
aaaagtatactagtatatac

SEQ ID NO: 229373 - DNA, 21 bp, Drosophila melanogaster
tgactgggtgactgggtggct

SEQ ID NO: 229374 - DNA, 19 bp, Drosophila melanogaster
acatccagacgcacacata

SEQ ID NO: 229375 - DNA, 19 bp, Drosophila melanogaster
gagagagagagagagcggc

SEQ ID NO: 229376 - DNA, 22 bp, Drosophila melanogaster
tctaggaagacagaaattgtag

SEQ ID NO: 229377 - DNA, 20 bp, Drosophila melanogaster
acatatgtacatatagtatc

SEQ ID NO: 229378 - DNA, 23 bp, Drosophila melanogaster
tctcgttctcactctctgttgtt

SEQ ID NO: 229379 - DNA, 23 bp, Drosophila melanogaster
agaatgatgatgatgatgatgtt

SEQ ID NO: 229380 - DNA, 23 bp, Drosophila melanogaster
tgtgtgcgtctgtgtctctgtgc

SEQ ID NO: 229381 - DNA, 23 bp, Drosophila melanogaster
tgtatgtatgtatgtatgtgtct

SEQ ID NO: 229382 - DNA, 18 bp, Drosophila melanogaster
aggtggagatgcaaatga

SEQ ID NO: 229383 - DNA, 20 bp, Drosophila melanogaster
acacacatatgtatgtgtgt

SEQ ID NO: 229384 - DNA, 23 bp, Drosophila melanogaster
ttgctgctactgttgctggctgt

SEQ ID NO: 229385 - DNA, 23 bp, Drosophila melanogaster
gcactcctcactctcagtctccg

SEQ ID NO: 229386 - DNA, 23 bp, Drosophila melanogaster
tcaacatcatcctcagtctccac

SEQ ID NO: 229387 - DNA, 22 bp, Drosophila melanogaster
accctgggctaaaagtgtctga

SEQ ID NO: 229388 - DNA, 23 bp, Drosophila melanogaster
atggatttggctgacatttcgaa

SEQ ID NO: 229389 - DNA, 19 bp, Drosophila melanogaster
cacacacacacactcgcgt

SEQ ID NO: 229390 - DNA, 21 bp, Drosophila melanogaster
ctgaacgactctttctctcac

SEQ ID NO: 229391 - DNA, 23 bp, Drosophila melanogaster
tgtatctgcatctgtatctgtat

SEQ ID NO: 229392 - DNA, 23 bp, Drosophila melanogaster
tatgtttgtatgtgagtgcctct

SEQ ID NO: 229393 - DNA, 23 bp, Drosophila melanogaster
tatgtatgtatgtatgtatgtat

SEQ ID NO: 229394 - DNA, 20 bp, Drosophila melanogaster
tggctctgtccttttgttga

SEQ ID NO: 229395 - DNA, 23 bp, Drosophila melanogaster
tggctggctggctggctggctca

SEQ ID NO: 229396 - DNA, 23 bp, Drosophila melanogaster
aaaagtgtgtgcatttgttgttt

SEQ ID NO: 229397 - DNA, 23 bp, Drosophila melanogaster
tctctggctgtgtgtgagcgagt

SEQ ID NO: 229398 - DNA, 21 bp, Drosophila melanogaster
tttgcacatcacacagacaca

SEQ ID NO: 229399 - DNA, 23 bp, Drosophila melanogaster
caactctctcgctcgctctctca

SEQ ID NO: 229400 - DNA, 18 bp, Drosophila melanogaster
cacacgcacacacacgtg

SEQ ID NO: 229401 - DNA, 23 bp, Drosophila melanogaster
tttgaatggtgtgcgtgtgtgcg

SEQ ID NO: 229402 - DNA, 23 bp, Drosophila melanogaster
agacgctcctcagtcagtcagtc

SEQ ID NO: 229403 - DNA, 23 bp, Drosophila melanogaster
tatgcatgtatgtatgtgtgtgt

SEQ ID NO: 229404 - DNA, 21 bp, Drosophila melanogaster
cagacactgcagcatgtacat

SEQ ID NO: 229405 - DNA, 19 bp, Drosophila melanogaster
atacatgcacagggtttct

SEQ ID NO: 229406 - DNA, 18 bp, Drosophila melanogaster
attatacatatgtagcta

SEQ ID NO: 229407 - DNA, 21 bp, Drosophila melanogaster
tctctccgtcgctgcgtcact

SEQ ID NO: 229408 - DNA, 23 bp, Drosophila melanogaster
gtccgtcactgtgtccgtgtgtc

SEQ ID NO: 229409 - DNA, 18 bp, Drosophila melanogaster
tggctagtaactggctct

SEQ ID NO: 229410 - DNA, 23 bp, Drosophila melanogaster
atgcaccatgacagatctgatat

SEQ ID NO: 229411 - DNA, 23 bp, Drosophila melanogaster
atttctgtcagtgcatctgctta

SEQ ID NO: 229412 - DNA, 23 bp, Drosophila melanogaster
ctgtgcgtgtgagcgctgctggt

SEQ ID NO: 229413 - DNA, 21 bp, Drosophila melanogaster
tttcacgttgatgtttccgtt

SEQ ID NO: 229414 - DNA, 23 bp, Drosophila melanogaster
agtcagtcagtcagtcagtcagt

SEQ ID NO: 229415 - DNA, 23 bp, Drosophila melanogaster
tggatatgtgtgtgtgtgtgagg

SEQ ID NO: 229416 - DNA, 23 bp, Drosophila melanogaster
atgagcttggaagatgagtgtct

SEQ ID NO: 229417 - DNA, 20 bp, Drosophila melanogaster
aatcactgcgtgtgtgtgtg

SEQ ID NO: 229418 - DNA, 23 bp, Drosophila melanogaster
caacaaagtgactgtcactccgt

SEQ ID NO: 229419 - DNA, 22 bp, Drosophila melanogaster
tttggcttggcaaacactcact

SEQ ID NO: 229420 - DNA, 20 bp, Drosophila melanogaster
tgtgtgcagaactgatattt

SEQ ID NO: 229421 - DNA, 20 bp, Drosophila melanogaster
ctggagttatattcataatg

SEQ ID NO: 229422 - DNA, 23 bp, Drosophila melanogaster
tcatgatgatgatgatgatgctc

SEQ ID NO: 229423 - DNA, 23 bp, Drosophila melanogaster
ttactctgatttggctttgttga

SEQ ID NO: 229424 - DNA, 23 bp, Drosophila melanogaster
actgactgactgagtgcctgagt

SEQ ID NO: 229425 - DNA, 21 bp, Drosophila melanogaster
ttcagtcctcttgttctgcat

SEQ ID NO: 229426 - DNA, 23 bp, Drosophila melanogaster
acaaattgcatttgtgttgctct

SEQ ID NO: 229427 - DNA, 23 bp, Drosophila melanogaster
gtcagtcagtcagtcagtcagcc

SEQ ID NO: 229428 - DNA, 20 bp, Drosophila melanogaster
aactgtttatttttttttgt

SEQ ID NO: 229429 - DNA, 23 bp, Drosophila melanogaster
aagttgttggttgaattgttgta

SEQ ID NO: 229430 - DNA, 23 bp, Drosophila melanogaster
ataacagtcatcacacacgtcag

SEQ ID NO: 229431 - DNA, 22 bp, Drosophila melanogaster
tatgtgtatgtgtatatgcgtc

SEQ ID NO: 229432 - DNA, 23 bp, Drosophila melanogaster
tatgtgtgtggcctttgtctttg

SEQ ID NO: 229433 - DNA, 23 bp, Drosophila melanogaster
tttaggtttcacaggaaactggt

SEQ ID NO: 229434 - DNA, 20 bp, Drosophila melanogaster
acgaaaactagtttcctcta

SEQ ID NO: 229435 - DNA, 22 bp, Drosophila melanogaster
tgtccgtccgtccgtccgtccg

SEQ ID NO: 229436 - DNA, 18 bp, Drosophila melanogaster
catatgtacattatgtgg

SEQ ID NO: 229437 - DNA, 19 bp, Drosophila melanogaster
aacaggtcctcgagctagg

SEQ ID NO: 229438 - DNA, 23 bp, Drosophila melanogaster
actgcagctggaactgtaactgt

SEQ ID NO: 229439 - DNA, 22 bp, Drosophila melanogaster
gtgtgtgtctgtgtgtgtatag

SEQ ID NO: 229440 - DNA, 23 bp, Drosophila melanogaster
tgcacagagctttttgattgctt

SEQ ID NO: 229441 - DNA, 23 bp, Drosophila melanogaster
gtatgtgtgtagttgctagactc

SEQ ID NO: 229442 - DNA, 23 bp, Drosophila melanogaster
atgatcttcatcatccgctggtc

SEQ ID NO: 229443 - DNA, 23 bp, Drosophila melanogaster
agggtgactgtcttatggttttc

SEQ ID NO: 229444 - DNA, 21 bp, Drosophila melanogaster
ttgtgtgtggctcacttgggc

SEQ ID NO: 229445 - DNA, 23 bp, Drosophila melanogaster
gtatgtatgtatgtatgttatgc

SEQ ID NO: 229446 - DNA, 22 bp, Drosophila melanogaster
gccattcacacagactcattcg

SEQ ID NO: 229447 - DNA, 18 bp, Drosophila melanogaster
gcattgaattgccgagtg

SEQ ID NO: 229448 - DNA, 21 bp, Drosophila melanogaster
atatgtatgtatgtatgtatg

SEQ ID NO: 229449 - DNA, 23 bp, Drosophila melanogaster
tggttgtatgtatgtatgtatgt

SEQ ID NO: 229450 - DNA, 22 bp, Drosophila melanogaster
ttgcatgactaacagatatcaa

SEQ ID NO: 229451 - DNA, 23 bp, Drosophila melanogaster
agtctgactgtcagtctgcttcc

SEQ ID NO: 229452 - DNA, 23 bp, Drosophila melanogaster
tatgtatgtatgtaatatatggt

SEQ ID NO: 229453 - DNA, 22 bp, Drosophila melanogaster
tttctcagagagcaatggggga

SEQ ID NO: 229454 - DNA, 23 bp, Drosophila melanogaster
tgagcaagtccaagtccaagtcc

SEQ ID NO: 229455 - DNA, 23 bp, Drosophila melanogaster
atgtatgtgtgcaagtgcacgtg

SEQ ID NO: 229456 - DNA, 23 bp, Drosophila melanogaster
atgtgcatctgcaactgcaactg

SEQ ID NO: 229457 - DNA, 23 bp, Drosophila melanogaster
tgtgtatctgtgtctgtgtgtgt

SEQ ID NO: 229458 - DNA, 18 bp, Drosophila melanogaster
ctgagcgactctgttctt

SEQ ID NO: 229459 - DNA, 23 bp, Drosophila melanogaster
tatgcatgtatgtatgtatgtat

SEQ ID NO: 229460 - DNA, 22 bp, Drosophila melanogaster
acatgtgtatgcatgcacacag

SEQ ID NO: 229461 - DNA, 21 bp, Drosophila melanogaster
agtgtgtcccacacttcaaag

SEQ ID NO: 229462 - DNA, 23 bp, Drosophila melanogaster
tgtgtgtgtgagtgcttgactgg

SEQ ID NO: 229463 - DNA, 23 bp, Drosophila melanogaster
agtggctcggtctgtcggtcact

SEQ ID NO: 229464 - DNA, 18 bp, Drosophila melanogaster
atgcgaatactatccaat

SEQ ID NO: 229465 - DNA, 22 bp, Drosophila melanogaster
gtgcttgtgcatttgatgcgat

SEQ ID NO: 229466 - DNA, 23 bp, Drosophila melanogaster
ataagtgtgtatttctatatatt

SEQ ID NO: 229467 - DNA, 23 bp, Drosophila melanogaster
tatatagtagtaggcatgcatgt

SEQ ID NO: 229468 - DNA, 23 bp, Drosophila melanogaster
tacatagttcaagagcaggagat

SEQ ID NO: 229469 - DNA, 23 bp, Drosophila melanogaster
ctgtgactgtgactgtggctgtg

SEQ ID NO: 229470 - DNA, 21 bp, Drosophila melanogaster
tagaggtagtagtcgtacagg

SEQ ID NO: 229471 - DNA, 23 bp, Drosophila melanogaster
ctgactgactgactggctggctg

SEQ ID NO: 229472 - DNA, 20 bp, Drosophila melanogaster
tcagtcagtcagttatcgga

SEQ ID NO: 229473 - DNA, 23 bp, Drosophila melanogaster
actgtctgcctgtctgtctgtct

SEQ ID NO: 229474 - DNA, 23 bp, Drosophila melanogaster
acacacacagatatgatatgcga

SEQ ID NO: 229475 - DNA, 22 bp, Drosophila melanogaster
ctatgtgtgtgtgagagaacgg

SEQ ID NO: 229476 - DNA, 20 bp, Drosophila melanogaster
tgtgtcggagtaaacttgtg

SEQ ID NO: 229477 - DNA, 23 bp, Drosophila melanogaster
taatcatctgtatctgaatacgt

SEQ ID NO: 229478 - DNA, 23 bp, Drosophila melanogaster
ttatagactgctcttcttcacgt

SEQ ID NO: 229479 - DNA, 20 bp, Drosophila melanogaster
ttttgagacgattttttgtt

SEQ ID NO: 229480 - DNA, 20 bp, Drosophila melanogaster
gtaactcttctgttttagat

SEQ ID NO: 229481 - DNA, 22 bp, Drosophila melanogaster
tatgtgctgttgcaccgccttg

SEQ ID NO: 229482 - DNA, 20 bp, Drosophila melanogaster
tatgtatgtatgttttagtt

SEQ ID NO: 229483 - DNA, 21 bp, Drosophila melanogaster
tatgtacatacataatgtaca

SEQ ID NO: 229484 - DNA, 23 bp, Drosophila melanogaster
gtgaaagcttctgatttgcttag

SEQ ID NO: 229485 - DNA, 18 bp, Caenorhabditis elegans
tagactttggtaaagctt

SEQ ID NO: 229486 - DNA, 20 bp, Caenorhabditis elegans
aatccaagttttgccaaagt

SEQ ID NO: 229487 - DNA, 19 bp, Caenorhabditis elegans
ccaagtttagacagcttct

SEQ ID NO: 229488 - DNA, 23 bp, Caenorhabditis elegans
aaattatcgattttttttgaaaa

SEQ ID NO: 229489 - DNA, 21 bp, Caenorhabditis elegans
atggatgatgatgatgatgaa

SEQ ID NO: 229490 - DNA, 22 bp, Caenorhabditis elegans
cggagtcttatcacatactgat

SEQ ID NO: 229491 - DNA, 19 bp, Caenorhabditis elegans
atctatgtagttgttgcag

SEQ ID NO: 229492 - DNA, 19 bp, Caenorhabditis elegans
attcgagattttagctgaa

SEQ ID NO: 229493 - DNA, 20 bp, Caenorhabditis elegans
aaaatctatgtttttcttaa

SEQ ID NO: 229494 - DNA, 23 bp, Caenorhabditis elegans
gatatgtctggtattcttgggtt

SEQ ID NO: 229495 - DNA, 20 bp, Caenorhabditis elegans
tcagcaattttttagagaaa

SEQ ID NO: 229496 - DNA, 18 bp, Caenorhabditis elegans
aggcttgtgtaaggctta

SEQ ID NO: 229497 - DNA, 21 bp, Caenorhabditis elegans
tttcgatttttaatggaaatt

SEQ ID NO: 229498 - DNA, 20 bp, Caenorhabditis elegans
atctcattttcatgatgtga

SEQ ID NO: 229499 - DNA, 21 bp, Caenorhabditis elegans
aatgccattagaaacactcac

SEQ ID NO: 229500 - DNA, 22 bp, Caenorhabditis elegans
tttacgtatgaatccataacat

SEQ ID NO: 229501 - DNA, 20 bp, Caenorhabditis elegans
ctaatcttactgaatttgtt

SEQ ID NO: 229502 - DNA, 23 bp, Caenorhabditis elegans
ctcagcctcagtcagtcagtcaa

SEQ ID NO: 229503 - DNA, 22 bp, Caenorhabditis elegans
tttttggtcaaaattgttatca

SEQ ID NO: 229504 - DNA, 20 bp, Caenorhabditis elegans
tgctcgtttttttacgacta

SEQ ID NO: 229505 - DNA, 19 bp, Caenorhabditis elegans
attgtttgtatttacgtat

SEQ ID NO: 229506 - DNA, 22 bp, Caenorhabditis elegans
ccaaagaacttgcagaagagct

SEQ ID NO: 229507 - DNA, 23 bp, Caenorhabditis elegans
tgaagagagagaaaacagttgga

SEQ ID NO: 229508 - DNA, 23 bp, Caenorhabditis elegans
tctctctatcactctctatcctt

SEQ ID NO: 229509 - DNA, 18 bp, Caenorhabditis elegans
aggatgagcagctggaga

SEQ ID NO: 229510 - DNA, 23 bp, Caenorhabditis elegans
tctgaccgtctgagtctcattgt

SEQ ID NO: 229511 - DNA, 19 bp, Caenorhabditis elegans
agtgaagcctgagaaaggg

SEQ ID NO: 229512 - DNA, 23 bp, Caenorhabditis elegans
ctgattctctcactatttttcac

SEQ ID NO: 229513 - DNA, 23 bp, Caenorhabditis elegans
ttagaaactacgttgtaaagtat

SEQ ID NO: 229514 - DNA, 22 bp, Caenorhabditis elegans
attggtcccctccaagtagctc

SEQ ID NO: 229515 - DNA, 23 bp, Caenorhabditis elegans
atgagcatcagcaactggagctg

SEQ ID NO: 229516 - DNA, 22 bp, Caenorhabditis elegans
ctgtatgtcacttgagcgtttg

SEQ ID NO: 229517 - DNA, 23 bp, Caenorhabditis elegans
gatctttggtgattcagcttcaa

SEQ ID NO: 229518 - DNA, 22 bp, Caenorhabditis elegans
ataaagctaggttaccaaagct

SEQ ID NO: 229519 - DNA, 21 bp, Caenorhabditis elegans
tcaagtaatgtagcaaaatgt

SEQ ID NO: 229520 - DNA, 23 bp, Caenorhabditis elegans
tcagtgtccctgtgtgtctcgca

SEQ ID NO: 229521 - DNA, 23 bp, Caenorhabditis elegans
tctctctctctctcaagtcccgc

SEQ ID NO: 229522 - DNA, 20 bp, Caenorhabditis elegans
tcagaaagatacatgtttat

SEQ ID NO: 229523 - DNA, 23 bp, Caenorhabditis elegans
ttcgttgttgttgttccgtggaa

SEQ ID NO: 229524 - DNA, 18 bp, Caenorhabditis elegans
tcctgatcaatagtgaat

SEQ ID NO: 229525 - DNA, 21 bp, Caenorhabditis elegans
atagagacagagattgttatc

SEQ ID NO: 229526 - DNA, 20 bp, Caenorhabditis elegans
tggttgtaagaatttttgaa

SEQ ID NO: 229527 - DNA, 22 bp, Caenorhabditis elegans
aaggagacctagaatttgagag

SEQ ID NO: 229528 - DNA, 23 bp, Caenorhabditis elegans
agctgattttgttgttgtctcag

SEQ ID NO: 229529 - DNA, 19 bp, Caenorhabditis elegans
ttttttcccattttcttga

SEQ ID NO: 229530 - DNA, 18 bp, Caenorhabditis elegans
gggtccaaccatcaatcg

SEQ ID NO: 229531 - DNA, 21 bp, Caenorhabditis elegans
tgcctgcctgcctggttgcct

SEQ ID NO: 229532 - DNA, 21 bp, Caenorhabditis elegans
tcaagtaatgtagcaaaatgt

SEQ ID NO: 229533 - DNA, 23 bp, Caenorhabditis elegans
actatcaactacaaagttgtact

SEQ ID NO: 229534 - DNA, 23 bp, Caenorhabditis elegans
actttgtagttgatcactttgtc

SEQ ID NO: 229535 - DNA, 18 bp, Caenorhabditis elegans
ggatttcagaggttttca

SEQ ID NO: 229536 - DNA, 22 bp, Caenorhabditis elegans
tttaacgatgaaaatctgattt

SEQ ID NO: 229537 - DNA, 23 bp, Caenorhabditis elegans
tagctgtctgcgtatctcctctc

SEQ ID NO: 229538 - DNA, 20 bp, Caenorhabditis elegans
tgacaggagagagacagaca

SEQ ID NO: 229539 - DNA, 21 bp, Caenorhabditis elegans
gcaattctttgggatctcatg

SEQ ID NO: 229540 - DNA, 20 bp, Caenorhabditis elegans
tccttgacagaactcgaaga

SEQ ID NO: 229541 - DNA, 22 bp, Caenorhabditis elegans
agtgtgtgaagagtgagagccg

SEQ ID NO: 229542 - DNA, 19 bp, Caenorhabditis elegans
aaagatctaaagatctaag

SEQ ID NO: 229543 - DNA, 20 bp, Caenorhabditis elegans
ttgagcggcgctaacttgag

SEQ ID NO: 229544 - DNA, 18 bp, Caenorhabditis elegans
agaagttggacgcactgt

SEQ ID NO: 229545 - DNA, 21 bp, Caenorhabditis elegans
atctgcttgaattgctcagct

SEQ ID NO: 229546 - DNA, 21 bp, Caenorhabditis elegans
aattgggtggaaaacctatga

SEQ ID NO: 229547 - DNA, 21 bp, Caenorhabditis elegans
agagtgtcccattttgttttg

SEQ ID NO: 229548 - DNA, 23 bp, Caenorhabditis elegans
ttgatgtattccaggtttggatg

SEQ ID NO: 229549 - DNA, 21 bp, Caenorhabditis elegans
tcaagtaatgtagcaaaatgt

SEQ ID NO: 229550 - DNA, 21 bp, Caenorhabditis elegans
tcaagtaatgtagcaaaatgt

SEQ ID NO: 229551 - DNA, 19 bp, Caenorhabditis elegans
gaatgttcagttggagcgg

SEQ ID NO: 229552 - DNA, 23 bp, Caenorhabditis elegans
tcatgtgtggcacgagttctgga

SEQ ID NO: 229553 - DNA, 23 bp, Caenorhabditis elegans
tctctgcgctttctcactctctc

SEQ ID NO: 229554 - DNA, 23 bp, Caenorhabditis elegans
ctctgtgtgtgtgtgtctaaacg

SEQ ID NO: 229555 - DNA, 23 bp, Caenorhabditis elegans
actgactgcctctgtctgtctct

SEQ ID NO: 229556 - DNA, 22 bp, Caenorhabditis elegans
aaatactgtggaattctgaaaa

SEQ ID NO: 229557 - DNA, 20 bp, Caenorhabditis elegans
aatacaagtcttttggtagt

SEQ ID NO: 229558 - DNA, 23 bp, Caenorhabditis elegans
ctcacggagcaattgtttttgtt

SEQ ID NO: 229559 - DNA, 18 bp, Caenorhabditis elegans
ttaggcagcctatgagag

SEQ ID NO: 229560 - DNA, 21 bp, Caenorhabditis elegans
caaaagttgggtcagactagg

SEQ ID NO: 229561 - DNA, 22 bp, Caenorhabditis elegans
aaatccaagtttagccaaagtt

SEQ ID NO: 229562 - DNA, 18 bp, Caenorhabditis elegans
ttttggcaggaaatccaa

SEQ ID NO: 229563 - DNA, 23 bp, Caenorhabditis elegans
agactgtctgtctgtctgcgtct

SEQ ID NO: 229564 - DNA, 23 bp, Caenorhabditis elegans
agatgaagagatacttacaacta

SEQ ID NO: 229565 - DNA, 23 bp, Caenorhabditis elegans
cgttgtagttgatgactttttga

SEQ ID NO: 229566 - DNA, 23 bp, Caenorhabditis elegans
ttcagctaaattttgcaattttt

SEQ ID NO: 229567 - DNA, 18 bp, Caenorhabditis elegans
tttttttgaaattttcat

SEQ ID NO: 229568 - DNA, 18 bp, Caenorhabditis elegans
attgagctcaccgagcac

SEQ ID NO: 229569 - DNA, 21 bp, Caenorhabditis elegans
tagtaataatttaggataact

SEQ ID NO: 229570 - DNA, 23 bp, Caenorhabditis elegans
actctgcctgtctgcgtctctct

SEQ ID NO: 229571 - DNA, 22 bp, Caenorhabditis elegans
tttgtggactacaaactgcaaa

SEQ ID NO: 229572 - DNA, 19 bp, Caenorhabditis elegans
tgcgatgatgatgatgatc

SEQ ID NO: 229573 - DNA, 23 bp, Caenorhabditis elegans
tgttatcactcccagatttgtgt

SEQ ID NO: 229574 - DNA, 23 bp, Caenorhabditis elegans
ctcactgcctgcctgcctgactc

SEQ ID NO: 229575 - DNA, 23 bp, Caenorhabditis elegans
atgatgatgatgttgatggtgct

SEQ ID NO: 229576 - DNA, 21 bp, Caenorhabditis elegans
gttaaaggtctatatctcagc

SEQ ID NO: 229577 - DNA, 21 bp, Caenorhabditis elegans
tgcaagacatttttttttcta

SEQ ID NO: 229578 - DNA, 22 bp, Caenorhabditis elegans
accaattgatttgagcttcatt

SEQ ID NO: 229579 - DNA, 20 bp, Caenorhabditis elegans
ttaaaggtctatatcttggc

SEQ ID NO: 229580 - DNA, 19 bp, Caenorhabditis elegans
tgaaagacatgggtagtga

SEQ ID NO: 229581 - DNA, 23 bp, Caenorhabditis elegans
tatcacagccagctttgatgtgc

SEQ ID NO: 229582 - DNA, 22 bp, Caenorhabditis elegans
gctttttacgttcaaatctgaa

SEQ ID NO: 229583 - DNA, 22 bp, Caenorhabditis elegans
tacatgatttgttgatgatgtt

SEQ ID NO: 229584 - DNA, 23 bp, Caenorhabditis elegans
ttgatttgttcttgaattttgaa

SEQ ID NO: 229585 - DNA, 22 bp, Caenorhabditis elegans
aatgtatttaaatacatttgtg

SEQ ID NO: 229586 - DNA, 22 bp, Caenorhabditis elegans
tgttatgttcgacaaacaatgt

SEQ ID NO: 229587 - DNA, 19 bp, Caenorhabditis elegans
tgaaagagacaaaaagatg

SEQ ID NO: 229588 - DNA, 21 bp, Caenorhabditis elegans
gaaagttattgattaaccgtg

SEQ ID NO: 229589 - DNA, 23 bp, Caenorhabditis elegans
tccttttcgatttgatcgacttt

SEQ ID NO: 229590 - DNA, 23 bp, Caenorhabditis elegans
tggaatgtaaagaagtatgtaga

SEQ ID NO: 229591 - DNA, 23 bp, Caenorhabditis elegans
tatcaggatcaggccttggctga

SEQ ID NO: 229592 - DNA, 22 bp, Caenorhabditis elegans
tattgcactctccccggcctga

SEQ ID NO: 229593 - DNA, 21 bp, Caenorhabditis elegans
tactcattgtttctttttcaa

SEQ ID NO: 229594 - DNA, 23 bp, Caenorhabditis elegans
tgtatgtttgtacttttagtacc

SEQ ID NO: 229595 - DNA, 23 bp, Caenorhabditis elegans
tgacttcttccacacactcgata

SEQ ID NO: 229596 - DNA, 23 bp, Caenorhabditis elegans
agcataaatattgatgaggaaat

SEQ ID NO: 229597 - DNA, 23 bp, Caenorhabditis elegans
tttctacgattgatttcttggct

SEQ ID NO: 229598 - DNA, 19 bp, Caenorhabditis elegans
gatcatcataagcaggagt

SEQ ID NO: 229599 - DNA, 23 bp, Caenorhabditis elegans
taactgtctgttacctctctgtc

SEQ ID NO: 229600 - DNA, 23 bp, Caenorhabditis elegans
aaattgatgtgcactctggaaat

SEQ ID NO: 229601 - DNA, 22 bp, Caenorhabditis elegans
tctcactttcacactgtttctc

SEQ ID NO: 229602 - DNA, 22 bp, Caenorhabditis elegans
cacactctctcggactcgtctc

SEQ ID NO: 229603 - DNA, 23 bp, Caenorhabditis elegans
tcagtgatgatgctctctctctt

SEQ ID NO: 229604 - DNA, 23 bp, Caenorhabditis elegans
tctttggttgtacaaagtggtat

SEQ ID NO: 229605 - DNA, 23 bp, Caenorhabditis elegans
aataagcacatactgcttttcag

SEQ ID NO: 229606 - DNA, 21 bp, Caenorhabditis elegans
tcaagtaatgtagcaaaatgt

SEQ ID NO: 229607 - DNA, 23 bp, Caenorhabditis elegans
tgacccattgtattactgcggaa

SEQ ID NO: 229608 - DNA, 22 bp, Caenorhabditis elegans
catctctgaaaatcatttgtaa

SEQ ID NO: 229609 - DNA, 18 bp, Caenorhabditis elegans
aacaaactttttcaagag

SEQ ID NO: 229610 - DNA, 22 bp, Caenorhabditis elegans
tgctagtggttgtggtggtggt

SEQ ID NO: 229611 - DNA, 20 bp, Caenorhabditis elegans
tcagcccattttttgtctta

SEQ ID NO: 229612 - DNA, 21 bp, Caenorhabditis elegans
agtcgttggtctcttttttgt

SEQ ID NO: 229613 - DNA, 23 bp, Caenorhabditis elegans
accaatctattttttggtatgtc

SEQ ID NO: 229614 - DNA, 21 bp, Caenorhabditis elegans
tttttcgttaaatttccagta

SEQ ID NO: 229615 - DNA, 21 bp, Caenorhabditis elegans
tattggaagattttaggttag

SEQ ID NO: 229616 - DNA, 21 bp, Caenorhabditis elegans
atctctccgtgtgtctatgtg

SEQ ID NO: 229617 - DNA, 20 bp, Caenorhabditis elegans
tttcagacacttttccgtga

SEQ ID NO: 229618 - DNA, 23 bp, Caenorhabditis elegans
tgtttgcctgcctgcctgcctgc

SEQ ID NO: 229619 - DNA, 23 bp, Caenorhabditis elegans
ttctggaaaaatattgattttct

SEQ ID NO: 229620 - DNA, 20 bp, Caenorhabditis elegans
attttctgagattttattga

SEQ ID NO: 229621 - DNA, 20 bp, Caenorhabditis elegans
tcgattagattcttgagtgt

SEQ ID NO: 229622 - DNA, 23 bp, Caenorhabditis elegans
gtatttaatgaagtattgttgtt

SEQ ID NO: 229623 - DNA, 23 bp, Caenorhabditis elegans
aaaattcgagtttttgttgaaaa

SEQ ID NO: 229624 - DNA, 23 bp, Caenorhabditis elegans
ttgaaaagtattgattttctatt

SEQ ID NO: 229625 - DNA, 21 bp, Caenorhabditis elegans
tatcggtttttaatgaaaatt

SEQ ID NO: 229626 - DNA, 23 bp, Caenorhabditis elegans
aatccaagttttgccaaagtatt

SEQ ID NO: 229627 - DNA, 23 bp, Caenorhabditis elegans
tataggtaggtataggtatgtga

SEQ ID NO: 229628 - DNA, 23 bp, Caenorhabditis elegans
gtgatcaactacaaagttttttt

SEQ ID NO: 229629 - DNA, 23 bp, Caenorhabditis elegans
aactttgtaattgatcactttgt

SEQ ID NO: 229630 - DNA, 23 bp, Caenorhabditis elegans
ttgtttgaaaaactaagtttttg

SEQ ID NO: 229631 - DNA, 23 bp, Caenorhabditis elegans
tcgttttagtgagagcttttgaa

SEQ ID NO: 229632 - DNA, 21 bp, Caenorhabditis elegans
atggttgtagatgatgatagg

SEQ ID NO: 229633 - DNA, 20 bp, Caenorhabditis elegans
aatttgggtctgctagacta

SEQ ID NO: 229634 - DNA, 18 bp, Caenorhabditis elegans
agagtttgatctgatctg

SEQ ID NO: 229635 - DNA, 23 bp, Caenorhabditis elegans
aagacttttactcatagtggggc

SEQ ID NO: 229636 - DNA, 23 bp, Caenorhabditis elegans
atgatgacgtggtcgtcgactga

SEQ ID NO: 229637 - DNA, 23 bp, Caenorhabditis elegans
aggcaagatgttggcatagctga

SEQ ID NO: 229638 - DNA, 23 bp, Caenorhabditis elegans
tctgccacgcactgatgtgagga

SEQ ID NO: 229639 - DNA, 23 bp, Caenorhabditis elegans
tctgcgtctctccctcacacagg

SEQ ID NO: 229640 - DNA, 21 bp, Caenorhabditis elegans
tttttgaaagctaagggtgac

SEQ ID NO: 229641 - DNA, 21 bp, Caenorhabditis elegans
ttgacagtagtctgtgggcac

SEQ ID NO: 229642 - DNA, 22 bp, Caenorhabditis elegans
actttgctttaaaattggaaaa

SEQ ID NO: 229643 - DNA, 21 bp, Caenorhabditis elegans
aatgagggtggagacgcagag

SEQ ID NO: 229644 - DNA, 19 bp, Caenorhabditis elegans
tcgctgtctgcgtccctca

SEQ ID NO: 229645 - DNA, 18 bp, Caenorhabditis elegans
gttctatcaagaattctt

SEQ ID NO: 229646 - DNA, 23 bp, Caenorhabditis elegans
tattcaagtaatgtagcaaaatg

SEQ ID NO: 229647 - DNA, 20 bp, Caenorhabditis elegans
tatatacttgaataaggttg

SEQ ID NO: 229648 - DNA, 23 bp, Caenorhabditis elegans
aatgagagaagagagttggctca

SEQ ID NO: 229649 - DNA, 23 bp, Caenorhabditis elegans
attgatgttgtggccatgctggt

SEQ ID NO: 229650 - DNA, 23 bp, Caenorhabditis elegans
atatgactgcaattttgatgagt

SEQ ID NO: 229651 - DNA, 23 bp, Caenorhabditis elegans
aaacttggatttgatatgatcct

SEQ ID NO: 229652 - DNA, 21 bp, Caenorhabditis elegans
tcttcagtgtccaattctacc

SEQ ID NO: 229653 - DNA, 21 bp, Caenorhabditis elegans
aggagcacttattcatttgaa

SEQ ID NO: 229654 - DNA, 23 bp, Caenorhabditis elegans
aacgtttttctctatttggtgaa

SEQ ID NO: 229655 - DNA, 22 bp, Caenorhabditis elegans
cctctcaccctctctgtctcgt

SEQ ID NO: 229656 - DNA, 22 bp, Caenorhabditis elegans
aactttgatttttctgcgagat

SEQ ID NO: 229657 - DNA, 18 bp, Caenorhabditis elegans
tctttttcacacgctctc

SEQ ID NO: 229658 - DNA, 21 bp, Caenorhabditis elegans
tagcactcagcatttgacgag

SEQ ID NO: 229659 - DNA, 23 bp, Caenorhabditis elegans
tctgtgtctgtcataagttcggt

SEQ ID NO: 229660 - DNA, 21 bp, Caenorhabditis elegans
tcaagtaatgtagcaaaatgt

SEQ ID NO: 229661 - DNA, 23 bp, Caenorhabditis elegans
gttatctcactcctctttctgtg

SEQ ID NO: 229662 - DNA, 22 bp, Caenorhabditis elegans
ttccattcttttcaagctgtcg

SEQ ID NO: 229663 - DNA, 23 bp, Caenorhabditis elegans
atgatctttaactaactgctatg

SEQ ID NO: 229664 - DNA, 20 bp, Caenorhabditis elegans
ctcacattttctctcactga

SEQ ID NO: 229665 - DNA, 19 bp, Caenorhabditis elegans
tcaatagtttgaaaccagt

SEQ ID NO: 229666 - DNA, 23 bp, Caenorhabditis elegans
tacaaagtatttgaaaagtcgtg

SEQ ID NO: 229667 - DNA, 23 bp, Caenorhabditis elegans
aaatgcatttaaatacatttgtg

SEQ ID NO: 229668 - DNA, 20 bp, Caenorhabditis elegans
aatccaagttttgccaaagt

SEQ ID NO: 229669 - DNA, 23 bp, Caenorhabditis elegans
gctttctatctcactctctgcgt

SEQ ID NO: 229670 - DNA, 23 bp, Caenorhabditis elegans
tagagaagtgacagtttgagctg

SEQ ID NO: 229671 - DNA, 19 bp, Caenorhabditis elegans
cagaaaatacttgatgtgt

SEQ ID NO: 229672 - DNA, 21 bp, Caenorhabditis elegans
tcaagtaatgtagcaaaatgt

SEQ ID NO: 229673 - DNA, 23 bp, Caenorhabditis elegans
cagagatgagagtcacgacacga

SEQ ID NO: 229674 - DNA, 23 bp, Caenorhabditis elegans
atttcaacgtcatctgcttccgg

SEQ ID NO: 229675 - DNA, 21 bp, Caenorhabditis elegans
aatgtgcatgccataaatgcc

SEQ ID NO: 229676 - DNA, 23 bp, Caenorhabditis elegans
tagaagtggttgacgagtgtttt

SEQ ID NO: 229677 - DNA, 23 bp, Caenorhabditis elegans
tttgggagtttgttatgctgtag

SEQ ID NO: 229678 - DNA, 22 bp, Caenorhabditis elegans
taggcaggtgtaggtcgtgagt

SEQ ID NO: 229679 - DNA, 23 bp, Caenorhabditis elegans
tcaccgggtggaaactagcagtg

SEQ ID NO: 229680 - DNA, 22 bp, Caenorhabditis elegans
tcaccgggtgaaaattcgcatg

SEQ ID NO: 229681 - DNA, 20 bp, Caenorhabditis elegans
ccttggaccagtgtgggtgt

SEQ ID NO: 229682 - DNA, 22 bp, Caenorhabditis elegans
tcaccgggtgaacacttgcagt

SEQ ID NO: 229683 - DNA, 22 bp, Caenorhabditis elegans
tcaccgggagaaaaactggagt

SEQ ID NO: 229684 - DNA, 23 bp, Caenorhabditis elegans
tcaccgggtgtaaatcagcttgg

SEQ ID NO: 229685 - DNA, 22 bp, Caenorhabditis elegans
tcaccgggtgtacatcagctaa

SEQ ID NO: 229686 - DNA, 22 bp, Caenorhabditis elegans
tcccagagaccttggtggtttt

SEQ ID NO: 229687 - DNA, 23 bp, Caenorhabditis elegans
tcaccgggtgaaaaatcacctag

SEQ ID NO: 229688 - DNA, 22 bp, Caenorhabditis elegans
aaaagtgtaatgttttcttttt

SEQ ID NO: 229689 - DNA, 23 bp, Caenorhabditis elegans
atatgtattagttaatgtgtatg

SEQ ID NO: 229690 - DNA, 23 bp, Caenorhabditis elegans
tctatgtatatatgtagatttac

SEQ ID NO: 229691 - DNA, 23 bp, Caenorhabditis elegans
ggtttttatgttttgaaaactga

SEQ ID NO: 229692 - DNA, 20 bp, Caenorhabditis elegans
aaaaccatcaaaatttcgga

SEQ ID NO: 229693 - DNA, 22 bp, Caenorhabditis elegans
ttcatcaggccatagctgtcca

SEQ ID NO: 229694 - DNA, 18 bp, Caenorhabditis elegans
attggtatagagtttgga

SEQ ID NO: 229695 - DNA, 22 bp, Caenorhabditis elegans
aatctggttttttattcagaaa

SEQ ID NO: 229696 - DNA, 23 bp, Caenorhabditis elegans
gctttgagtggattgttgaatcg

SEQ ID NO: 229697 - DNA, 22 bp, Caenorhabditis elegans
gctcacttgttgtggatctggt

SEQ ID NO: 229698 - DNA, 23 bp, Caenorhabditis elegans
ttttttgtagatcaaatcgtgat

SEQ ID NO: 229699 - DNA, 22 bp, Caenorhabditis elegans
aattttcaaattttctagatgt

SEQ ID NO: 229700 - DNA, 21 bp, Caenorhabditis elegans
tgtgtagtacaaaacgctttg

SEQ ID NO: 229701 - DNA, 21 bp, Caenorhabditis elegans
tttttggataaaaattgaaaa

SEQ ID NO: 229702 - DNA, 23 bp, Caenorhabditis elegans
tcacacacactgtctcgtttgga

SEQ ID NO: 229703 - DNA, 23 bp, Caenorhabditis elegans
tttaatgtttgaaagtttttgaa

SEQ ID NO: 229704 - DNA, 20 bp, Caenorhabditis elegans
attcgaattcaaactagagt

SEQ ID NO: 229705 - DNA, 20 bp, Caenorhabditis elegans
tgcccgtactgtgtcggctg

SEQ ID NO: 229706 - DNA, 22 bp, Caenorhabditis elegans
tgacaacttcttgctagctttt

SEQ ID NO: 229707 - DNA, 21 bp, Caenorhabditis elegans
tttagaaaattttggaaatgt

SEQ ID NO: 229708 - DNA, 21 bp, Caenorhabditis elegans
acccggttagtttttgggatg

SEQ ID NO: 229709 - DNA, 23 bp, Caenorhabditis elegans
tgagcttgaaactgcattttttg

SEQ ID NO: 229710 - DNA, 20 bp, Caenorhabditis elegans
atctcactgcttcaaattcc

SEQ ID NO: 229711 - DNA, 23 bp, Caenorhabditis elegans
ttattgctcgagaataccctttg

SEQ ID NO: 229712 - DNA, 21 bp, Caenorhabditis elegans
tttatgatgagttgctaaact

SEQ ID NO: 229713 - DNA, 22 bp, Caenorhabditis elegans
atagagcatgcaaattgcatgt

SEQ ID NO: 229714 - DNA, 23 bp, Caenorhabditis elegans
attattacgtaatgtatatgtat

SEQ ID NO: 229715 - DNA, 23 bp, Caenorhabditis elegans
tatacagtgtatatataatgtat

SEQ ID NO: 229716 - DNA, 22 bp, Caenorhabditis elegans
tgacagtctatgtctctgagta

SEQ ID NO: 229717 - DNA, 22 bp, Caenorhabditis elegans
gttgttgttgctgtttagctct

SEQ ID NO: 229718 - DNA, 22 bp, Caenorhabditis elegans
accccgtgaagtgtctgctgca

SEQ ID NO: 229719 - DNA, 21 bp, Caenorhabditis elegans
tagatatagatgcagtcgact

SEQ ID NO: 229720 - DNA, 22 bp, Caenorhabditis elegans
tcacggccagaaatagtcgaat

SEQ ID NO: 229721 - DNA, 21 bp, Caenorhabditis elegans
tcaagtaatgtagcaaaatgt

SEQ ID NO: 229722 - DNA, 18 bp, Caenorhabditis elegans
taaaatacatttgtgacg

SEQ ID NO: 229723 - DNA, 22 bp, Caenorhabditis elegans
tttcatagttttttttagtgtg

SEQ ID NO: 229724 - DNA, 19 bp, Caenorhabditis elegans
tagttttttttttcgatag

SEQ ID NO: 229725 - DNA, 19 bp, Caenorhabditis elegans
aaaactgtgaaaaatcgat

SEQ ID NO: 229726 - DNA, 21 bp, Caenorhabditis elegans
tgactagagacacattcagct

SEQ ID NO: 229727 - DNA, 23 bp, Caenorhabditis elegans
taagtagtagtgccgcaggtaac

SEQ ID NO: 229728 - DNA, 23 bp, Caenorhabditis elegans
tgatgtctggacatgttcggttt

SEQ ID NO: 229729 - DNA, 18 bp, Caenorhabditis elegans
aattgaggccaatgctgt

SEQ ID NO: 229730 - DNA, 20 bp, Caenorhabditis elegans
aatccaagttttgccaaagt

SEQ ID NO: 229731 - DNA, 20 bp, Caenorhabditis elegans
actttcgaaggtattctgat

SEQ ID NO: 229732 - DNA, 23 bp, Caenorhabditis elegans
tgtgtatatttgtgtctcctata

SEQ ID NO: 229733 - DNA, 23 bp, Caenorhabditis elegans
gaagtcctggggctcctggtggt

SEQ ID NO: 229734 - DNA, 23 bp, Caenorhabditis elegans
tcttattgtgctccatttctcta

SEQ ID NO: 229735 - DNA, 23 bp, Caenorhabditis elegans
taccctgtagatcgagctgtgtg

SEQ ID NO: 229736 - DNA, 18 bp, Caenorhabditis elegans
tagactacaaggtgcacg

SEQ ID NO: 229737 - DNA, 23 bp, Caenorhabditis elegans
tacctgttcaatatttagactga

SEQ ID NO: 229738 - DNA, 23 bp, Caenorhabditis elegans
taatactgtcaggtaatgacgct

SEQ ID NO: 229739 - DNA, 23 bp, Caenorhabditis elegans
tctctagttcgttgaatagtatc

SEQ ID NO: 229740 - DNA, 23 bp, Caenorhabditis elegans
agctgttctatgtttacacaagt

SEQ ID NO: 229741 - DNA, 18 bp, Caenorhabditis elegans
tatattgatgttgatcat

SEQ ID NO: 229742 - DNA, 23 bp, Caenorhabditis elegans
cttgttcttgaactggaagagtg

SEQ ID NO: 229743 - DNA, 23 bp, Caenorhabditis elegans
tattatgcacattttctagttca

SEQ ID NO: 229744 - DNA, 20 bp, Caenorhabditis elegans
tgtgaaaatgtattttcttt

SEQ ID NO: 229745 - DNA, 22 bp, Caenorhabditis elegans
tggtactgcatcttcaactgct

SEQ ID NO: 229746 - DNA, 23 bp, Caenorhabditis elegans
tccgagttccttttgtattctga

SEQ ID NO: 229747 - DNA, 22 bp, Caenorhabditis elegans
tcagtggcttagaggtggtggc

SEQ ID NO: 229748 - DNA, 21 bp, Caenorhabditis elegans
tcaagtaatgtagcaaaatgt

SEQ ID NO: 229749 - DNA, 23 bp, Caenorhabditis elegans
agcagctagacagatgtgctcgc

SEQ ID NO: 229750 - DNA, 23 bp, Caenorhabditis elegans
tgagtgatgagacggtgcacagg

SEQ ID NO: 229751 - DNA, 23 bp, Caenorhabditis elegans
tgacagattgtggtggtagtggt

SEQ ID NO: 229752 - DNA, 20 bp, Caenorhabditis elegans
atggtagtgttactgtactg

SEQ ID NO: 229753 - DNA, 23 bp, Caenorhabditis elegans
tggtagagtagtgatattgtagt

SEQ ID NO: 229754 - DNA, 19 bp, Caenorhabditis elegans
agaaaaagcttgaattgtt

SEQ ID NO: 229755 - DNA, 23 bp, Caenorhabditis elegans
ttagagctacttttaatttgtct

SEQ ID NO: 229756 - DNA, 21 bp, Caenorhabditis elegans
tgtctgcgtctctcactctct

SEQ ID NO: 229757 - DNA, 23 bp, Caenorhabditis elegans
ctctctctctcagcttttcagct

SEQ ID NO: 229758 - DNA, 23 bp, Caenorhabditis elegans
ttttgtcattttgtacatgtgag

SEQ ID NO: 229759 - DNA, 23 bp, Caenorhabditis elegans
tttcagaagttttttctatgaat

SEQ ID NO: 229760 - DNA, 18 bp, Caenorhabditis elegans
agggctccatcaaagtgc

SEQ ID NO: 229761 - DNA, 23 bp, Caenorhabditis elegans
tgaaaagattttggactggaggt

SEQ ID NO: 229762 - DNA, 18 bp, Caenorhabditis elegans
aggggtaagagagtgtga

SEQ ID NO: 229763 - DNA, 18 bp, Caenorhabditis elegans
tcagtagagcgcagtttc

SEQ ID NO: 229764 - DNA, 23 bp, Caenorhabditis elegans
taaagttgatgagcaagaggtga

SEQ ID NO: 229765 - DNA, 23 bp, Caenorhabditis elegans
tgtctgcctgtctgcgtctctcc

SEQ ID NO: 229766 - DNA, 20 bp, Caenorhabditis elegans
tgtgtgagggagagacgcag

SEQ ID NO: 229767 - DNA, 23 bp, Caenorhabditis elegans
cgttgcaatagttactcaactgt

SEQ ID NO: 229768 - DNA, 21 bp, Caenorhabditis elegans
aaaattttagagtgttccaga

SEQ ID NO: 229769 - DNA, 22 bp, Caenorhabditis elegans
tagccatttgttgaaaatgcgt

SEQ ID NO: 229770 - DNA, 23 bp, Caenorhabditis elegans
ttaagagcaaaatcaatagtttt

SEQ ID NO: 229771 - DNA, 23 bp, Caenorhabditis elegans
tcgaagaaaaatgagtttggtct

SEQ ID NO: 229772 - DNA, 21 bp, Caenorhabditis elegans
ttagcagacacaaattgaaga

SEQ ID NO: 229773 - DNA, 20 bp, Caenorhabditis elegans
attgaataaagtttgagcac

SEQ ID NO: 229774 - DNA, 22 bp, Caenorhabditis elegans
ctagttctacagtaacttgact

SEQ ID NO: 229775 - DNA, 20 bp, Caenorhabditis elegans
ttgagctatatggttaaatg

SEQ ID NO: 229776 - DNA, 18 bp, Caenorhabditis elegans
aagctcgaaagttttttt

SEQ ID NO: 229777 - DNA, 19 bp, Caenorhabditis elegans
agaccaaaaattttcaatt

SEQ ID NO: 229778 - DNA, 22 bp, Caenorhabditis elegans
tttttcagcgggaaaatgaaca

SEQ ID NO: 229779 - DNA, 21 bp, Caenorhabditis elegans
aaacatccctgatcaacacat

SEQ ID NO: 229780 - DNA, 22 bp, Caenorhabditis elegans
gtctgcgtctctccctctctca

SEQ ID NO: 229781 - DNA, 21 bp, Caenorhabditis elegans
tcgaaatcttgttactttttc

SEQ ID NO: 229782 - DNA, 23 bp, Caenorhabditis elegans
cagtcagtcagtctctctccact

SEQ ID NO: 229783 - DNA, 23 bp, Caenorhabditis elegans
tatgacactgaagcgttaccgaa

SEQ ID NO: 229784 - DNA, 23 bp, Caenorhabditis elegans
tatgacactgaagcgtaaccgaa

SEQ ID NO: 229785 - DNA, 21 bp, Caenorhabditis elegans
aaacggccacaaaaatgccat

SEQ ID NO: 229786 - DNA, 23 bp, Caenorhabditis elegans
catgacactgattagggatgtga

SEQ ID NO: 229787 - DNA, 23 bp, Caenorhabditis elegans
tggcgtatgtggttgtagttggt

SEQ ID NO: 229788 - DNA, 23 bp, Caenorhabditis elegans
tctctgaatttctctctgtttga

SEQ ID NO: 229789 - DNA, 23 bp, Caenorhabditis elegans
tgcctgcctgcctgactacctgc

SEQ ID NO: 229790 - DNA, 23 bp, Caenorhabditis elegans
tcgctgtctgcgtctctccctgt

SEQ ID NO: 229791 - DNA, 23 bp, Caenorhabditis elegans
cactgcgtctctccctctcccac

SEQ ID NO: 229792 - DNA, 22 bp, Caenorhabditis elegans
gcttcacaatagtcgaatacct

SEQ ID NO: 229793 - DNA, 23 bp, Caenorhabditis elegans
attcgttgttgatgaagccttga

SEQ ID NO: 229794 - DNA, 20 bp, Caenorhabditis elegans
cactgccacactctctcgct

SEQ ID NO: 229795 - DNA, 20 bp, Caenorhabditis elegans
aactgacattttgtagaact

SEQ ID NO: 229796 - DNA, 23 bp, Caenorhabditis elegans
caaaatgtatttcaatacatttg

SEQ ID NO: 229797 - DNA, 23 bp, Caenorhabditis elegans
acaaatgtatttgaatacatgtt

SEQ ID NO: 229798 - DNA, 19 bp, Caenorhabditis elegans
gtttgatgatgaagctgat

SEQ ID NO: 229799 - DNA, 23 bp, Caenorhabditis elegans
actatcatcatcatcatcatcat

SEQ ID NO: 229800 - DNA, 20 bp, Caenorhabditis elegans
tgaatttccactgaaattga

SEQ ID NO: 229801 - DNA, 22 bp, Caenorhabditis elegans
tttgatttttcaagtttttgga

SEQ ID NO: 229802 - DNA, 20 bp, Caenorhabditis elegans
tatgaggtggaggaggagga

SEQ ID NO: 229803 - DNA, 22 bp, Caenorhabditis elegans
agtttcattatgaaattcggtg

SEQ ID NO: 229804 - DNA, 23 bp, Caenorhabditis elegans
aaaacatcaaagtcagtacttgg

SEQ ID NO: 229805 - DNA, 21 bp, Caenorhabditis elegans
tacactgtctctgtgttcatc

SEQ ID NO: 229806 - DNA, 18 bp, Caenorhabditis elegans
agagaagcgagagtgtct

SEQ ID NO: 229807 - DNA, 20 bp, Caenorhabditis elegans
agagagatgagaaagtgccc

SEQ ID NO: 229808 - DNA, 23 bp, Caenorhabditis elegans
tgtctgcgtctctctgtaactct

SEQ ID NO: 229809 - DNA, 23 bp, Caenorhabditis elegans
atagtagtagttcttgaggagct

SEQ ID NO: 229810 - DNA, 23 bp, Caenorhabditis elegans
aaatgcatttaaatacatttgtg

SEQ ID NO: 229811 - DNA, 23 bp, Caenorhabditis elegans
gtcaagagtaaggcatatgagtt

SEQ ID NO: 229812 - DNA, 22 bp, Caenorhabditis elegans
aaacgctgagcatctttcctcg

SEQ ID NO: 229813 - DNA, 18 bp, Caenorhabditis elegans
ttgaggtagttgttgaag

SEQ ID NO: 229814 - DNA, 23 bp, Caenorhabditis elegans
tctcggtctctccgtctcaaagg

SEQ ID NO: 229815 - DNA, 21 bp, Caenorhabditis elegans
aatcgtattgatacgagctcg

SEQ ID NO: 229816 - DNA, 23 bp, Caenorhabditis elegans
cctagttggttctatggtttcca

SEQ ID NO: 229817 - DNA, 23 bp, Caenorhabditis elegans
tactctttctctgtctctttcta

SEQ ID NO: 229818 - DNA, 18 bp, Caenorhabditis elegans
agcaatacaatcgaaaat

SEQ ID NO: 229819 - DNA, 20 bp, Caenorhabditis elegans
tctcctcctcatttcatgat

SEQ ID NO: 229820 - DNA, 23 bp, Caenorhabditis elegans
agagcagcagtaggagcagcaga

SEQ ID NO: 229821 - DNA, 23 bp, Caenorhabditis elegans
actctgtctctcagggaaccacg

SEQ ID NO: 229822 - DNA, 19 bp, Caenorhabditis elegans
tgagcaaaaaaaacctatt

SEQ ID NO: 229823 - DNA, 19 bp, Caenorhabditis elegans
aattcacaatttttttttg

SEQ ID NO: 229824 - DNA, 23 bp, Caenorhabditis elegans
aaaaggttctagaacattccaga

SEQ ID NO: 229825 - DNA, 22 bp, Caenorhabditis elegans
aaggttctagaacattccagaa

SEQ ID NO: 229826 - DNA, 22 bp, Caenorhabditis elegans
attcaagtaatgtagcaaaatg

SEQ ID NO: 229827 - DNA, 23 bp, Caenorhabditis elegans
tttatctacttgaataaggttgt

SEQ ID NO: 229828 - DNA, 19 bp, Caenorhabditis elegans
ttttttggtgtgggtgtgt

SEQ ID NO: 229829 - DNA, 21 bp, Caenorhabditis elegans
tcaagtaatgtagcaaaatgt

SEQ ID NO: 229830 - DNA, 21 bp, Caenorhabditis elegans
tcaagtaatgtagcaaaatgt

SEQ ID NO: 229831 - DNA, 23 bp, Caenorhabditis elegans
tgtcatggagtcgctctcttcag

SEQ ID NO: 229832 - DNA, 18 bp, Caenorhabditis elegans
ttctgagacgagtagaag

SEQ ID NO: 229833 - DNA, 22 bp, Caenorhabditis elegans
cagtgactggagggtctagagg

SEQ ID NO: 229834 - DNA, 23 bp, Caenorhabditis elegans
ttcactcactctcttattgatca

SEQ ID NO: 229835 - DNA, 23 bp, Caenorhabditis elegans
actgcgtctctctggcactgtgc

SEQ ID NO: 229836 - DNA, 23 bp, Caenorhabditis elegans
gattttgcatgatttggcaagca

SEQ ID NO: 229837 - DNA, 21 bp, Caenorhabditis elegans
tggacggctcgatgtttctgt

SEQ ID NO: 229838 - DNA, 18 bp, Caenorhabditis elegans
tcgaaattttttaagttt

SEQ ID NO: 229839 - DNA, 18 bp, Caenorhabditis elegans
ttttcagagaaaatctaa

SEQ ID NO: 229840 - DNA, 18 bp, Caenorhabditis elegans
ttgtcgaacaactagtga

SEQ ID NO: 229841 - DNA, 23 bp, Caenorhabditis elegans
tctcttgatatcctcctgctgct

SEQ ID NO: 229842 - DNA, 22 bp, Caenorhabditis elegans
tctctcactttatcacactcta

SEQ ID NO: 229843 - DNA, 23 bp, Caenorhabditis elegans
actctcacagtctgacatcattc

SEQ ID NO: 229844 - DNA, 23 bp, Caenorhabditis elegans
aagacaagatggtgtggagatga

SEQ ID NO: 229845 - DNA, 18 bp, Caenorhabditis elegans
tttccaaatttttggtaa

SEQ ID NO: 229846 - DNA, 18 bp, Caenorhabditis elegans
agtatgtaagtagtaagt

SEQ ID NO: 229847 - DNA, 23 bp, Caenorhabditis elegans
aaggtcgttgtctgtgttgctgt

SEQ ID NO: 229848 - DNA, 23 bp, Caenorhabditis elegans
aatccaagttttgccaaagtctt

SEQ ID NO: 229849 - DNA, 19 bp, Caenorhabditis elegans
tcacaggtgtaaatcagtg

SEQ ID NO: 229850 - DNA, 22 bp, Caenorhabditis elegans
ttttaagcgtgctttttaatcg

SEQ ID NO: 229851 - DNA, 23 bp, Caenorhabditis elegans
taagtgaatgctttgccacagtc

SEQ ID NO: 229852 - DNA, 21 bp, Caenorhabditis elegans
tgccacacaataatttttgtt

SEQ ID NO: 229853 - DNA, 21 bp, Caenorhabditis elegans
aaattttgtgattcttatgat

SEQ ID NO: 229854 - DNA, 19 bp, Caenorhabditis elegans
tgtagacttgtatgcttgt

SEQ ID NO: 229855 - DNA, 19 bp, Caenorhabditis elegans
tatatacttgaatacagtt

SEQ ID NO: 229856 - DNA, 18 bp, Caenorhabditis elegans
tgcgagagtgagagggcg

SEQ ID NO: 229857 - DNA, 19 bp, Caenorhabditis elegans
tgtctgcgtctatctctct

SEQ ID NO: 229858 - DNA, 22 bp, Caenorhabditis elegans
ttcaaaattgaagatgttgatt

SEQ ID NO: 229859 - DNA, 21 bp, Caenorhabditis elegans
atttttacagatattgttgga

SEQ ID NO: 229860 - DNA, 23 bp, Caenorhabditis elegans
tttttcatagtttttcaagagaa

SEQ ID NO: 229861 - DNA, 23 bp, Caenorhabditis elegans
acagattttctagttctgagaat

SEQ ID NO: 229862 - DNA, 23 bp, Caenorhabditis elegans
atgaacaggacaatccagaagtg

SEQ ID NO: 229863 - DNA, 23 bp, Caenorhabditis elegans
tttctctcgattcactctctctc

SEQ ID NO: 229864 - DNA, 19 bp, Caenorhabditis elegans
gaaatgagagaaaggtgtt

SEQ ID NO: 229865 - DNA, 22 bp, Caenorhabditis elegans
tgatatgttgtttgaatgcccc

SEQ ID NO: 229866 - DNA, 23 bp, Caenorhabditis elegans
ttgactgtttggatgttctcgga

SEQ ID NO: 229867 - DNA, 23 bp, Caenorhabditis elegans
tttgtactccgatgccattcaga

SEQ ID NO: 229868 - DNA, 21 bp, Caenorhabditis elegans
tcaagtaatgtagcaaaatgt

SEQ ID NO: 229869 - DNA, 20 bp, Caenorhabditis elegans
gcgagcgtctctttccggct

SEQ ID NO: 229870 - DNA, 23 bp, Caenorhabditis elegans
catttagcacgtgaaagttttga

SEQ ID NO: 229871 - DNA, 18 bp, Caenorhabditis elegans
ttaaccaaattttcagat

SEQ ID NO: 229872 - DNA, 23 bp, Caenorhabditis elegans
tacgtgcctgtgtgcctacgtgc

SEQ ID NO: 229873 - DNA, 23 bp, Caenorhabditis elegans
tacgtgcctgtgtgcctacgtgc

SEQ ID NO: 229874 - DNA, 19 bp, Caenorhabditis elegans
tatatacttgaatacagtt

SEQ ID NO: 229875 - DNA, 23 bp, Caenorhabditis elegans
tatgtttgcatttgttgctgatt

SEQ ID NO: 229876 - DNA, 23 bp, Caenorhabditis elegans
ataagttgttcaatgtggaaaat

SEQ ID NO: 229877 - DNA, 22 bp, Caenorhabditis elegans
acagtacttggagacgtggtag

SEQ ID NO: 229878 - DNA, 23 bp, Caenorhabditis elegans
attggtgttctaccttgtttaaa

SEQ ID NO: 229879 - DNA, 21 bp, Caenorhabditis elegans
cacaggttgttctgactgttt

SEQ ID NO: 229880 - DNA, 23 bp, Caenorhabditis elegans
taagctcgtgatcaacaggcaga

SEQ ID NO: 229881 - DNA, 21 bp, Caenorhabditis elegans
atcggtgactatttgctatgt

SEQ ID NO: 229882 - DNA, 23 bp, Caenorhabditis elegans
atatactgtggagatgttctcaa

SEQ ID NO: 229883 - DNA, 21 bp, Caenorhabditis elegans
tttcacaaactattactaaaa

SEQ ID NO: 229884 - DNA, 23 bp, Caenorhabditis elegans
acagcttctgcaagaggaggtgg

SEQ ID NO: 229885 - DNA, 19 bp, Caenorhabditis elegans
tcattctgccggttgttat

SEQ ID NO: 229886 - DNA, 23 bp, Caenorhabditis elegans
tcacaacctcctagaaagagtag

SEQ ID NO: 229887 - DNA, 18 bp, Caenorhabditis elegans
gtgtggtttgttgattgc

SEQ ID NO: 229888 - DNA, 21 bp, Caenorhabditis elegans
tcaagtaatgtagcaaaatgt

SEQ ID NO: 229889 - DNA, 20 bp, Caenorhabditis elegans
tggtccatgatttaagcata

SEQ ID NO: 229890 - DNA, 23 bp, Caenorhabditis elegans
tatatgaatctatatattggaga

SEQ ID NO: 229891 - DNA, 23 bp, Caenorhabditis elegans
cttgtctcagtctgtcacagtcg

SEQ ID NO: 229892 - DNA, 21 bp, Caenorhabditis elegans
aatgggtgtgtgctcgtgtgt

SEQ ID NO: 229893 - DNA, 21 bp, Caenorhabditis elegans
tggcggtttctttttccgttc

SEQ ID NO: 229894 - DNA, 19 bp, Caenorhabditis elegans
agactagagagagagagag

SEQ ID NO: 229895 - DNA, 23 bp, Caenorhabditis elegans
actttgttaagcaattttttact

SEQ ID NO: 229896 - DNA, 18 bp, Caenorhabditis elegans
aaatctgagaatttttga

SEQ ID NO: 229897 - DNA, 21 bp, Caenorhabditis elegans
aacagagttgttcatcaacaa

SEQ ID NO: 229898 - DNA, 20 bp, Caenorhabditis elegans
ttttgttagttggaaacttt

SEQ ID NO: 229899 - DNA, 23 bp, Caenorhabditis elegans
cgtctcactctctgacatctccc

SEQ ID NO: 229900 - DNA, 23 bp, Caenorhabditis elegans
tccgaaaattttcagcaattgcc

SEQ ID NO: 229901 - DNA, 21 bp, Caenorhabditis elegans
tgtgtcagtgtcacttggttc

SEQ ID NO: 229902 - DNA, 23 bp, Caenorhabditis elegans
tctgcgtctctcgccctctctca

SEQ ID NO: 229903 - DNA, 20 bp, Caenorhabditis elegans
attttcagatttgccacggc

SEQ ID NO: 229904 - DNA, 22 bp, Caenorhabditis elegans
aaattttcagattttcgaaaag

SEQ ID NO: 229905 - DNA, 22 bp, Caenorhabditis elegans
tgttacactgtctgcgtctcct

SEQ ID NO: 229906 - DNA, 22 bp, Caenorhabditis elegans
ctcctgcaattacaacactatc

SEQ ID NO: 229907 - DNA, 23 bp, Caenorhabditis elegans
atgccagtacatgcgtagttgtg

SEQ ID NO: 229908 - DNA, 23 bp, Caenorhabditis elegans
tcactgtctgcgtctctccacac

SEQ ID NO: 229909 - DNA, 21 bp, Caenorhabditis elegans
tcaagtaatgtagcaaaatgt

SEQ ID NO: 229910 - DNA, 22 bp, Caenorhabditis elegans
cgaacttttgttctcttgcagg

SEQ ID NO: 229911 - DNA, 21 bp, Caenorhabditis elegans
tcaagtaatgtagcaaaatgt

SEQ ID NO: 229912 - DNA, 19 bp, Caenorhabditis elegans
gtgtgcaatgaagtttgga

SEQ ID NO: 229913 - DNA, 21 bp, Caenorhabditis elegans
aatccaagttttgccaaagtt

SEQ ID NO: 229914 - DNA, 23 bp, Caenorhabditis elegans
tctccaaattttcatgttcatca

SEQ ID NO: 229915 - DNA, 23 bp, Caenorhabditis elegans
tgactgaacctgataaaatgaaa

SEQ ID NO: 229916 - DNA, 22 bp, Caenorhabditis elegans
accaattgatttgagcttcatt

SEQ ID NO: 229917 - DNA, 20 bp, Caenorhabditis elegans
ttaaaggtctatatcttggc

SEQ ID NO: 229918 - DNA, 22 bp, Caenorhabditis elegans
ttggcttaaaatccagttttgt

SEQ ID NO: 229919 - DNA, 22 bp, Caenorhabditis elegans
ttgattgaacctgataaaatga

SEQ ID NO: 229920 - DNA, 23 bp, Caenorhabditis elegans
cagtgatcacacactctgttact

SEQ ID NO: 229921 - DNA, 19 bp, Caenorhabditis elegans
atagagtggatagatctgg

SEQ ID NO: 229922 - DNA, 22 bp, Caenorhabditis elegans
tctctctctcactgcctcagaa

SEQ ID NO: 229923 - DNA, 22 bp, Caenorhabditis elegans
aaaactggggggagatgaagct

SEQ ID NO: 229924 - DNA, 23 bp, Caenorhabditis elegans
ttgaatgatgatgatgatgatgg

SEQ ID NO: 229925 - DNA, 20 bp, Caenorhabditis elegans
atcgcaacatttgcaattct

SEQ ID NO: 229926 - DNA, 21 bp, Caenorhabditis elegans
ttcaagtagtgtagcaaaatg

SEQ ID NO: 229927 - DNA, 19 bp, Caenorhabditis elegans
tatatacttgaatacagtt

SEQ ID NO: 229928 - DNA, 21 bp, Caenorhabditis elegans
aattttttgtttttgatctag

SEQ ID NO: 229929 - DNA, 19 bp, Caenorhabditis elegans
aaccatcacaaattcgatt

SEQ ID NO: 229930 - DNA, 19 bp, Caenorhabditis elegans
attggaacaaaaaaagtga

SEQ ID NO: 229931 - DNA, 20 bp, Caenorhabditis elegans
agtgaacagtttgggtctca

SEQ ID NO: 229932 - DNA, 23 bp, Caenorhabditis elegans
agtaacagcaagtggaagtcctt

SEQ ID NO: 229933 - DNA, 22 bp, Caenorhabditis elegans
ttgccctactcttcgcatctca

SEQ ID NO: 229934 - DNA, 22 bp, Caenorhabditis elegans
tgagatcgttcagtacggcaat

SEQ ID NO: 229935 - DNA, 19 bp, Caenorhabditis elegans
tcactttctctaattctcc

SEQ ID NO: 229936 - DNA, 19 bp, Caenorhabditis elegans
agtatgtcagaaataatgt

SEQ ID NO: 229937 - DNA, 21 bp, Caenorhabditis elegans
ttgcgtaggcctttgcttcga

SEQ ID NO: 229938 - DNA, 23 bp, Caenorhabditis elegans
cggtacgatcgcggcgggatatc

SEQ ID NO: 229939 - DNA, 22 bp, Caenorhabditis elegans
tgtgcaataggaggcattttgt

SEQ ID NO: 229940 - DNA, 23 bp, Caenorhabditis elegans
gatgcctgcctgcctgcttgcca

SEQ ID NO: 229941 - DNA, 23 bp, Caenorhabditis elegans
gcctgcctgcctgcctgcctgcc

SEQ ID NO: 229942 - DNA, 22 bp, Caenorhabditis elegans
aagttaggattacatgcagttt

SEQ ID NO: 229943 - DNA, 22 bp, Caenorhabditis elegans
tgtgggcctgaaaaaaaacaga

SEQ ID NO: 229944 - DNA, 21 bp, Caenorhabditis elegans
aatccaagttttgccaaactt

SEQ ID NO: 229945 - DNA, 21 bp, Caenorhabditis elegans
aatccaagttttgccaaactt

SEQ ID NO: 229946 - DNA, 23 bp, Caenorhabditis elegans
ttggaaccaattgatttgagcgt

SEQ ID NO: 229947 - DNA, 20 bp, Caenorhabditis elegans
ttaaaggtctatatcttggg

SEQ ID NO: 229948 - DNA, 23 bp, Caenorhabditis elegans
aatggcactgcatgaattcacgg

SEQ ID NO: 229949 - DNA, 19 bp, Caenorhabditis elegans
tgtgtcaggcacgtctttc

SEQ ID NO: 229950 - DNA, 21 bp, Caenorhabditis elegans
aatccaagttttgccaaactt

SEQ ID NO: 229951 - DNA, 18 bp, Caenorhabditis elegans
atttcaaaccaaatcaaa

SEQ ID NO: 229952 - DNA, 19 bp, Caenorhabditis elegans
ttttgatttgtttggaaaa

SEQ ID NO: 229953 - DNA, 21 bp, Caenorhabditis elegans
tcaagtaatgtagcaaaatgt

SEQ ID NO: 229954 - DNA, 21 bp, Caenorhabditis elegans
aacagaattatgtgaggagtt

SEQ ID NO: 229955 - DNA, 20 bp, Caenorhabditis elegans
attttgtaacttgtattgaa

SEQ ID NO: 229956 - DNA, 23 bp, Caenorhabditis elegans
aagctgagtggaattgttggagc

SEQ ID NO: 229957 - DNA, 21 bp, Caenorhabditis elegans
tcaagtaatgtagcaaaatgt

SEQ ID NO: 229958 - DNA, 22 bp, Caenorhabditis elegans
attcaagtaatgtagcaaaatg

SEQ ID NO: 229959 - DNA, 18 bp, Caenorhabditis elegans
tatatacttgaatacagt

SEQ ID NO: 229960 - DNA, 23 bp, Caenorhabditis elegans
tctactagtattgatgatgaaga

SEQ ID NO: 229961 - DNA, 22 bp, Caenorhabditis elegans
ctttgagctccttctccagaga

SEQ ID NO: 229962 - DNA, 23 bp, Caenorhabditis elegans
tctctctttctcattctgtcaaa

SEQ ID NO: 229963 - DNA, 20 bp, Caenorhabditis elegans
attgatcgaagagacagaga

SEQ ID NO: 229964 - DNA, 23 bp, Caenorhabditis elegans
actgaatttatgtgtgtacttga

SEQ ID NO: 229965 - DNA, 23 bp, Caenorhabditis elegans
ctagcaccatataaattcagtaa

SEQ ID NO: 229966 - DNA, 21 bp, Caenorhabditis elegans
tcaagtaatgtagcaaaatgt

SEQ ID NO: 229967 - DNA, 22 bp, Caenorhabditis elegans
tatatgcaagcaaaccaaagga

SEQ ID NO: 229968 - DNA, 22 bp, Caenorhabditis elegans
aatgtgaggttatgtattgtta

SEQ ID NO: 229969 - DNA, 23 bp, Caenorhabditis elegans
tggaatggatagaagattgttga

SEQ ID NO: 229970 - DNA, 23 bp, Caenorhabditis elegans
agatttcttattctgttcgtaaa

SEQ ID NO: 229971 - DNA, 23 bp, Caenorhabditis elegans
aacgttctggaagttgtttgaaa

SEQ ID NO: 229972 - DNA, 23 bp, Caenorhabditis elegans
ttgaatactgattttgaagtcat

SEQ ID NO: 229973 - DNA, 18 bp, Caenorhabditis elegans
tgtggtttacaagcgaca

SEQ ID NO: 229974 - DNA, 19 bp, Caenorhabditis elegans
caaaaacgacttggtgcag

SEQ ID NO: 229975 - DNA, 22 bp, Caenorhabditis elegans
ttacatgtttcgggtaggagct

SEQ ID NO: 229976 - DNA, 23 bp, Caenorhabditis elegans
gacagaacagagaaaacatacct

SEQ ID NO: 229977 - DNA, 21 bp, Caenorhabditis elegans
ttgtcctgtgaattgtgtgac

SEQ ID NO: 229978 - DNA, 19 bp, Caenorhabditis elegans
ttaaaggtctatatcttgg

SEQ ID NO: 229979 - DNA, 23 bp, Caenorhabditis elegans
tttttcaacaggaaatatattga

SEQ ID NO: 229980 - DNA, 18 bp, Caenorhabditis elegans
agtgactttagtggacat

SEQ ID NO: 229981 - DNA, 23 bp, Caenorhabditis elegans
taaggcacgcggtgaatgccacg

SEQ ID NO: 229982 - DNA, 23 bp, Caenorhabditis elegans
gaaagacgagtgaaattgttgac

SEQ ID NO: 229983 - DNA, 23 bp, Caenorhabditis elegans
agatgaagagatacttacaacta

SEQ ID NO: 229984 - DNA, 23 bp, Caenorhabditis elegans
cgttgtagttgatgactttttga

SEQ ID NO: 229985 - DNA, 19 bp, Caenorhabditis elegans
tttgctttaaaaaagctct

SEQ ID NO: 229986 - DNA, 22 bp, Caenorhabditis elegans
attcaagtaatgtagcaaaatg

SEQ ID NO: 229987 - DNA, 20 bp, Caenorhabditis elegans
tatatacttgaataaggttg

SEQ ID NO: 229988 - DNA, 23 bp, Caenorhabditis elegans
cacccgtacatatgtttccgtgc

SEQ ID NO: 229989 - DNA, 21 bp, Caenorhabditis elegans
tcaagtaatgtagcaaaatgt

SEQ ID NO: 229990 - DNA, 23 bp, Caenorhabditis elegans
atttttgtttttgaaatggcatc

SEQ ID NO: 229991 - DNA, 22 bp, Caenorhabditis elegans
cgcaacatttttggattgaaag

SEQ ID NO: 229992 - DNA, 23 bp, Caenorhabditis elegans
tcaaagaaattgaaaaaatgaca

SEQ ID NO: 229993 - DNA, 23 bp, Caenorhabditis elegans
attttcatagtttttgatgtctt

SEQ ID NO: 229994 - DNA, 23 bp, Caenorhabditis elegans
actctctcacagtctcttattcc

SEQ ID NO: 229995 - DNA, 23 bp, Caenorhabditis elegans
tttactgtttgaaactttttgaa

SEQ ID NO: 229996 - DNA, 18 bp, Caenorhabditis elegans
aaggaggacacattgaga

SEQ ID NO: 229997 - DNA, 23 bp, Caenorhabditis elegans
gatctcatgtgtttttcttgacg

SEQ ID NO: 229998 - DNA, 23 bp, Caenorhabditis elegans
aaaatctaggttgaatagatgta

SEQ ID NO: 229999 - DNA, 20 bp, Caenorhabditis elegans
atccaagttttgccaaagtt

SEQ ID NO: 230000 - DNA, 23 bp, Caenorhabditis elegans
gaagcaccaaaactactgagttc

SEQ ID NO: 230001 - DNA, 21 bp, Caenorhabditis elegans
aaagtcaatagttttggtcag

SEQ ID NO: 230002 - DNA, 23 bp, Caenorhabditis elegans
tgtaacactgtctgcgtctctgt

SEQ ID NO: 230003 - DNA, 19 bp, Caenorhabditis elegans
tgcttttaaaaagtgaaat

SEQ ID NO: 230004 - DNA, 23 bp, Caenorhabditis elegans
aactgacaggacagagagaggat

SEQ ID NO: 230005 - DNA, 21 bp, Caenorhabditis elegans
tcaatttctaattgagcaaga

SEQ ID NO: 230006 - DNA, 20 bp, Caenorhabditis elegans
ttatgattttttcaactact

SEQ ID NO: 230007 - DNA, 23 bp, Caenorhabditis elegans
agaaggcccggtggaactgcttg

SEQ ID NO: 230008 - DNA, 19 bp, Caenorhabditis elegans
cttatcagtaatttgcgat

SEQ ID NO: 230009 - DNA, 23 bp, Caenorhabditis elegans
ctctgcgtctcacactctcttcc

SEQ ID NO: 230010 - DNA, 23 bp, Caenorhabditis elegans
caaagtgtgtagagagagtggag

SEQ ID NO: 230011 - DNA, 23 bp, Caenorhabditis elegans
tgacaactttttgaaacaggaaa

SEQ ID NO: 230012 - DNA, 23 bp, Caenorhabditis elegans
aaatccactgtttcaacattgtg

SEQ ID NO: 230013 - DNA, 21 bp, Caenorhabditis elegans
tcaaattcactctcactcaca

SEQ ID NO: 230014 - DNA, 21 bp, Caenorhabditis elegans
tttttgttaaaattccattga

SEQ ID NO: 230015 - DNA, 21 bp, Caenorhabditis elegans
aaactgtcggaaaatgttgga

SEQ ID NO: 230016 - DNA, 21 bp, Caenorhabditis elegans
tcaagtaatgtagcaaaatgt

SEQ ID NO: 230017 - DNA, 18 bp, Caenorhabditis elegans
tcaaagcggaaaatgtgt

SEQ ID NO: 230018 - DNA, 23 bp, Caenorhabditis elegans
ttacagagtgcgtgttgtttagt

SEQ ID NO: 230019 - DNA, 21 bp, Caenorhabditis elegans
tcaagtaatgtagcaaaatgt

SEQ ID NO: 230020 - DNA, 18 bp, Caenorhabditis elegans
tgaagctagttttgcgga

SEQ ID NO: 230021 - DNA, 23 bp, Caenorhabditis elegans
tatgtgctaaacgaacactttgt

SEQ ID NO: 230022 - DNA, 23 bp, Caenorhabditis elegans
agaagagagagagcagttagttt

SEQ ID NO: 230023 - DNA, 19 bp, Caenorhabditis elegans
tctggaaatactaatttct

SEQ ID NO: 230024 - DNA, 23 bp, Caenorhabditis elegans
ttgtatgaacaactggatgtcgt

SEQ ID NO: 230025 - DNA, 23 bp, Caenorhabditis elegans
tctcactcactctttgcgctttc

SEQ ID NO: 230026 - DNA, 23 bp, Caenorhabditis elegans
agatgaagagatacttacaacta

SEQ ID NO: 230027 - DNA, 23 bp, Caenorhabditis elegans
cgttgtagttgatgactttttga

SEQ ID NO: 230028 - DNA, 19 bp, Caenorhabditis elegans
tctcctcatgtttacttgg

SEQ ID NO: 230029 - DNA, 23 bp, Caenorhabditis elegans
cctattgtaaggattgtagactg

SEQ ID NO: 230030 - DNA, 23 bp, Caenorhabditis elegans
acaatctctcgttctcttttctt

SEQ ID NO: 230031 - DNA, 23 bp, Caenorhabditis elegans
tcgaatcgtttatcaggatgatg

SEQ ID NO: 230032 - DNA, 23 bp, Caenorhabditis elegans
acccgtacatttgtttccgtgct

SEQ ID NO: 230033 - DNA, 23 bp, Caenorhabditis elegans
tacccgtagctcctatccatgtt

SEQ ID NO: 230034 - DNA, 23 bp, Caenorhabditis elegans
aaaaagtgaacatggaagcaggt

SEQ ID NO: 230035 - DNA, 23 bp, Caenorhabditis elegans
taaatgcatcttaactgcggtga

SEQ ID NO: 230036 - DNA, 21 bp, Caenorhabditis elegans
aagaccatttgaaatgtgaga

SEQ ID NO: 230037 - DNA, 23 bp, Caenorhabditis elegans
ttgtgcatccttttgatttctga

SEQ ID NO: 230038 - DNA, 20 bp, Caenorhabditis elegans
ttttttagttgattgggcta

SEQ ID NO: 230039 - DNA, 23 bp, Caenorhabditis elegans
taatgaaagatctgggacagaga

SEQ ID NO: 230040 - DNA, 18 bp, Caenorhabditis elegans
tgaaaaggtcattcattg

SEQ ID NO: 230041 - DNA, 23 bp, Caenorhabditis elegans
gttgtctgtctctctaaatgtct

SEQ ID NO: 230042 - DNA, 21 bp, Caenorhabditis elegans
tcaagtaatgtagcaaaatgt

SEQ ID NO: 230043 - DNA, 23 bp, Caenorhabditis elegans
aacaactttgtagttgaccggtt

SEQ ID NO: 230044 - DNA, 22 bp, Caenorhabditis elegans
tacagtagtctgcagatttgta

SEQ ID NO: 230045 - DNA, 23 bp, Caenorhabditis elegans
ttgtgtgtttcttgatgacattc

SEQ ID NO: 230046 - DNA, 18 bp, Caenorhabditis elegans
tagactttggtaaagctt

SEQ ID NO: 230047 - DNA, 20 bp, Caenorhabditis elegans
atccaagttttgccaaagtt

SEQ ID NO: 230048 - DNA, 23 bp, Caenorhabditis elegans
ggttctgtctctctctcaccgcc

SEQ ID NO: 230049 - DNA, 23 bp, Caenorhabditis elegans
tttgctgatgaattgaagttgaa

SEQ ID NO: 230050 - DNA, 22 bp, Caenorhabditis elegans
ggtctctctatctcactctcgg

SEQ ID NO: 230051 - DNA, 22 bp, Caenorhabditis elegans
aacagtctgagttttctgattt

SEQ ID NO: 230052 - DNA, 23 bp, Caenorhabditis elegans
tcgctctctcactctgtaaacct

SEQ ID NO: 230053 - DNA, 21 bp, Caenorhabditis elegans
aatccaagttttgccaaactt

SEQ ID NO: 230054 - DNA, 23 bp, Caenorhabditis elegans
actgatgactgtttttgttgtag

SEQ ID NO: 230055 - DNA, 19 bp, Caenorhabditis elegans
tgtgtatgtctgtgtatga

SEQ ID NO: 230056 - DNA, 23 bp, Caenorhabditis elegans
tagaagaaggatttgaaatgtag

SEQ ID NO: 230057 - DNA, 23 bp, Caenorhabditis elegans
aaatgccacagggagaagtctca

SEQ ID NO: 230058 - DNA, 21 bp, Caenorhabditis elegans
aatccaagttttgccaaactt

SEQ ID NO: 230059 - DNA, 21 bp, Caenorhabditis elegans
aatccaagttttgccaaactt

SEQ ID NO: 230060 - DNA, 23 bp, Caenorhabditis elegans
tgtcttctggaattgttctattt

SEQ ID NO: 230061 - DNA, 19 bp, Caenorhabditis elegans
cacggtaaagaacgtgctg

SEQ ID NO: 230062 - DNA, 20 bp, Caenorhabditis elegans
tgagctattttatacttttt

SEQ ID NO: 230063 - DNA, 20 bp, Caenorhabditis elegans
attgcttgtatctttatttg

SEQ ID NO: 230064 - DNA, 23 bp, Caenorhabditis elegans
tgctgagagctaaagttgggcaa

SEQ ID NO: 230065 - DNA, 22 bp, Caenorhabditis elegans
attcaagtaatgtagcaaaatg

SEQ ID NO: 230066 - DNA, 22 bp, Caenorhabditis elegans
tatatacttgaatacagttgtg

SEQ ID NO: 230067 - DNA, 23 bp, Caenorhabditis elegans
tgcagctgtcatggtttttgaga

SEQ ID NO: 230068 - DNA, 22 bp, Caenorhabditis elegans
tttttttttgaaaacctatgat

SEQ ID NO: 230069 - DNA, 23 bp, Caenorhabditis elegans
cactttctctctctgcctcagca

SEQ ID NO: 230070 - DNA, 23 bp, Caenorhabditis elegans
tatttatgtattgatgcactaca

SEQ ID NO: 230071 - DNA, 23 bp, Caenorhabditis elegans
gttttctccattatttttcgagt

SEQ ID NO: 230072 - DNA, 22 bp, Caenorhabditis elegans
ttacagttcgagaaaatctcga

SEQ ID NO: 230073 - DNA, 18 bp, Caenorhabditis elegans
atacgtaaatttttctgt

SEQ ID NO: 230074 - DNA, 23 bp, Caenorhabditis elegans
caactctttcatatattttctga

SEQ ID NO: 230075 - DNA, 23 bp, Caenorhabditis elegans
aaattttgaaaaagaattgggat

SEQ ID NO: 230076 - DNA, 21 bp, Caenorhabditis elegans
tgggtctcgcagcgatattct

SEQ ID NO: 230077 - DNA, 19 bp, Caenorhabditis elegans
tgtggaattttttttttga

SEQ ID NO: 230078 - DNA, 23 bp, Caenorhabditis elegans
ttctaggaacttctagaaatttc

SEQ ID NO: 230079 - DNA, 22 bp, Caenorhabditis elegans
ctagagaaaagttgaatatgtt

SEQ ID NO: 230080 - DNA, 23 bp, Caenorhabditis elegans
gtagtttctatttttctatttga

SEQ ID NO: 230081 - DNA, 19 bp, Caenorhabditis elegans
tgggaattttacttcattg

SEQ ID NO: 230082 - DNA, 23 bp, Caenorhabditis elegans
ttcaatgtttttcaaaacggtta

SEQ ID NO: 230083 - DNA, 23 bp, Caenorhabditis elegans
aagcattctggaaaatttttgaa

SEQ ID NO: 230084 - DNA, 23 bp, Caenorhabditis elegans
tgaaatgtaatgaagctatagtt

SEQ ID NO: 230085 - DNA, 21 bp, Caenorhabditis elegans
acagatgtgtgcaaactgtac

SEQ ID NO: 230086 - DNA, 22 bp, Caenorhabditis elegans
tttgcgaatagttttagtgtct

SEQ ID NO: 230087 - DNA, 23 bp, Caenorhabditis elegans
attgatttcaaattttgttctag

SEQ ID NO: 230088 - DNA, 19 bp, Caenorhabditis elegans
tatatacttgaatacagtt

SEQ ID NO: 230089 - DNA, 23 bp, Caenorhabditis elegans
tacatgagcattttcataccata

SEQ ID NO: 230090 - DNA, 20 bp, Caenorhabditis elegans
atccaagttttgccaaagtt

SEQ ID NO: 230091 - DNA, 21 bp, Caenorhabditis elegans
gccagaagaactagctgttaa

SEQ ID NO: 230092 - DNA, 23 bp, Caenorhabditis elegans
tttacttagtttttcattactaa

SEQ ID NO: 230093 - DNA, 23 bp, Caenorhabditis elegans
ttatcagaaaaattttaactgac

SEQ ID NO: 230094 - DNA, 21 bp, Caenorhabditis elegans
tattttaccagttaaacattt

SEQ ID NO: 230095 - DNA, 23 bp, Caenorhabditis elegans
atgttgtttgtgtatctctacag

SEQ ID NO: 230096 - DNA, 23 bp, Caenorhabditis elegans
tgttttgacgtagaaattgtatg

SEQ ID NO: 230097 - DNA, 20 bp, Caenorhabditis elegans
tccctctctgcgtctctcgc

SEQ ID NO: 230098 - DNA, 21 bp, Caenorhabditis elegans
ttcagcatgtgaagtggactg

SEQ ID NO: 230099 - DNA, 21 bp, Caenorhabditis elegans
gttaaaggtctatatctcagc

SEQ ID NO: 230100 - DNA, 22 bp, Caenorhabditis elegans
aactctagcgattttgttgtag

SEQ ID NO: 230101 - DNA, 19 bp, Caenorhabditis elegans
gattgcacgtgtcgctgag

SEQ ID NO: 230102 - DNA, 23 bp, Caenorhabditis elegans
gtgactttgtctctgtgtgtgcg

SEQ ID NO: 230103 - DNA, 23 bp, Caenorhabditis elegans
tcactgttgagagtgtgctcact

SEQ ID NO: 230104 - DNA, 23 bp, Caenorhabditis elegans
gctcgctgcctgcgtctctgtgt

SEQ ID NO: 230105 - DNA, 21 bp, Caenorhabditis elegans
gactggaagaaaaactcactt

SEQ ID NO: 230106 - DNA, 20 bp, Caenorhabditis elegans
tcggtaatctaaacttttcg

SEQ ID NO: 230107 - DNA, 23 bp, Caenorhabditis elegans
aaatgcatgaatactcgtttgga

SEQ ID NO: 230108 - DNA, 19 bp, Caenorhabditis elegans
tgcccgcctctttcttccg

SEQ ID NO: 230109 - DNA, 22 bp, Caenorhabditis elegans
aaacattttggagaggaagtgg

SEQ ID NO: 230110 - DNA, 23 bp, Caenorhabditis elegans
ggcaagaattagaagcagtttgg

SEQ ID NO: 230111 - DNA, 23 bp, Caenorhabditis elegans
tactcactcactgcttcttgttt

SEQ ID NO: 230112 - DNA, 23 bp, Caenorhabditis elegans
gtacatagtgactctgattttcc

SEQ ID NO: 230113 - DNA, 23 bp, Caenorhabditis elegans
tctcagaagatacacagcagcta

SEQ ID NO: 230114 - DNA, 18 bp, Caenorhabditis elegans
tgttaaatttgaaacctg

SEQ ID NO: 230115 - DNA, 18 bp, Caenorhabditis elegans
atatatcatgttttagat

SEQ ID NO: 230116 - DNA, 22 bp, Caenorhabditis elegans
aacaagatggaagttttctaag

SEQ ID NO: 230117 - DNA, 23 bp, Caenorhabditis elegans
atttcaaaagtatacaagttttt

SEQ ID NO: 230118 - DNA, 19 bp, Caenorhabditis elegans
aataatagagatgcgattc

SEQ ID NO: 230119 - DNA, 19 bp, Caenorhabditis elegans
tggcaaagaaaagagtatc

SEQ ID NO: 230120 - DNA, 23 bp, Caenorhabditis elegans
ttttctcactgtgtttattttgt

SEQ ID NO: 230121 - DNA, 19 bp, Caenorhabditis elegans
atagagggtggttcaattc

SEQ ID NO: 230122 - DNA, 19 bp, Caenorhabditis elegans
ttttttcatttgagacgcg

SEQ ID NO: 230123 - DNA, 20 bp, Caenorhabditis elegans
accgaagtgaagaaaatgct

SEQ ID NO: 230124 - DNA, 23 bp, Caenorhabditis elegans
tctctccgcttcttttctcactc

SEQ ID NO: 230125 - DNA, 20 bp, Caenorhabditis elegans
tctgtgggtgtgtgtgaggc

SEQ ID NO: 230126 - DNA, 23 bp, Caenorhabditis elegans
ctgtcaaactctgtcgaactttt

SEQ ID NO: 230127 - DNA, 23 bp, Caenorhabditis elegans
aattttaggtctaatagtatcag

SEQ ID NO: 230128 - DNA, 23 bp, Caenorhabditis elegans
agttcagataaagaaaacggtga

SEQ ID NO: 230129 - DNA, 23 bp, Caenorhabditis elegans
atatgtgtataattttttgacag

SEQ ID NO: 230130 - DNA, 22 bp, Caenorhabditis elegans
tttttcagttgcaaatttaaag

SEQ ID NO: 230131 - DNA, 23 bp, Caenorhabditis elegans
gaatttcacactgataaagaaca

SEQ ID NO: 230132 - DNA, 19 bp, Caenorhabditis elegans
aaaccaactttttgccttt

SEQ ID NO: 230133 - DNA, 22 bp, Caenorhabditis elegans
gagtatcaggagtacccagtga

SEQ ID NO: 230134 - DNA, 18 bp, Caenorhabditis elegans
tagactttggtaaagctt

SEQ ID NO: 230135 - DNA, 20 bp, Caenorhabditis elegans
aatccaagttttgccaaagt

SEQ ID NO: 230136 - DNA, 19 bp, Caenorhabditis elegans
tatatacttgaatacagtt

SEQ ID NO: 230137 - DNA, 23 bp, Caenorhabditis elegans
aaagttctagaacatttcagata

SEQ ID NO: 230138 - DNA, 23 bp, Caenorhabditis elegans
tctcgctgtctgcgtctcttctc

SEQ ID NO: 230139 - DNA, 21 bp, Caenorhabditis elegans
agagacgagagtgtgcagaga

SEQ ID NO: 230140 - DNA, 23 bp, Caenorhabditis elegans
atgtcacagagtacttgatatcc

SEQ ID NO: 230141 - DNA, 23 bp, Caenorhabditis elegans
aagttgcagtgtacaatacatgt

SEQ ID NO: 230142 - DNA, 18 bp, Caenorhabditis elegans
aaaattttgaagttgtgg

SEQ ID NO: 230143 - DNA, 23 bp, Caenorhabditis elegans
tttttctggaaatttatcgattt

SEQ ID NO: 230144 - DNA, 20 bp, Caenorhabditis elegans
tctgaaaatttattgatttt

SEQ ID NO: 230145 - DNA, 19 bp, Caenorhabditis elegans
tttctgaatgttcactgat

SEQ ID NO: 230146 - DNA, 23 bp, Caenorhabditis elegans
ttttctggaaatttattgatttt

SEQ ID NO: 230147 - DNA, 18 bp, Caenorhabditis elegans
aattgattgatttttctg

SEQ ID NO: 230148 - DNA, 23 bp, Caenorhabditis elegans
tctcactgtctgcgtctcttctc

SEQ ID NO: 230149 - DNA, 19 bp, Caenorhabditis elegans
taagctagaaatttgaatt

SEQ ID NO: 230150 - DNA, 23 bp, Caenorhabditis elegans
atttttctggaaaattattgatt

SEQ ID NO: 230151 - DNA, 22 bp, Caenorhabditis elegans
tttctggaaatttattgatttt

SEQ ID NO: 230152 - DNA, 22 bp, Caenorhabditis elegans
tttgaaactatttgatatcagc

SEQ ID NO: 230153 - DNA, 23 bp, Caenorhabditis elegans
agggcaatagaagaaaatgtttc

SEQ ID NO: 230154 - DNA, 23 bp, Caenorhabditis elegans
actctctgcgtctctctgtctct

SEQ ID NO: 230155 - DNA, 23 bp, Caenorhabditis elegans
agatgtaaagttttcaactttta

SEQ ID NO: 230156 - DNA, 19 bp, Caenorhabditis elegans
tttgaggtttgagaaacgg

SEQ ID NO: 230157 - DNA, 19 bp, Caenorhabditis elegans
tttttggacattttagatt

SEQ ID NO: 230158 - DNA, 23 bp, Caenorhabditis elegans
taacgcatatttttcttttgaac

SEQ ID NO: 230159 - DNA, 23 bp, Caenorhabditis elegans
agtatgtatagtagtatgtgtag

SEQ ID NO: 230160 - DNA, 18 bp, Caenorhabditis elegans
tgcatagtacatgtatgt

SEQ ID NO: 230161 - DNA, 22 bp, Caenorhabditis elegans
aggaaagttaagaagtttgcag

SEQ ID NO: 230162 - DNA, 20 bp, Caenorhabditis elegans
ttttctagaagtttccagat

SEQ ID NO: 230163 - DNA, 19 bp, Caenorhabditis elegans
aaaaattttgaagttgtgg

SEQ ID NO: 230164 - DNA, 19 bp, Caenorhabditis elegans
tctggaaatttatggattt

SEQ ID NO: 230165 - DNA, 19 bp, Caenorhabditis elegans
tttggaaatttattgattt

SEQ ID NO: 230166 - DNA, 18 bp, Caenorhabditis elegans
tttggaaatttattgatt

SEQ ID NO: 230167 - DNA, 22 bp, Caenorhabditis elegans
tcatgaaatttatcgatttttc

SEQ ID NO: 230168 - DNA, 23 bp, Caenorhabditis elegans
atttttctggaaaatttttgaaa

SEQ ID NO: 230169 - DNA, 19 bp, Caenorhabditis elegans
tttttcgaatttttcatga

SEQ ID NO: 230170 - DNA, 23 bp, Caenorhabditis elegans
atttttctggaaaatttttgaaa

SEQ ID NO: 230171 - DNA, 19 bp, Caenorhabditis elegans
tttttcgaatttttcatga

SEQ ID NO: 230172 - DNA, 23 bp, Caenorhabditis elegans
atttttctggaaaatttttgaaa

SEQ ID NO: 230173 - DNA, 19 bp, Caenorhabditis elegans
tttttcgaatttttcatga

SEQ ID NO: 230174 - DNA, 19 bp, Caenorhabditis elegans
ttagatgtaggtgttaggt

SEQ ID NO: 230175 - DNA, 21 bp, Caenorhabditis elegans
tttaagtttttctgcaaacag

SEQ ID NO: 230176 - DNA, 23 bp, Caenorhabditis elegans
cattgagagctgagagagacgag

SEQ ID NO: 230177 - DNA, 23 bp, Caenorhabditis elegans
atttggtagtttttcaacggttt

SEQ ID NO: 230178 - DNA, 18 bp, Caenorhabditis elegans
aaccggtgaaaaaccacc

SEQ ID NO: 230179 - DNA, 18 bp, Caenorhabditis elegans
atatacttgaatacagtt

SEQ ID NO: 230180 - DNA, 23 bp, Caenorhabditis elegans
gactgactgacagactatattgt

SEQ ID NO: 230181 - DNA, 23 bp, Caenorhabditis elegans
atatgtgtataattttttgacag

SEQ ID NO: 230182 - DNA, 22 bp, Caenorhabditis elegans
tttttcagttgcaaatttaaag

SEQ ID NO: 230183 - DNA, 23 bp, Caenorhabditis elegans
gaatttcacactgataaagaaca

SEQ ID NO: 230184 - DNA, 21 bp, Caenorhabditis elegans
gttaaaggtctatatctcagc

SEQ ID NO: 230185 - DNA, 20 bp, Caenorhabditis elegans
atatgtctgaaggtcagttt

SEQ ID NO: 230186 - DNA, 20 bp, Caenorhabditis elegans
aaatttatttgcaaatctga

SEQ ID NO: 230187 - DNA, 23 bp, Caenorhabditis elegans
atcagaagctttttcttgggttt

SEQ ID NO: 230188 - DNA, 21 bp, Caenorhabditis elegans
tttcagacagaaaaaaaagtg

SEQ ID NO: 230189 - DNA, 23 bp, Caenorhabditis elegans
tagagttttgagctctttggttt

SEQ ID NO: 230190 - DNA, 23 bp, Caenorhabditis elegans
tggcaagagtttggtaaaacttg

SEQ ID NO: 230191 - DNA, 23 bp, Caenorhabditis elegans
ctgaatccaagttttgccaaagt

SEQ ID NO: 230192 - DNA, 23 bp, Caenorhabditis elegans
tctcgctctctcattgcattttg

SEQ ID NO: 230193 - DNA, 22 bp, Caenorhabditis elegans
tgtcgtcgtgctcctcctcttt

SEQ ID NO: 230194 - DNA, 22 bp, Caenorhabditis elegans
agagatggatgatgaatcagat

SEQ ID NO: 230195 - DNA, 23 bp, Caenorhabditis elegans
atgaggaagtggtggaatagaca

SEQ ID NO: 230196 - DNA, 22 bp, Caenorhabditis elegans
aaaggatgtatgaattattcta

SEQ ID NO: 230197 - DNA, 22 bp, Caenorhabditis elegans
ttgaggtaggtgcgagaaatga

SEQ ID NO: 230198 - DNA, 22 bp, Caenorhabditis elegans
ttgtctctcagctgcttcatct

SEQ ID NO: 230199 - DNA, 23 bp, Caenorhabditis elegans
tgaggtaggctcagtagatgcga

SEQ ID NO: 230200 - DNA, 23 bp, Caenorhabditis elegans
tcgcattcccagagtttacggta

SEQ ID NO: 230201 - DNA, 23 bp, Caenorhabditis elegans
tggagaaatgtagttgaatggag

SEQ ID NO: 230202 - DNA, 22 bp, Caenorhabditis elegans
gtatgatttgtgtgtatattta

SEQ ID NO: 230203 - DNA, 23 bp, Caenorhabditis elegans
ttaaattgtagcacataaagttg

SEQ ID NO: 230204 - DNA, 20 bp, Caenorhabditis elegans
agcttcctaaatattgcttt

SEQ ID NO: 230205 - DNA, 22 bp, Caenorhabditis elegans
tactgtgagagtcaattgggag

SEQ ID NO: 230206 - DNA, 23 bp, Caenorhabditis elegans
taagaaatacatctccaaatcga

SEQ ID NO: 230207 - DNA, 21 bp, Caenorhabditis elegans
gtgagcaaagtttcaggtgtg

SEQ ID NO: 230208 - DNA, 23 bp, Caenorhabditis elegans
tgactagaaccgttactcatctc

SEQ ID NO: 230209 - DNA, 23 bp, Caenorhabditis elegans
atcacagtcaactgttggcatgg

SEQ ID NO: 230210 - DNA, 23 bp, Caenorhabditis elegans
tccctctgtgcctctctctattc

SEQ ID NO: 230211 - DNA, 20 bp, Caenorhabditis elegans
acagcagcctcagaggtgca

SEQ ID NO: 230212 - DNA, 23 bp, Caenorhabditis elegans
attttgacaaacttaagttatga

SEQ ID NO: 230213 - DNA, 22 bp, Caenorhabditis elegans
tgtctgactttctgactgtctg

SEQ ID NO: 230214 - DNA, 22 bp, Caenorhabditis elegans
accaattgatttgagcttcatt

SEQ ID NO: 230215 - DNA, 20 bp, Caenorhabditis elegans
ttaaaggtctatatcttggc

SEQ ID NO: 230216 - DNA, 22 bp, Caenorhabditis elegans
tccagcaggttttctttttgaa

SEQ ID NO: 230217 - DNA, 22 bp, Caenorhabditis elegans
agtaaatctcatcctaatctgg

SEQ ID NO: 230218 - DNA, 21 bp, Caenorhabditis elegans
tgccaccgatttggcatggga

SEQ ID NO: 230219 - DNA, 23 bp, Caenorhabditis elegans
ctgaactatatgtagtcagttgg

SEQ ID NO: 230220 - DNA, 23 bp, Caenorhabditis elegans
agtgttgataggttttctggaag

SEQ ID NO: 230221 - DNA, 23 bp, Caenorhabditis elegans
gcttcttcagcagtaaattccgt

SEQ ID NO: 230222 - DNA, 21 bp, Caenorhabditis elegans
atttctcaattagtttatttc

SEQ ID NO: 230223 - DNA, 23 bp, Caenorhabditis elegans
tgaatgaacaagaattgcatgat

SEQ ID NO: 230224 - DNA, 23 bp, Caenorhabditis elegans
cattgagtatttctttatgtttg

SEQ ID NO: 230225 - DNA, 22 bp, Caenorhabditis elegans
atttgagttatgttaagatgtt

SEQ ID NO: 230226 - DNA, 23 bp, Caenorhabditis elegans
taaacattgatttcaaaaacagg

SEQ ID NO: 230227 - DNA, 22 bp, Caenorhabditis elegans
tagactgtttttgaaaatgcaa

SEQ ID NO: 230228 - DNA, 23 bp, Caenorhabditis elegans
tatagttctttgtgaaacgattt

SEQ ID NO: 230229 - DNA, 22 bp, Caenorhabditis elegans
tggaatgcatagaagactgtac

SEQ ID NO: 230230 - DNA, 22 bp, Caenorhabditis elegans
aaacgatgaaaactatcgaaat

SEQ ID NO: 230231 - DNA, 23 bp, Caenorhabditis elegans
taatacgtcgttggtgtttccat

SEQ ID NO: 230232 - DNA, 23 bp, Caenorhabditis elegans
gaaagagagaaacgtagtgtgtc

SEQ ID NO: 230233 - DNA, 23 bp, Caenorhabditis elegans
agagttgtcaatttgttattttg

SEQ ID NO: 230234 - DNA, 21 bp, Caenorhabditis elegans
gttaaaggtctatatctcagc

SEQ ID NO: 230235 - DNA, 23 bp, Caenorhabditis elegans
tctctgatccacacactctctca

SEQ ID NO: 230236 - DNA, 23 bp, Caenorhabditis elegans
tctgtgtgtgtgtgtgtgtcaaa

SEQ ID NO: 230237 - DNA, 21 bp, Caenorhabditis elegans
cagagagaagagttagaggtg

SEQ ID NO: 230238 - DNA, 22 bp, Caenorhabditis elegans
gtgagtgtgtacattttgtggt

SEQ ID NO: 230239 - DNA, 21 bp, Caenorhabditis elegans
cacacctcactaacactgacc

SEQ ID NO: 230240 - DNA, 23 bp, Caenorhabditis elegans
aatccaagttttgccaaagtttt

SEQ ID NO: 230241 - DNA, 21 bp, Caenorhabditis elegans
aatccaagttttgccaaactt

SEQ ID NO: 230242 - DNA, 21 bp, Caenorhabditis elegans
tctgcatttctatatcaattt

SEQ ID NO: 230243 - DNA, 23 bp, Caenorhabditis elegans
ttttctgaatttgaatttgtgtt

SEQ ID NO: 230244 - DNA, 22 bp, Caenorhabditis elegans
aaattgaaattgtggagcttga

SEQ ID NO: 230245 - DNA, 23 bp, Caenorhabditis elegans
cgaaaatgattttctgatgttta

SEQ ID NO: 230246 - DNA, 23 bp, Caenorhabditis elegans
ctctgcgtctctcactctttgag

SEQ ID NO: 230247 - DNA, 19 bp, Caenorhabditis elegans
tatatacttgaatacagtt

SEQ ID NO: 230248 - DNA, 19 bp, Caenorhabditis elegans
tatatacttgaatacagtt

SEQ ID NO: 230249 - DNA, 19 bp, Caenorhabditis elegans
atagttcttgatgtgttct

SEQ ID NO: 230250 - DNA, 23 bp, Caenorhabditis elegans
gacgtcactcaatttcgaggtca

SEQ ID NO: 230251 - DNA, 20 bp, Caenorhabditis elegans
tggcatttttagaaaagggt

SEQ ID NO: 230252 - DNA, 21 bp, Caenorhabditis elegans
ttttgcacatttttctggaaa

SEQ ID NO: 230253 - DNA, 21 bp, Caenorhabditis elegans
ttttgcacatttttctggaaa

SEQ ID NO: 230254 - DNA, 18 bp, Caenorhabditis elegans
aatggttaatttttcttt

SEQ ID NO: 230255 - DNA, 19 bp, Caenorhabditis elegans
agtttggcaagagttgggt

SEQ ID NO: 230256 - DNA, 23 bp, Caenorhabditis elegans
tgaatccaagttttgccaaagtt

SEQ ID NO: 230257 - DNA, 23 bp, Caenorhabditis elegans
tccagaattgtacagggctttga

SEQ ID NO: 230258 - DNA, 19 bp, Caenorhabditis elegans
aaaaatgtgaggattggaa

SEQ ID NO: 230259 - DNA, 20 bp, Caenorhabditis elegans
tgtcagcctgcctcattgcg

SEQ ID NO: 230260 - DNA, 23 bp, Caenorhabditis elegans
aaatgcatttaaatacatttgtg

SEQ ID NO: 230261 - DNA, 23 bp, Caenorhabditis elegans
tctgtgtgtctctgtgtgagtgt

SEQ ID NO: 230262 - DNA, 21 bp, Caenorhabditis elegans
ttttgttgttgaaagaacttt

SEQ ID NO: 230263 - DNA, 21 bp, Caenorhabditis elegans
tcaagtaatgtagcaaaatgt

SEQ ID NO: 230264 - DNA, 20 bp, Caenorhabditis elegans
tttcagcatgttgtgctctt

SEQ ID NO: 230265 - DNA, 23 bp, Caenorhabditis elegans
tttctggaaatttattgattttt

SEQ ID NO: 230266 - DNA, 19 bp, Caenorhabditis elegans
ctagaaatttattgatttt

SEQ ID NO: 230267 - DNA, 18 bp, Caenorhabditis elegans
ttctggaatttttcagat

SEQ ID NO: 230268 - DNA, 21 bp, Caenorhabditis elegans
ggttttgagaggaatcctttt

SEQ ID NO: 230269 - DNA, 21 bp, Caenorhabditis elegans
actgtagaaggaagcctgcac

SEQ ID NO: 230270 - DNA, 21 bp, Caenorhabditis elegans
ggttttgagaggaatcctttt

SEQ ID NO: 230271 - DNA, 21 bp, Caenorhabditis elegans
actgtagaaggaagcctgcac

SEQ ID NO: 230272 - DNA, 23 bp, Caenorhabditis elegans
tgtaacagcggctggaaactagt

SEQ ID NO: 230273 - DNA, 23 bp, Caenorhabditis elegans
ctttactctgtctctctttctcc

SEQ ID NO: 230274 - DNA, 22 bp, Caenorhabditis elegans
cctgagagaagagtgagtgatg

SEQ ID NO: 230275 - DNA, 23 bp, Caenorhabditis elegans
ttttgaacacattcgttgtaatg

SEQ ID NO: 230276 - DNA, 23 bp, Caenorhabditis elegans
atgtaagttgttttgatgctcaa

SEQ ID NO: 230277 - DNA, 22 bp, Caenorhabditis elegans
ttctctctagatgtatatttca

SEQ ID NO: 230278 - DNA, 23 bp, Caenorhabditis elegans
ttagttctagttcttttcataag

SEQ ID NO: 230279 - DNA, 21 bp, Caenorhabditis elegans
ttcaggtcccgttatgtgtcg

SEQ ID NO: 230280 - DNA, 23 bp, Caenorhabditis elegans
ttttgagaggtcctagaatcccg

SEQ ID NO: 230281 - DNA, 20 bp, Caenorhabditis elegans
tatttccacaaactggcacg

SEQ ID NO: 230282 - DNA, 23 bp, Caenorhabditis elegans
gtactgtagtgatatggttgaag

SEQ ID NO: 230283 - DNA, 23 bp, Caenorhabditis elegans
tggcaagatgtaggcagttcagt

SEQ ID NO: 230284 - DNA, 18 bp, Caenorhabditis elegans
tctctttcccagcctaca

SEQ ID NO: 230285 - DNA, 22 bp, Caenorhabditis elegans
tggcaagaaatggcagtctaca

SEQ ID NO: 230286 - DNA, 23 bp, Caenorhabditis elegans
tctactttcttgttgctttgaag

SEQ ID NO: 230287 - DNA, 22 bp, Caenorhabditis elegans
ttaaagctaccaaccggcttca

SEQ ID NO: 230288 - DNA, 23 bp, Caenorhabditis elegans
tcactgaagagtgttaggtgaac

SEQ ID NO: 230289 - DNA, 23 bp, Caenorhabditis elegans
tgagatcatcgtgaaagctagtt

SEQ ID NO: 230290 - DNA, 21 bp, Caenorhabditis elegans
ttaacggtccatatcttggca

SEQ ID NO: 230291 - DNA, 20 bp, Caenorhabditis elegans
tattgcatattttggtattt

SEQ ID NO: 230292 - DNA, 20 bp, Caenorhabditis elegans
tcactcagtttttagactca

SEQ ID NO: 230293 - DNA, 23 bp, Caenorhabditis elegans
agatgatagtgcttgcagtaaac

SEQ ID NO: 230294 - DNA, 20 bp, Caenorhabditis elegans
tcgccgggtgggaaagcatt

SEQ ID NO: 230295 - DNA, 18 bp, Caenorhabditis elegans
tgtcagtgctttttgtaa

SEQ ID NO: 230296 - DNA, 18 bp, Caenorhabditis elegans
ttcgaaagtagtaaggcg

SEQ ID NO: 230297 - DNA, 22 bp, Caenorhabditis elegans
aggcaagactttggcaaagctt

SEQ ID NO: 230298 - DNA, 20 bp, Caenorhabditis elegans
aatccaagttttgccaaagt

SEQ ID NO: 230299 - DNA, 23 bp, Caenorhabditis elegans
acatttgatgtttctcaattctt

SEQ ID NO: 230300 - DNA, 19 bp, Caenorhabditis elegans
aagaccagtctaaaaattg

SEQ ID NO: 230301 - DNA, 21 bp, Caenorhabditis elegans
aattcaacaaactcagactgc

SEQ ID NO: 230302 - DNA, 23 bp, Caenorhabditis elegans
aatctgctcactctctctgtcaa

SEQ ID NO: 230303 - DNA, 23 bp, Caenorhabditis elegans
taagtgatgacagtgagctgtct

SEQ ID NO: 230304 - DNA, 23 bp, Caenorhabditis elegans
tgactagagcctattctcttctt

SEQ ID NO: 230305 - DNA, 19 bp, Caenorhabditis elegans
agttgaacgatttgggtgt

SEQ ID NO: 230306 - DNA, 23 bp, Caenorhabditis elegans
cagcttcatcttcatcatcttca

SEQ ID NO: 230307 - DNA, 23 bp, Caenorhabditis elegans
gtattagttgtgcgaccaggaga

SEQ ID NO: 230308 - DNA, 23 bp, Caenorhabditis elegans
agctagagtcttgaaaaaatgtt

SEQ ID NO: 230309 - DNA, 21 bp, Caenorhabditis elegans
gtcagtgcaattgcaagtggt

SEQ ID NO: 230310 - DNA, 21 bp, Caenorhabditis elegans
atcagtgcaactgcaagtggt

SEQ ID NO: 230311 - DNA, 19 bp, Caenorhabditis elegans
acaatttgtcatctcagtc

SEQ ID NO: 230312 - DNA, 21 bp, Caenorhabditis elegans
agatttgagacacattgagct

SEQ ID NO: 230313 - DNA, 23 bp, Caenorhabditis elegans
aaatgacaggtttagtttttcta

SEQ ID NO: 230314 - DNA, 21 bp, Caenorhabditis elegans
gtagatttggatagtatagaa

SEQ ID NO: 230315 - DNA, 20 bp, Caenorhabditis elegans
attgtttttgaatatcatat

SEQ ID NO: 230316 - DNA, 21 bp, Caenorhabditis elegans
ccatgcttttcatatgattct

SEQ ID NO: 230317 - DNA, 22 bp, Caenorhabditis elegans
atctagctgaaattgatgttta

SEQ ID NO: 230318 - DNA, 21 bp, Caenorhabditis elegans
tagaaactttttcaaatcgag

SEQ ID NO: 230319 - DNA, 22 bp, Caenorhabditis elegans
tactggcccccaaatcttcgct

SEQ ID NO: 230320 - DNA, 23 bp, Caenorhabditis elegans
tccctgagaattctcgaacagct

SEQ ID NO: 230321 - DNA, 23 bp, Caenorhabditis elegans
gtcactctttgtgtctgagagca

SEQ ID NO: 230322 - DNA, 19 bp, Caenorhabditis elegans
tctcgctcccaaagttggc

SEQ ID NO: 230323 - DNA, 22 bp, Caenorhabditis elegans
tctcgaaaaccatcacaaaatc

SEQ ID NO: 230324 - DNA, 23 bp, Caenorhabditis elegans
aagcaccacgagaagctgcagat

SEQ ID NO: 230325 - DNA, 23 bp, Caenorhabditis elegans
agacaagtcgttttgaggtacaa

SEQ ID NO: 230326 - DNA, 23 bp, Caenorhabditis elegans
ttaagtagtggtgccgctcttat

SEQ ID NO: 230327 - DNA, 23 bp, Caenorhabditis elegans
aaaacttcttcttgaacagcttg

SEQ ID NO: 230328 - DNA, 22 bp, Caenorhabditis elegans
accaattgatttgagcttcatt

SEQ ID NO: 230329 - DNA, 20 bp, Caenorhabditis elegans
ttaaaggtctatatcttggc

SEQ ID NO: 230330 - DNA, 23 bp, Caenorhabditis elegans
gatattcacattatgttcatcag

SEQ ID NO: 230331 - DNA, 23 bp, Caenorhabditis elegans
tttgtactacacataggtactgg

SEQ ID NO: 230332 - DNA, 23 bp, Caenorhabditis elegans
gtctagtgcaaacattgctcggt

SEQ ID NO: 230333 - DNA, 21 bp, Caenorhabditis elegans
atatgcaagttatttgatagt

SEQ ID NO: 230334 - DNA, 22 bp, Caenorhabditis elegans
aatatgaactaaatcatatcac

SEQ ID NO: 230335 - DNA, 23 bp, Caenorhabditis elegans
ctgtctctctctcactccgctgt

SEQ ID NO: 230336 - DNA, 23 bp, Caenorhabditis elegans
aaatgatatgtaatctagcttac

SEQ ID NO: 230337 - DNA, 23 bp, Caenorhabditis elegans
gctcactgtttcaaaatacagtc

SEQ ID NO: 230338 - DNA, 22 bp, Caenorhabditis elegans
aaggaacttcaaaggctgaaaa

SEQ ID NO: 230339 - DNA, 22 bp, Caenorhabditis elegans
aattttcaacaagttggtgata

SEQ ID NO: 230340 - DNA, 19 bp, Caenorhabditis elegans
tcacttcggccattcttct

SEQ ID NO: 230341 - DNA, 20 bp, Caenorhabditis elegans
agagcagtctattgacagtc

SEQ ID NO: 230342 - DNA, 23 bp, Caenorhabditis elegans
tactgtcatggaggcgctctctt

SEQ ID NO: 230343 - DNA, 23 bp, Caenorhabditis elegans
aacaagtcacagactctgtgttt

SEQ ID NO: 230344 - DNA, 21 bp, Caenorhabditis elegans
aatcaactacgatgtgtttgt

SEQ ID NO: 230345 - DNA, 18 bp, Caenorhabditis elegans
agtttgatgttgtggagg

SEQ ID NO: 230346 - DNA, 23 bp, Caenorhabditis elegans
tttcagaaaatcaaaaaatgttt

SEQ ID NO: 230347 - DNA, 22 bp, Caenorhabditis elegans
taaggtagaaaattgcatagtt

SEQ ID NO: 230348 - DNA, 21 bp, Caenorhabditis elegans
ctatacaacctactacctcac

SEQ ID NO: 230349 - DNA, 23 bp, Caenorhabditis elegans
tggtgtcagaagattgtcacgac

SEQ ID NO: 230350 - DNA, 23 bp, Caenorhabditis elegans
tatgagttattttcactttggct

SEQ ID NO: 230351 - DNA, 21 bp, Caenorhabditis elegans
tcaagtaatgtagcaaaatgt

SEQ ID NO: 230352 - DNA, 22 bp, Caenorhabditis elegans
gagtctctggctctctgactgg

SEQ ID NO: 230353 - DNA, 20 bp, Caenorhabditis elegans
tgaaaaaaaaacttggtatg

SEQ ID NO: 230354 - DNA, 21 bp, Caenorhabditis elegans
atattgctgtagtttagcctt

SEQ ID NO: 230355 - DNA, 23 bp, Caenorhabditis elegans
taatgtagcaaaatgtatacatt

SEQ ID NO: 230356 - DNA, 23 bp, Caenorhabditis elegans
tcgttttcatttctcattttgtt

SEQ ID NO: 230357 - DNA, 21 bp, Caenorhabditis elegans
cccctctctctctcactgggc

SEQ ID NO: 230358 - DNA, 22 bp, Caenorhabditis elegans
aatcttcagattttgttgatca

SEQ ID NO: 230359 - DNA, 20 bp, Caenorhabditis elegans
tcacgttatttgattgattg

SEQ ID NO: 230360 - DNA, 23 bp, Caenorhabditis elegans
aatttctaactcgtcggtagtca

SEQ ID NO: 230361 - DNA, 23 bp, Caenorhabditis elegans
tatgacactgaagcgagttggaa

SEQ ID NO: 230362 - DNA, 19 bp, Caenorhabditis elegans
attgatcgccgtctctctc

SEQ ID NO: 230363 - DNA, 20 bp, Caenorhabditis elegans
agggttagattcgtgattga

SEQ ID NO: 230364 - DNA, 23 bp, Caenorhabditis elegans
cagggtaactgtctctcagtgtg

SEQ ID NO: 230365 - DNA, 23 bp, Caenorhabditis elegans
aaattcattttttttaaatgtgt

SEQ ID NO: 230366 - DNA, 23 bp, Caenorhabditis elegans
agagaggcaagaagctgcgaaac

SEQ ID NO: 230367 - DNA, 22 bp, Caenorhabditis elegans
ttttcagaggaatgttttaagg

SEQ ID NO: 230368 - DNA, 22 bp, Caenorhabditis elegans
tgaggtagtatgtaatattgta

SEQ ID NO: 230369 - DNA, 23 bp, Caenorhabditis elegans
agaatatcagctgttccaggtgt

SEQ ID NO: 230370 - DNA, 19 bp, Caenorhabditis elegans
tgagaacaagaaatttgct

SEQ ID NO: 230371 - DNA, 23 bp, Caenorhabditis elegans
ttgtgcatttgatgttctgtttg

SEQ ID NO: 230372 - DNA, 22 bp, Caenorhabditis elegans
tttcacattgcgtgttcttttt

SEQ ID NO: 230373 - DNA, 22 bp, Caenorhabditis elegans
tgaggtagtaggttgtatagtt

SEQ ID NO: 230374 - DNA, 23 bp, Caenorhabditis elegans
aactatgcaattttctaccttac

SEQ ID NO: 230375 - DNA, 21 bp, Caenorhabditis elegans
tagaagttgttgtagttggaa

SEQ ID NO: 230376 - DNA, 23 bp, Caenorhabditis elegans
tgtgctagtaggtttcatagttg

SEQ ID NO: 230377 - DNA, 22 bp, Caenorhabditis elegans
accaattgatttgagcttcatt

SEQ ID NO: 230378 - DNA, 20 bp, Caenorhabditis elegans
ttaaaggtctatatcttggc

SEQ ID NO: 230379 - DNA, 23 bp, Caenorhabditis elegans
acactgtgagttgttgttagttt

SEQ ID NO: 230380 - DNA, 23 bp, Caenorhabditis elegans
tttttcgaagctgttgatttgca

SEQ ID NO: 230381 - DNA, 22 bp, Caenorhabditis elegans
accaattgatttgagcttcatt

SEQ ID NO: 230382 - DNA, 20 bp, Caenorhabditis elegans
ttaaaggtctatatcttggc

SEQ ID NO: 230383 - DNA, 22 bp, Caenorhabditis elegans
agacgacgagaacattgctttt

SEQ ID NO: 230384 - DNA, 23 bp, Caenorhabditis elegans
tacccgtaatcttcataatccga

SEQ ID NO: 230385 - DNA, 22 bp, Caenorhabditis elegans
tgtctagatttggaacttaatg

SEQ ID NO: 230386 - DNA, 23 bp, Caenorhabditis elegans
tacccgtataagtttctgctgag

SEQ ID NO: 230387 - DNA, 21 bp, Caenorhabditis elegans
tactgcgaaacgaatttttct

SEQ ID NO: 230388 - DNA, 23 bp, Caenorhabditis elegans
agaaagatacatgttttgtgtta

SEQ ID NO: 230389 - DNA, 19 bp, Caenorhabditis elegans
atagcatctttctgtctcg

SEQ ID NO: 230390 - DNA, 23 bp, Caenorhabditis elegans
ttgagcaatgcgcatgtgcggga

SEQ ID NO: 230391 - DNA, 23 bp, Caenorhabditis elegans
tatacatattaattgctatgtgt

SEQ ID NO: 230392 - DNA, 23 bp, Caenorhabditis elegans
tgagattgtgctaaagttgtgtg

SEQ ID NO: 230393 - DNA, 23 bp, Caenorhabditis elegans
tgcaaatctttcgcgactgtagg

SEQ ID NO: 230394 - DNA, 20 bp, Caenorhabditis elegans
tgttaagacatttgagaggc

SEQ ID NO: 230395 - DNA, 21 bp, Caenorhabditis elegans
aatccaagttttgccaaagtt

SEQ ID NO: 230396 - DNA, 22 bp, Caenorhabditis elegans
aaaagagtcccgaaaagatgga

SEQ ID NO: 230397 - DNA, 23 bp, Caenorhabditis elegans
tagagtttggattacatttgatt

SEQ ID NO: 230398 - DNA, 23 bp, Caenorhabditis elegans
atttcaaattttgtaaatctgtg

SEQ ID NO: 230399 - DNA, 23 bp, Caenorhabditis elegans
tgagatgttggttgaaatagtgt

SEQ ID NO: 230400 - DNA, 20 bp, Caenorhabditis elegans
atctatctgagtcaaagttc

SEQ ID NO: 230401 - DNA, 23 bp, Caenorhabditis elegans
ttttgagggatgtgacttgctca

SEQ ID NO: 230402 - DNA, 23 bp, Caenorhabditis elegans
taaaatgtatatatttttagctt

SEQ ID NO: 230403 - DNA, 21 bp, Caenorhabditis elegans
agtagtcttgtgatgctaccg

SEQ ID NO: 230404 - DNA, 23 bp, Caenorhabditis elegans
tttatctacttgaataaggttgt

SEQ ID NO: 230405 - DNA, 21 bp, Caenorhabditis elegans
tcaagtaatgtagcaaaatgt

SEQ ID NO: 230406 - DNA, 19 bp, Caenorhabditis elegans
atgagaaacgtgttagagt

SEQ ID NO: 230407 - DNA, 21 bp, Caenorhabditis elegans
aaccggaaaatttgagcattg

SEQ ID NO: 230408 - DNA, 22 bp, Caenorhabditis elegans
tgagagcgcgtttattttgagt

SEQ ID NO: 230409 - DNA, 23 bp, Caenorhabditis elegans
gaagtgagagaagactgagagga

SEQ ID NO: 230410 - DNA, 18 bp, Caenorhabditis elegans
agcacatacacactcact

SEQ ID NO: 230411 - DNA, 18 bp, Caenorhabditis elegans
tgagcatattttggcgag

SEQ ID NO: 230412 - DNA, 23 bp, Caenorhabditis elegans
aatgaaattagttttgaatactt

SEQ ID NO: 230413 - DNA, 18 bp, Caenorhabditis elegans
tcagtacagtcaaagatc

SEQ ID NO: 230414 - DNA, 22 bp, Caenorhabditis elegans
tattttggttatgaaaaagaat

SEQ ID NO: 230415 - DNA, 23 bp, Caenorhabditis elegans
cacacactgtatcgtaatctgtg

SEQ ID NO: 230416 - DNA, 23 bp, Caenorhabditis elegans
tgatattttttcaaggtaagtga

SEQ ID NO: 230417 - DNA, 23 bp, Caenorhabditis elegans
agatgtgttactatgctcattct

SEQ ID NO: 230418 - DNA, 23 bp, Caenorhabditis elegans
accaagtggagttggtggttgaa

SEQ ID NO: 230419 - DNA, 23 bp, Caenorhabditis elegans
aggagcttggcaattctgtgtca

SEQ ID NO: 230420 - DNA, 20 bp, Caenorhabditis elegans
atagcggtttcagtggtgca

SEQ ID NO: 230421 - DNA, 23 bp, Caenorhabditis elegans
ctgtcattgtcactgtctgtgtg

SEQ ID NO: 230422 - DNA, 19 bp, Caenorhabditis elegans
ataggtggaagttgaaagc

SEQ ID NO: 230423 - DNA, 20 bp, Caenorhabditis elegans
gccttgatggttgcaatgta

SEQ ID NO: 230424 - DNA, 23 bp, Caenorhabditis elegans
tttgaaattcaagcttaaaactt

SEQ ID NO: 230425 - DNA, 23 bp, Caenorhabditis elegans
ttgatgtgtattgtcggtcagtt

SEQ ID NO: 230426 - DNA, 23 bp, Caenorhabditis elegans
tgagcaggccagaatttgggata

SEQ ID NO: 230427 - DNA, 22 bp, Caenorhabditis elegans
tgtgactgcgtagtgtatcgtt

SEQ ID NO: 230428 - DNA, 21 bp, Caenorhabditis elegans
atgactgaacagtgagagcag

SEQ ID NO: 230429 - DNA, 18 bp, Caenorhabditis elegans
tttcgcactcattttatt

SEQ ID NO: 230430 - DNA, 23 bp, Caenorhabditis elegans
atttccagcatctgcatgctcat

SEQ ID NO: 230431 - DNA, 23 bp, Caenorhabditis elegans
aagttgttctgtttggaaatgta

SEQ ID NO: 230432 - DNA, 23 bp, Caenorhabditis elegans
cgccttggtacaacctctgaaac

SEQ ID NO: 230433 - DNA, 23 bp, Caenorhabditis elegans
tttgaaaagatgcgtgcgtaaga

SEQ ID NO: 230434 - DNA, 22 bp, Caenorhabditis elegans
tcacaggacttttgagcgttgc

SEQ ID NO: 230435 - DNA, 23 bp, Caenorhabditis elegans
aggcagtgtggttagctggttgc

SEQ ID NO: 230436 - DNA, 20 bp, Caenorhabditis elegans
tgtgatctacagaatgacag

SEQ ID NO: 230437 - DNA, 22 bp, Caenorhabditis elegans
tgagatcatcgtgaaagccagt

SEQ ID NO: 230438 - DNA, 22 bp, Caenorhabditis elegans
agtttgacaagagttgggtcgc

SEQ ID NO: 230439 - DNA, 23 bp, Caenorhabditis elegans
tacacgtgcacggataacgctca

SEQ ID NO: 230440 - DNA, 23 bp, Caenorhabditis elegans
atgatagtgctttagatttcttg

SEQ ID NO: 230441 - DNA, 23 bp, Caenorhabditis elegans
aatatttgcagtgccccacttct

SEQ ID NO: 230442 - DNA, 23 bp, Caenorhabditis elegans
taattctcaatttttgttgttgt

SEQ ID NO: 230443 - DNA, 23 bp, Caenorhabditis elegans
ttgtacaggcctagaaattcagc

SEQ ID NO: 230444 - DNA, 23 bp, Caenorhabditis elegans
ataattatgatgatgatgatgat

SEQ ID NO: 230445 - DNA, 23 bp, Caenorhabditis elegans
gctgaaactgtatgctgtaagtg

SEQ ID NO: 230446 - DNA, 23 bp, Caenorhabditis elegans
aattgtcaagttgccaaaatctc

SEQ ID NO: 230447 - DNA, 22 bp, Caenorhabditis elegans
agaagtttgaaagtagttaagt
